United States Patent 11,180,807 (METHODS FOR DETECTING A GENETIC VARIATION IN ATTRACTIN-LIKE 1 (ATRNL1) GENE IN SUBJECT WITH PARKINSON'S DISEASE) - sequence listing, part 44

SEQ ID NO: 669 - DNA, 105803 bp, Homo sapiens
gtccctcatgtcaaactgctttattacatcttaaataacagtacagtttaatatagtatctatcttgcatccagcttccttgcagtacactgactttaaaattaaatacaaaaggtggaaaggggtaagggtgcagagagctctacagagttgttggacggaaagagaaagaaggggtttcatttgtattctctttgccagatccaggcctaccgcaaggtcacagcacagttttgtatagaatgttgcagaaaacaggatggagaagccactactgctgctatgaaggagtgcggggggcggggcggggggtcccacagaacctgctttccaaacgctgctgctgaacactggccttgaaatgaacaccaggacaatctgtgtgtgatgggaatgagccacctcagatgtggagggccctgaagaatccatataggagggcaggctcttcactccctctccctccctctctctccctccccaccctcagaatccaacagcagtcgtttgcaacagaacttttttttttttaaagaaataaagaaaacagtgacttatcccgctacccaagcgtgtagagccgcgcgctgtactgcttccgatatgtgccacagagcagcaacgagaagtggacagagccgcaatggttacaactgtaagaggttatttcttaaaagaaaaagaacacctaaggactgagtcccatatgcacttttgagcatttctacagcatgcgattctaagagtaaacccacccaatatggcaaacaatcaaaatttttaaaatttaacttagaaagtctgagatcattattttcaaaacattgatttgtacattgtttcatacacaaataattgactgactatccaagcacaggacaggcatctctcttgaaaacagaggttcctcctagttgggggtggggtagtgttaggctattataaacttccctccaacttcacaaggaaacccaaagtgagattaaaaactcaactgagaagatagacaggatgggtcaggaggaacatggtgctggatctgagctcacttttcagcaaaggtgaaggattctctgatcacgcatttgagaccgtccccgcatgtgcttggccccatggcttctgaacatgttcttttctatgccacgtttgtgtgcaacaatgatctgtgacatcagacagaaaattaaaaaccagggactgaatttacatcattgacaacatcagagaggctgccctagactctctggttttgattaactgttgaacacaaaggaatacattttaaaaaggaaatatgaatgcttccaaaatcttgctacaaacatgactgaaatttggacacgatgaccagatgaacaaagccctcagcatgttttgcatgaatgccacaaaacagggtcactggtctaaaattcaaatacactggtggaaaagtgtgtctgtctgacaattacactcaagtttaccttctggttaacatttttattatatatttccttttaaaattcattcaagacaaaaaagaaaacaaagacgatggccccggaaggaatgcacaatttgttttagtttacagcacagagatctttctctcaatgggaattgtgctcttggtttcagcaataagtgaaggaaaaaagatcttgcccttttgaagttctgaggggaggtgtagggtgtccacgttagtacggttggataggatatgctctcatggtaacgcgtccaagttggaatggtcttccagtctccatggcatccacatgctgttttaaacagagtttaaagaaatgtgaaaagaggcagagaatctaagtgcagacgcacagccaggtcactgctcttcccatcactgcatgagtgtctgcagctgagggcacgtgacttcagctttctgtaaacgtttcccacaacacaattccaaatcaatgctacatcaacatttatctagaaaccgttaatgacaacttcaaatgttctatgagaaacacgcacagttctcctcagagaagggcatttgggctgctgcattacctactggcgttagttccagatcttgaggaagctatcccaggaccctgtcgccacagccatgccatcgtcagtcacgcccaggcagctgacgcggttgtcatgcccagccaagacacctgggagcaaacaacagcagaatcacaccaaagcccagaggcatcgatctcacctgtgtgccatgttgtgacgaggacggatggtgcatctctcatgggacaagacccagagtctcccacggccaggaagggagggaaagttgcatccacgtggggaattaacctgcagcatatggccagccttgttaaaattcaaagacacgcacacacacgcaatcgataaatccagagcccctggcattgacttctcagcactcacttataaaacttaaaaaaagaagcaaaggccactatcaaaaaaatcaaaactatcatcagacgcagtggcttaggcctgtaatcccagcacgttggaaggccgaggcaggcagatcatgaggtcaggactttgagaccagcctggccaatatggtgaaaccccatttctactaaaaatacaaaaaccagcagggcgtggtggtgcgggccgtagtcccagctactcaggaggctagggtaggagaatcattggaacccaggaggtggagcttgcagtgagccaagatcgtgccagtgctctccagcctgggcgacagagcgagactccatctcaaaaaaaaaaaaaaaaaatcaaaaccgccccaatctcaaagcaatctgtaacacaggagcttagaggcatgagccgtttttcctttgtctgtgatccctagagcccagcacaaggcacagaacacaggagtagcgatggtggctgagaccactggcactgcactgtcactgtcatgtgatgagggggccttctgtcaacactcccaataaccttggcttggatcatcaccagccagaagctccacttcctcccagggggatccgaaggcccatttcagccaccctcctccacctcctgcagccaccacacagctgagtacaggggccggcgtgtgctctgccaaggcctgggctggcttccaccgcccttcaacagcactgtgactgtgagacttggctggaaatggctccactctggtccccccaggctggggagaaaaagaaatgtgtttaaccaggaggtgggagtggcacccatccggaagcaggaagccccggtaagggccaagacctggagccatgctcccttctgtcctcccaggtactgagacaaatgaatctaagtctgtaagtgtcaacagttctcaaattcaaatgcccaaatgaccatttttagtaaggaagtctcatcttttgtacacctggcaataacacgcttgcctttgatatgttaactgtaacggcacccagaggtgtccctgcatggaactcctccccctgaagcagagttcagaggggaaagcacggggctgggccctggagcctgcacagctgaccctctcctgcccactgactctccccagagccctccccgacgcatgtgggaagatctgctggtactcctcggagtccacttgcctggagggtcagagctgggccatcagtttgcgactgtcactcctgctacgccatgccacagtcccaccgatactaaaacactgcagcttatgcaaccactctgtgtttgctctaaagataccacgtaaatgtccacaagacacagaaaggccccatggccacgtacctgcccggtcggctttgagtgcatcccagacgttgcagttgaagtcgtcgtacccagcaaggaggaggcgcccgctcttggagaaggagacagaggtgatcccgcagatgatgttgtcatgggagtaagtcatgagctcctggtcagcacgaaggtcaaacagcctgcaggtggcgtcgtctgagccagtggcaaatgcattgccatttggaaagaactggaaagagaaagcaaatcaagacatcatgtaaacgctcagaaagaaacattgggaatatggattgctcaatggtagggctgcagagaacacagcaggcaaagaccagcaagactgtgctctggtaagaacagagggctgggccgggtgcggtggctcatgcctgtaatcccagcactttgggaggctgacgcgggtggatcacctgagatggggagtttgagaccagcctgaccaacatagagaaaccccatctatactaaaaatacaaaattagctgggcgtggcggcgtgcgcctgtaatcccagctactcaagaggctgaagcaggagaactgcttgaaaccgggaggcggcggaggctgcggtgagccaagattgcaccattgcaccccagcctgggcaacaagagcaaaactccgtctcaaaaaaaaaaaaaaaagggtggggggatgggggaggaactacaggggactgggatgggaggggatttgcactggggaggcacacaaacactgtgatcttggacactgtgattactgtccccaaagagtagaatttattccaaaggatagtgagaaagtagtcatcactgacaggtgtgcatgttgctgtagctgccagccatcagggctaatctcatggaggaaggagggaagcgggctgaccaaggctgtggtcaggactgcagcagagctctgtccaaccaacagatacatccttctaagtctcctcacaaggccaggggctggaaacactgcctagccatccgcgtgctaaagaggagggcaggttccctggttagctgtgcccctgaccagtaaggctctgtaaccactggtggcctgagttatcttactgtctttcccctccaggatcccaaccactgctcagctgtagaggtgggaacggggactggcatacaacaccctgtgagtatctgtgagacaagtggtcaacacagagaagtttcccatcgggagttttctgtatccccatctgtacatgaggttgtataaggatcagaaaggagaacatctaatccagaaaagtttaaaatttagcaatctgaacggctagcagagacggcagaggacccgaccccacacctccacccagactcacgcaaatggcattgatgtcagactcgtggccagtgaaggtctgccggcacatgccttctcgcacatcccagagtttggctgaagcatcacaagcaccagagacgaacagtctggtgtcaggagcaagagaaaggctcatgacatctccagtgtgtccggtaaacgtggtcgtctgctggccggtctcgatgtcccacagggcactggagcaggagcgaatgacaaggggacatcagccttaacttcttgggtggctagtcatgtgacagacaatctgtccttcaaaccacccagggccacagtgagcctctgcactgttactttaaaaacgtaaattgtttaaagacaaatttaaatgtaatacaactttggaagggaaacaaagcaaagcaagcaaaattatacagagatgagcacagggcctgggcttcagaatgacgggatcgctacctcaactcaaatgccagcaaacagggagctgggggcacttttcaagcagcaccactgaggctgtgccccctctttggtcatggatgggcatggaaggggtggcaggaagctacgtggaggccctggatggcggaggggacgcgactctatctgtggctgctccctctgtgccctcccttggcctcccctccacagggtctcagaaaaggcaggcaggagaaggccaatgccaggtaaacaaatggctcacagcaattctgaggtcctcctgccctttcctggaatcacaaacaggagagcagctgagttctcagtgatcacacctggtattttttttttttttttgagaccgaatttcactcttgttgcccaggctggagtgcaatggcgcgatcttggctcaccacaacctccgcctcccgagttcaagcgattctcctgcctcagcctctccagtagctgggattacaggcatgcgccaccatgcccggctaattttgtttgtatttttagtagagacggggtttctccatattggtcagactggtctcgaactcctgacctcaggtgatccgcccgcctcggcctcccaaagtgctgggattacaggcatgagccaccgcgcccggccatacctggtattctatcacatttctgcttaacaagctgtcaaaaggtgagacgctgacagagccctgcacagagcagaagcctggctcaggtgtaaggacagctgtgagggccacacgcccaccaacatactattctcctgtgcctcgacccatggaaggcaacaccagagagcactgtccgttcatgtcagcctcagaggaaagcctggctgggcctggcaatgcaaatccaatcagccaatctcaacagacactgcacagggagcctcctctctagggcctgagggactgactgcagaagggaagcaagatacgtaaaagagtctgaaaaaaatgattaatgaacagaagcactttaaaaatatcttctaataaataaagtcttctcaagattgacaatctaggtgacaaatcttttgtaaatctatgaaatttatacaacgaggacaccttataataccacagatgctttgctgacaagttggttaagggcccatgtctcggtgaaccccaccaactgcgtgactaggggtctgtgccctgggctgggcacagctcctgccaccaaatcatgcctcagaagaccagaaaaacccacatggccagctgaagtctaaaatgactctcataaaataactatctggacatttaatttagtactttgatgccacaaatgaaaaaattctagcatttaagtgggcttccgtttacctgtaaggtgaaaacactaaaaatgaagtctgatggaatcacttgaattgtgacgtctgttatttttagtctgtgctcattgttcacaatgacatgatgctatcagaaagggacaatcaaaacccaccctactcccacctatcatcacctaaggaggtacaaatatatagaggggaaaaaaaagaagagcaggtactttgagcctgattgtagttaaaatatctatgttggccaggcatgggggctcacacctgtaatcccagcactttcagaggctgacgcaggcagatcacgaggtcaacggataagagaccatcctggccaacgtggtgaaatcccgtctctactgaaaatacaaaaattagctgggtgtggtggcgcacacctgtagttcccagctactcgggaggctgagaggggagaattgcttgaatctgggaggcagaggttgcaatgagccgagatcacgccactccactctagcctggagacagagagagactctatctcaaaaaaaaaaaaaaaaagaaaaaaatgtgtattttagttctcagctgctgaaaattaaactttgtaaatttattagaagtataatgaggctaggcacggaggctcacgcctgtaatcccagcactttgggaggccgaggtgggcaggtcacctgaggtcaggagttcaggaccagcctggccaatgtggtgaaacctggtctctactaaaaatacaaaaattagtcaggcgtggtggcgggcacctgtaatcccagctattcaggaggatgaggcaggagaatcatttaaacccggcaggcagatgtcgcagagccaagattgagccattgtactccagcctgggtgacaagaacaaaactccatctcaaaaaaaaaaaaagtataatgaattcacacattgctactatgtgttttaaatcttaaggccacttaaattacagatggcctaatattatgtcaagaaccttatttcctccatgttcacagaggaatgtgccaggggctgtgggttctcaaggcactgcctgccccgggtcaggtacttaccacgtggtgtctccagagctggtgacgatctgattgtcatccaggaatcggcagcaggacaggtaacctggcaaagaacaggcctaagtgatgagctgaatccagcaggccttgcacccagcctcatacatagagaaacacattggcccggtggaagctctacgtctaaggtaagaccagcaccatgctagtgaccttttattcccatctgtgcacacagcagaaggtccacacgcactgctggtgagggtgagagcctggccaggcaggacagcacgtcccacagagacccacagctccgtgatgggggcagaagcagaaaccacacccatgaaacatacacatctttcatctgctttactgtttgacccatcaaaggctggggatccctcgtctatttactcattcagggcacgctgactccagtgcccaggaagcagccttaaccagacagacacctcctgctctcctacagcccacgctcagcagggacagagaatgagaatcactgaaagaggacatcagaaagggagtgctaggggaaggaagaggacaaagtaggggcctcacaagatggaagccaggagaggagggaggacgagagtagactcagagaaggaggatccaaacagagggcccagccagggcaggaggcggcgaggccacagggtcagggtggcaagggcctgcaggtcatggaagggataacgaaggcaacaggaacgcggcatggcagcaacactgcagacacgggggtgctcgtgaatatgtgtgggtgggtttgttttcttggggacagtggctgtgacacccacatcagcgtgggcacaattctgtgtctctgagtattcccacccactcccactgggaaggaagcatcagaggcgagagcaggacacaccaagatgccccgtcctaaacaacttccaaaatgaggaaaagcaacaacaaaaaatcagtccgcaatatccacacatgatgactggtctctactaaaaatacaaaaattaagcgtggtggcgggcacctgtaatcccagctactcaggagggtgaggcaggagaatcatttgaacccggcagttcaagttgttaatgacttctgttgaccattatttcttttgtacattgatcacagttctggtatttactgtggaactaaaagcatagggtcaacaaaccagttagtgtgtgcccaggattggtgacagactggccctaatctgaagattcaggggttccagtggcactggtgattcttgggatacctgtttagatttgagtgtttactgaaaagccttccccccaactacaccccagggagtcatgcgacactgcgtgaatcagcaaacaacaaaaataaaatgcaccaaaagaagaaacccactggggttttaatgtagaaagtgtaagattacagagaaaacaaagcatttatttaacaaacattattatcactattttttgagacagagtctcgtgctgtcgccaggctggagtgcagtgatgtgatctcggctcaccgcaacctccacctcccaggtcaagcgattctcctgcctcagcctcccaagtagctgggactacaggtgcacgccaccacacacagctaatttttgtatttttagtagagatggggtttcaccatgttggtcaggatggtcttgatctcttgaccttgtgatccacccacctcggcttcccaaagtgctaggattacaggcgtgagccaccatgcctggccaacaaacattattaaactggctctgacagaagaaaaatatgcatagatgacagagctcaaaatattaactacgtgcctacgaaagtatgcgtggtcaaatacttcctggaggccacaccacagggacactagggaccacaaaggtgaacccaagtccagctcagaggaggatagccctgcatacctggcgccccctgtagtgccctgcagcttgctgtcgtgccccgcagctcactgtcatgctcccgggtctccacccgagccctcctccactggcttcctggttcacactcacccttgcttcagggaagcacccccaccccgtcagatgcccatccagaccaggccaccgagccttgtagcacttagcctgtttgaatgtgagcacagaagggcaggaaagaagagtcatggagacctcagcacagcctgcatctcacacaggggaccaggcggaggcactcccaagtttactgcatgaaagaatcatgaccttggctggacgcggtggctcatgactgtaatcccagcacttggggaggctgaggtcaggagtttgagaccagcctggccaacatggtgaaaccccgtctctactaaaaatataaaaattagccagctgtggtggtgggtgctgggtctgtaatcccagctactcgagaggctgaggcaggagaatcgcttgaacccaggaggcagaggttgcagtgagccgagttcacagcggtgcactccagcctgggcaacagagtgagactctgcctcaaaaaaacaaaaaacatgacctcataggtctcaaagatgacctctctgtcccaccctgtgcaggctgtagtgaagctacacagaatccatcagcttcttactccaagaaccagagactgaaccctaaaatcacagctctcaagcgctgataaaatgatgtggacaagcatcagctgacaggaactatgaaggacaaggggaatgaccgaatgtataagccacacatggcccctgacttacaattttgtgactttatgatggtttgaaagacacacgcatttaataggaaaaccatgctccaagtacccatacaactattctgtgttttcattttcaggagtgtccaataatttacatgagatgttcaactttttcttataagatatgtattatgttagatggttctgcccaaccagaggccactctaagtgtctgtgcatgttcaggttggggggtgaggtgtgtccagtgcggctggagagcaggatgggtggtgcaatgcccagggtgcaagcatactccatgaggcccagtctgtgaacagagaccaggtctaaccccttcttccaggaaagcctcgtagggccttctggccaagaggccacgagtggtgaagactgcagactctgaaatcagaaatacctgggctccactgtcagcatggcagctgaggaagagtgaaaattcctctaagttcttttagaagtcccagcctccccatgtaactggggaactgatgggaggagcagagctgtctgtgcacataagaagttctcagtaaatggagacagttactatttctgttattattgaatttgaacaaattccctgggtatgtgtggggggacacttcaggtgaaaacacgcccctcctcccctggtgcgggggcctgtgctgccaccctctggaagcctgcagaggggcagggaaaacagaccctgaacaaaagtgtgcacccagtgaggaggtgcaagggcacaaaggtggcaccaagtgcctcaaggagaggctgaaacgcggcctggggacctcgcagtggtctggtcatataggcagtgggtgtgaagggctgtcctgtgtctcatagggaccactggctatagggacaaggctgttaaagtccaggagagagggggtggcttgaagagaggcacggcagagagtggaagcgtaggagaaagatgggctcctgggcatgtggtgtcagcagaggtgcctcaaggatagagtgagtccagagtctagaaaggagcagatcaccaggctctgggaagagcacagcatgggtgcacacactgctctacccagcatggctgccgacccaaagacagcaaagccaagaaggacacacaagcgtggccagatgcagccctgtgaggaaacttacccaagaacgggacgatgggcttgagaaaccatccatctacaaggatggcgtttgctgcagcaatgtttataataaattgtgggaaactgtgaactgcctaaatgtctcacaataggaacaaattagtgcaccacaccatgaaactctctacagctcctgagttacagaacgacagtataatactatagttatataatactgtataatactactgcataactattgtataatactgtatttctggatggaattatagggtctcccaacataaaagatgatgattcaaagttcctttccaaaattcctttttttttttgagatggagtctcgctctgccacccaggctggagtgcagtggtgcggcctctgctcactgcaacctccgccaccccggttcagcacttctcctgcttcagcctcccaagtagctgggactacaggcacctgccaccacatccagctaatttttgtatttttagtagagatggggttttgccatgttggcaggctggtcttgcactcctaacatcaggtgatccacctgcctcagcctcccaaagtgctgggattataggcatgagccaccgcgcccagccccctttccaaaatttctacaatgaacacactttgaaaggtttagttctcctacctgcaccctggagaacatccctgttgggagcaggggcaaggagaccccacccaagggaggcgcacaggacacactgaaaggcaggcgggcaaatgccaagaagtcagccatgaccacgcccagtccctcactagtcctcctccgacaggtggtttcaggagcacctgtgccgccccaggatcggctccaaggagcaaaaacaagaccgtgctggcgagggacaggctcagcctagacctggagggaaaggtgcccagccctgcaccgaggcatgcacttggagagcagaggtgttttcttcaagttcagtaagaaggaaaatgaaagagatgaggaagtaacttgaagatgtgaaagtgaggctcagagggttgcacagaggagtgcccgggcaccatgagtgcctccatgatggtgtgaggctgtgaggcccaccagtgcagccaagatactggggctggtaacagtgagcctcaagcagacatcccagtcaccagctgccctgttgtggctcctgaagcagggtttacggggagacaacatatatccccttctgtgtccaagcttgtgaggcctgtcagaaaaaaatccgctattttcatgaatatagaaaatgttctgcttctcactatatgaagacaccgtgcctaaaaatgccaagttttggccaccacagtgggctctgtcactgacagctgtgcacgctgtatcatgaaggccttaggctggacttctgatcaatgcttatgtatctgtagccatcttgatcagaatgatccaggcaagggccgccgtgtctccactgcccgagaggtatgcaaagaacaaagctctaagagcaagcgttgagtctccctgcattggcccttagggatctgctttgataaaaatctgagactggatcagagggctggaaataagctttttttggagacggagtttcgctcttgttgcccaggctggagtgtagtggagcgatctcagctcactgcaaccttgcctgctgggttcaagtgattctcctgcctcaggatcccgagtagctgggactacaagtgcatgccaccacatccaactagtttttgtattttttgtagaggcgggtctccctatgtcacccagactcacaaacactcttttttttttttttgagacggagtctcgctgtcgcccaggttggagtgcggtggcgcgatctcggctcactgcaggctccgccccccggggttcacgccattctcctgcctcagccttttgagtagctgggactacaggtgcccgccacctcgcccggctaattttttgtatttttagtagagatggggtttcaccgtgttagccaggatggtctcgatctcctgacctcgtgatccgcctgcctcggcctcccaaagtgctgggattacaggcgtgagccaccgcgcccagcccacaaacactcttaagaggccaaatgtgtgtgtgtgttttttttaaataacacaactccttagaagtaaaatttcatgaaatatgaaggaaataaaatttctaaaatattcctactaataccagtttttttattttcttgagtatttttggcttttctttctttggtttcaaagacaaatacagtcagtgttaaatccagcaacctttgattaccaatggaaacagatgcacagactctgacggtcatgggaagggactgctgaacatagagaacacctttccaaaaagggtgctgcgtcagacagagctgtgtggtttacagggtcagtgtgagctgcctggctggactcccagcgatggccaggggctcctatctgtaggcattaccttctcacagaaacaactataagcactgcacaaactacaaaacgaaacacctgaaagcatgaaaacaggagcaggtagaaactggaggagtctcccctgggagaaaagaaaggcaggacatggtttgttcttaaggagctttctctgaggaggggactgtctgtgacaaccccagggctacagcctcacacacaagacctgtggccaaggtcttcaagagccagtagacagattactgggcaaccacagccagaaagcgaaaggataacaactacaaagaagaaagccacagaaagggagtcccaaactacacacacggctgaccagatatccgacacctgaagtgcacaggcatgcagcccagccagcgcagaaaagctgaacagaggtttctgctgctgccacacaagaaagacagagatagactgcctgatacaatgacactaaacatcagttagttctggagaatgtaaccggacacaaagtctctatgacacaacatttacaatgtccagaatacaatttgaaattactacatgtactaaaaaaatagcaaaatgtcactcagaatccagaggagagatccacaaggaccaacctcaggaagatgagatgctgggatcagcagacaagaactctaaaggcagctattaaactctccttgtggatgcaaaataaaacatgctattatacaaggacagggaatctcagcaggaaaataaaaaatttctaaataaaagcaatagaaactctacaactgcagaaggaatatctgacataaagaacctgctggatagccttagtttatcagaggtaacaagtacatgaacttgaatggaaataaaaaggttaaaagcaagtaagtggtgctaacaacaacaaaaaggaacaaatctgaagaagtgggaaagtgatgaacaaaccccagccccctgagcctcggggacagcacagatgcgtgtgtattgcagcacagaggggcagggactaaggacagaagatgcatttgaagacatggtctaaaacttcccaaatttggtgaaagacaaatttatagattcaagatgccaaagtgcaataaatgcaaagaaaatcacaccgaggcacctacgtgcaaactgctaaaaaccaaatctttagattgttaaaaaaaaaaaaaaaaaagaaaaataaattaaaaaaagagtcaacccataattctagatatccagcaaaaatacccttcaagaataaaggcaaaatataaatcttagagaaatgaacactaagtgctttgctagcagcagacctgagaactgcattaaccatgacttgttccgggtagggctcccggccgaaaggacgcccgcagaaggcgcctttgcaggagagcgggaagggcactggacatggaagatctctctggagggcagagtagatttacttcattcttttctctttgagacggagtctcactctgttacccaggctggaggtgcagtggcgtgatctcagctcactgcaacctccgcttcagttcaagtaattctcctgcttcagcctcctgagcagctgggactacaagcgcatgccaccatgcttggctaatttttttatttttagtagacacggggtttcgtcatgttggctaggctgatctcaaactcctggcctcaggtgatctgcttgcctcggcctcccaaagtgctgggattacaggcgtgagccaaccatgcccagcctatttcatgcttttcatatttattcacattataagacccctaatttcttaagaatgtttaaagtaaagaatacaacaatgcatcatggagctaataacacacacaggtgtgatgcatatgaaaaccacaagagtgagcaagggcagacagcaggcccgtgtggctgtgagttccttacgtttcctatcaactaggaccaagttaactagaggaccgcgagacattgggaatgtacactataatccctaaagacaccactaagacatcaggcaaaatggtttacctacaaagcccacagacaaagtaaaatagatttctttaaaaaatcaagtaacccaggccaggcgtggtggctcatgcctgtaatcaagtaactcaaaggaaggtaggaagggaacaaccaaaaaacaaaaatgaagggacaaaaaggtggcaaagtagcagagttacaataagaaatataaatgtgcaaaagcatattccaaaggcgggcagaaaaaaccaagacccaacaatgatgcgaggtctgtaacagactattttcaaagacacagttaagctgaaaggacccccatgaaggcaggactgactacattagtatcagaaaaagcagcggttcccaacaaagagcattatgagtgagaaagaacagttcatcatgagagcagggtcacagggtcaattaatcacaaagagacaacaaatgtaaaggcatctactaaaagagctcaagatatctgaagcacagattgacagaattaacaggaaagttagaaaatccataatcattttaacagccctgcatgagcatttcatagaaagacacagaatatttgaacatgccaaaaatcttgctctaattaacatgtatgtagaaaatcaggccgagatacaacaaaaacacatatcattcccatgtgcacacagcgcggccaccatgacagaccatcagctccattaaaaacaagcctcaaatgtcaaaggactgaaatgataccaagtgtgtctttaagcacaatgacatctaattagaaatcaacaataactaagaaaacttcagatatgtaaaaattatacatctaaataacctataagtcaaataagcactcacaaggatattaaaaatttcacattgaatgataattaaaatacaatataggctgggagtggtggctcaagcctgtaattccagcactttgggaggccgaggcaggcagatcacttgcagtcaggagttcaagaccagcctgaccaacatggcaaaaccccgtctctactaaaaatacaaaaattggccaggcgtggtggtgcacgcctgtaatctactcgggaggctgaggcaggagaatcgcttgaacccagggggttgaggtttcagtgagctgagattgcaccactgtactacagcctgggtgacagagcaggactccatcttaaaaaaaaaaaaaaaagacaatatgaaacaaatgtgtgtgatgtggctaaagccatgcttagagggaaacttaaaactttaagtgattctatttgaaaaggaagcaaaccagtggcctacagatctacttcaggtagctggaaaattaagaaggcaactccaaagtaagcagaaggcagaaaagaacagagaacagaaatcaacaacagcagcagcattatctttcaaaggacaaggttaaacttgtaatctggccaaaattaacttatttaacagactgcttaatgggtgtcaactgtagtactagtgactccatgaactgatttctttggctgcatgtgaagtgggcggagtgttatcaaaaagtactggggcataaaatgtctgagaacaaataatacagccagagaggtaaaatattagaatagtacatcctctttcagcaaatgtatgcctttcatgatgaattagtgtcacaagtaaataaaatcttggtgaaataatagactacctagcacttacggccacagggctctattatgcctcatttgcagagacagggtctcgctttcgcccagcctggagtgcagtggtgcaatcatagctccctgcagcctcaaccacccaggcttgagccatcctcctgaggagctgggaccatagttgtgtgccactgtgcgtggctgtttttcattttttgtagagaaggggtctagctttgttgccccagctggtctcgaacccctggctccaagctatcctcctaccttggcctcccagagtgttgcagttacaggcatgagccaccatgtccagcgcaaatccacaggtttcttactggtaaaggcatatcaggcttgtttttagtttcattttcagaaaacttctggccattactgtgacttttatttgaaccagtctcatttaatgattcataaggccgggcgcagcggctcacgcctataatcccagcactttgggaggctaaggcaggcggatcacaatgtcaggagttcaagaccagcctggccaatacagcaaaaccccgcctctactaaaaatacaaaaattagctgggcgtggtggcggacacctgtggtcccagctacttgggaggctgaggcaggagaatcgcttgaacccaggaatcagaggttgcagtgagccaagaatgcgctgctgcactccagcctgggtgacatagtgagactctgtctttaaaaaaaaaaaaaaaaaaaaagaaaaaaaggctgggtgtggtggctcacacctgtaatcccagcactttgggaggctgaggtgggtggatcacgaggttaggagatcgagaccatcctggctaacacggtgaaaccctgtctctactaaaaatacaaaaaagaaattagctgggcgtggtggtgggcgcctgtagtcccagctactcaggaggctgaggcaggggaatggcgtgaacacccaggaggcggagcgtgcagtgagccgagatcacgccaccgcactccagcctgggtgacagagcgagactccgcctcaaaaaaaataattaattaattaattaaaaaatgattgataaaaagtgagtatccaaagcatataatgtaccccaggtaaacagcttgtgtcacttgaagcttatgaacaaggacaggtacctgtgtgtcctgccagctcacgactcacgcgcacgttcccctcacgagttttcagattgtaaatggagcaaatgttatccaggccaccgcaggccacatagttcccagaaggggcatatgcacaggtcatgacccaggaggagcgcagagggatggcgtggacctaatgacagaaagacagatgatgcaaacaactttatgttcaaaaacaacactgacaccaggattttctcatctccaactttcactgcaaaggaggtaacagaacaaaataagagccaaaattatctagagagcgattcccatatgtggccactcaggtgaagcatacttaatgagaagtccagtgctgcacatgggattcaaattcaatccacacagtccagttttactgaagtcacaacttatgattaggtggagtcttaacagtagtgctgcccactcatcaaaaccacattaggccgggtgcggtcactcacgcctgtaatcccagcactttgggaggctaagtcgggcagatcacctgaggtcaggagttcaagaccagcttagccaacatggtgaaaccccatgtctctactaaatataccaaaattagctgggcgtgatggcgcatgcctgtagtttcagctacttgagtgactggggcaggagaatcacttgaacccgggaggcggaggttgcagtgagctgagatcacgccactgcactccagcctgggcaacagagcgagactccgtctcaaaagaaaacaaacaggccgggtgcggtggctcatgcctgtaatcctagcactttgggaggctaaggcgggtggatcacctgaggtcaggaattcgagaccagcctggcctcaaattggtgaaaccctgtctgtgctaaaatacaaaaattagctgggtgtggtggtgggcgcctgtaatcccagctactcaaggaggctgaagcaggagagtcgcttgaaccaggggggtggaggctgcagtgagcagagatcacgccactgcactccagccagggcggtaagagcaatgctccgtctcaaaaacacaaaaaaacccacacgtattggaaggaaaacactgcattatcctgtcaaatggctatgaactcatctgaaaacaaaaaatttttttttcgagatggagtttcgctcttgttgcccaggtttgagtgcagtggcgtgatctaggctcactgcaacctctgcctcctgggctcaagcaattctcctgcttcagcctcctgagtagctgggattacaggcgcctgccaccactcctggctaattttttgtatttttagtagagacgaggtttcaccatgttggctaggctggtctcaaactcctgacctcaggtgatccacctgcttcagcctcccaaaatgctggaattacaggtgtgagccacggcgcccagccgaaaacaaaagatttttatggaataaccaaaatggacattcctacaatctaccctgccacatctctcccactgttttagatctgctgtaattaatgcaatcatttatacacatttagtattctttagtaaaataaactgaattacatcttttacatacatgtttggaccaatgacaatactttttattcaaaacaatacactttggattaagtcttgaaaataacataaattacactttaaagtatgatgtctttcagatgatctcttctaaaaacttgtaactgaatgaaaagtgatacttctgcactctataaataaaacatgaaacttcccagactctgctaaaactggaattgaggtctcctagaaacacagaaggtccttagctcccaccagcttggtaaggagatgacggacaacagcacaactgtgcctggtccagaggaagagaccgtgacaggtggcacgtgactcagcttctatctcacctgcgcaacttcactactaacaaacagagcttgccgctgctgccttccctatcctgtattacgtgatttaacaaaatgaatccagagcttaaaaccctgtttcctgggttggtttttcaaggaagggaatcctccagtccctaccttgttggtggtgtagctgtcccagatgataagtttaccatcctgcgaggcactgacgagaagcctggagggacagacaaaagcaaacctatcagtaccgcacaacacagaaagtgtacaagagcaacagactaaaacccagactctggtggcttatgtgctcccatgttacatgtgcttcagacaaagccacttatttataagaaaaaaaatctctggtcgggcacagttgctcacgtttgtaatcccagcactttgggaggctgaggtgggcagatcacatgaggtcaggagttcaagaccagcctggccagcatggcgaaaccctgtctctattaaaaatacaaaaattagccgggcatggtagtgcgtctctgtaatcccagctactcgggaggctgaggcagaagaatcgcttgaacctaggaagcggaggttacagtgagccacaatcatgccactggacaccagcctgggcaacagagtgagactctgtttcaagaaagaaagaaagaaaggaaaggaaggctctaaatgtcagaccaacttcaaagcatgaacaaaaacactgtcacagaccacagttgagagtggagatgcctggccccaaccgaatgcaggccacatcacccctggcacccattccctttgtcagctgagacaggctgacatcatttcataagtgtttctgtttggtttcattacaaatcaaattagaggctcatgtctttaatcccaacactttgggaggccaaggtaggtggatcacaggagtttgagaccagcatggcctcatgctagcatggtaaaatcccgtctccactacaaaaacacaaaaaaatagctgggtatggtagtgcatgcctgtaatcctagctactcaggaggctgaggtgggaaaactgcttgaacccaggaggcgggggttgcagtgagccaagattgcgccactgcactctagcctgggcaacagagcgagatcctgactgaaaaaaaaaaaaaaaaaaaaaaaaaaaaaacaaacagaaagaacaaaccacttttagacattccaaattcatgaaacatttctcacccaaaataccccatgaaatttcccagactgagctaaaattggaatcaaggtctcctagaaaccaaaggaggcgttccctcctcacctgcttggtaaacaacagcaccactgcgcatggtccgggagcagagaccagtaactatcacgaattttttctttttttcttttttttttttgagacggagtctcgctccgtggcccaggctgcagtgcagtggcgccatctcggctcactgcaagctccgcctccggggttcatgccattctcctgccccagtctcccgagtagctgggactacaggcgcccaccatcacgcccagctaattctttttgtatttttagcagagacagggtctcaccatgttagccaggatggtctcgatctcctgacctcgtgatctgcccacctcagcctcccaaagtgctgggattacaggcgggagccaccacgcccggcctcttttttttgtttttgagatggagttttgcttttgttgcccaggctggagtgcaatggtgcgtcggctcaccgcaacctccacttcccagatttgagcaattttcctgcctcagcctccaaagtagctgggattacagacacgcgccaccacagccagctaattttgtatttttagtagagacggggtttctccacgttaatcaggctggtctcgaactcccgaccctcaggtgatccgcccacctcggcctcccaacgttttggtattacaagcgttgagccactgcgcccgaccatgaattttttcataactatttccttgctctggcaactgtgctcagttcggaatccacatgttgaaaaggagctccatactacaaaggagaatatgaataaggagcaaaagaatttcaccttagcaggcaagtaaggtgggtgaaaggtaactcctgggaaccacagttgcttatgagaggtcctaaggaaccctgtagcacagaatgctgttttcaaggaagagcaagaaggttccactgtttgatgcagggatatctgtcagtacggtaaatgatagtataaggatttttaattttaaagtttctatcaaacgcaaggttttttgtttgtttgtttttgtttgtttgtttgtttgagacagagtctcgctctgtcacccaggctggagtgcagtggtgtgatctcagctcactgcaacctctatctcctgggttcaagtgattctcatgcctcagcctcccaagtagctgggattacaggtacgtgccaccacacctggctaatttttgtatttttagtagagatggggtttccccatgttacccaggctggtctccaactcctggcctcaagtgatccgcccaccttggcctcccaaagtgttgggattacagacataagccacagcgcctcaaaacacaggttttaactatttcagctgtgaacatatgtggcttcttaaagctgacctaaagctggagtaacgctctctcaagttttgttgataactctgacacttttaatatcaaactagatgttttgatacaggtgtcaatgagtttaagaacaaataaaaaccttttcacctgcactttattacaaaatttatcacagaactaaaaactaagtgcaggctcccatcctattatttttcagatgcaattttttttttttttttttttttgagagagagtctcactctgtcacccaggctggagctcgctgcaacctctgcctcccagatgcaagcaattctcgtgcgtcagccttcccattagctggaattacaggtgtgcaccaccatgcctggctacttttttgtatttttagtagagacagggttttgccatgctggtctcgaactcctgagctcaatctgcctgcctcggctgggattacaggcgtaagccaccgcacccagccttcagttgcaattcttaaagcaaacttctcaatccaggttgtcatcaacatattaaacatttaaaattatttctacgtaatggtatcatgttcccactctagctttatttctgcccagcccttctgagactttctgtcgagtatcagagctgatctaaagcagctcatcctcctagattaggaggatcacctttacagaggtctcccggtcagagagcttaataactgctgacttccagagggattagggacacgtaagctgtccactgatcctccagaaggtgagagaagacatgcctcctagtcccgggtcagggagctgttggaaagctgggttcacgttgcctagtagtgcctttacctactcaaaaatcaattatctgaggtgccactcacctagaacatagaggcaagggccaggaagcaagctaacaggctccaggaccctgaaagtagctgtcaaaaatcaaaacacctaatgcccttcattttactcaaaggagggagggtggtggctcatgcctgtaaccccagcactttgggaggctgagataagaggattggttaagtccaggagtttgaaaccaacatgggcaacaaagggagaccctgtctccacaaaaaaatatatatatatattttttgagatggagtctcgctctgtcacccaggctggaggatctcggctaactgcaagctctgcctcctgggttcatgccattctcctgcctcagcctcccaaatagctgggactacaggcacctgccaccgcgcctggcttattttttgtatttttagttgagacagggtttcattgagttagccaggatggtctcgatctcctgacctcgtgatccgcccacctcagcctcccaaagtgctgggattacaggcctgagccaccgcgcccggcccacaaaaaatattttttaaaaattagctgggcacagtgatgtgcacctgtggtaccagctactcaggaggctgaggcaggaggattgcttgagcacagcagttcaaggcttcagtaagctaggatcgcaccactgcattctagcctggacgacagagtgagacccagtctcaaaaaaaaaaaaaaaaaaaaaaagttgccttttagtacaaatatattgataaacatattacaaatgtacatctgatacattaatacatacatacataacaagtaatcattgtgggccttgcatgtagttttcttttttgtttgtttttttgagacagagtctcactctgtcacccaggttggagtgcagtggtgcaatcttggctcactgcaacctctgcctcctgggttcaagcgattatcctgcctcagcctcctgagtagctgggattacaggcacccaccatgaagcctagttaacttttgtatttttggcagagacagggtttcaccatattgggcaggctggtctcaaactcctgacctcaggtgatccacccgccttagcctcccaaagtgctgggattataggcgtgaaccacggtgcctggcctctcatgtagctttatttgtgttttgttttgttttttgaggcagagtctccatccgtcacccaggcgggagtgcaatgcgcatgtttgtgggtatatatatacatatatatatattttttttttttttctttttttgagatggagtctcactctgttgcccaggctggagtgcagtggtgtgatcttggctcactgcaacctccagctcctgggttcaagcgattctcccacctcagcctcttgagtgcagctgaaactacaggcactcgccaccacacctggctaatttttgtatttttagtagagatggggtttcaccatgtcagccaggctggtctcgaactcctgaagtcaagcgatccacctgacttggcctcccaaagtgctggggttacaggtgtgagccaccgcgtctagcctcatgtagttttgaaagacaaactaggccgggcacagtggctcacccctgtaatcccagcactttgggaggccgaggcgagcggatcacgaggtcatgagatcgagaccaccctggctaacacggtgaaatcccgtctctactaaaaagacaaaaaaaattagccgggcgtggtggcgggtgcctgtagtcccagctactcgggaggctgaggcaggagaatggtgttaacctgggaggcagagcttgcagtgagctaagacagcaccattgcactctagcctgggcgacagtgagactccgtctcaaaaaaacagaaagacaaattagtagtcatttctactgtttccgagtgtccataaatcaaacaaacacagttaaaggaatggtattcataggccagacgcagtggctcacgcctgtaatcccagcactttgggaggccgaggtgggcagatcatgaggtcaggagatcgagaccatcctggctaacatggtgaaaccctgtctctactaaaaatacaaaaaaattagccaggcgtggtggcaggcgcctatagtcccagctactcgggaggctgaggcaggagaatggcgtgaacctgggaggcagagcttgcagtgagccgagatcgcaccactgcagtccaggctgggtgacagagcgagactccgtctcaaaaaaaaaaacccaaaaaaactggtattcataaattatagctttaagtcatgaaaaacaagcaataacatttgtttatgaaggcaggaaatatgaagattaaagaaaatatataccctccccactctgtcatgtggtggggggcaggaggagggacagcattaggagaaatacctatgtaaatgacaagttaacaggtgcagcaaaccaacatggcacatgtattcctatgtaacaaatctgcacattgtgcacatgtaccctagaacttaaagaaaaaaaaaaaagcttgtggaacaaggagatatagatatacatgtatatatatacacacacatacatacacacacacacacacacacaccctccccccaaaaaacctcttttggaccttaaagaggcaaacactggcctatccagaaaaaaacggctatttacaacaagcaatctctagaaggctctgaaaagcagaggttctccataatatcattttggttttctcatgactgtgcaattatacaacaaatgccatgcacctagcaccctgtccaagaacatggaccaatgtggcaccccagcctcccacaggcctcactgaagactgccttgctcacagggtggccatgattctgcacttggtcctgttttgtcagcccttgcttttcttccttctaatcctggggctttcaaggcacaaagtgtgtttgagacagacggaacataaagcctcccatgcaaggatctggcgcccaccccacccaccctgagcccccagccccacctccactgctcagttcacacacccatctcttcggtccctgaacacacctgcctgcaggtcactctcatcccttccagactacccagtccagagcccagctggtgaaggagacatattacttggcagtgcagtgctctgagtacctgaacactgcccagcagcagcactgtctactccactaacctgcctaatctgcacatcagtgttcccacacatggaggaaaggccccagaggtaacatactgttttgttttccatctacttttgacaataaattctaacatagatagactagtaacaacattttttcttttttttttttgagtcagtgtcactctgtcacccagtggtgcaatttcggctcacagtaacctccacgtgcctcagccttccaagtagctgggactacagctaccatgcccagctaatttttaaatttttagcagagatggggtttcgccatgttggccaggaggctggtttcgaactcctgacctcaagtgatccgcccacctcagcctcccaaagtgctgggattacaggtgtgcgccactgcatccagccagaacattttttaaaaaattctttttaattttttaaaggaataactttgaattcacaaagtatattcttacttatttacttatttatttagagacagggtctcactctgccgtgcaggctgaaacacagtggggtgatctggaatcactgcaagctctgcttccctgactcctgggttcaagtgatcctcccacctcggcctcctaagtagctgggactccaggtgcgcaccacaacaaccaacttatttttgtactttttgtagagaaggggtctcgccatgtgacctaggctgatcttgaactcctgggctcaagccattcgcctgccttggcctcccaaagtgctgggatgagaggcatgagccaatgtgcctggttacttatttattttgaatatttaaaagaatttttgacaagtaattatatgtatatttacggagtacaatgtgatattctgatatatatccacattgtgaaataaatcaatcaagctaatcaacatacccatcacttccaatttgctctgtggtgggaacacttaagtctactttactaacaattttgaaacacacgttattatgaactactctccgtgctgtgtggcacatttctaaaatttattcctaactaaaactctgtaccctcagaatatcatctccccacttccccaccctcccccttcccacttttattctttctgactcctgctgtcattggaaccatcatgcgagctctcatttgcatggggaattgtatgggatactatatagaacaaactaaagatagaatcttttgttctctagctgtttgtgctctaaagcggacaatttcacgaacaaagaaaaagcctagcagaaaattccacgctaacaacggaatacaaagaaatactactcaaagaagggcatgttaaaaattgttatgtcaggtgcttcaacgagcatgtcacagttacacaaatcaaacagtactttattaaattatttagatagaacaggcaccaaataagactttgtaatagcctctaaatcagagtgtggggtcacggaagggagatgcctggtggagaagaaaggggtataatttaaagtacaagaaataggctagaagtggtggtggctcacacctataatctcagcactttgggaggctgaggtggaaggatcacttaggggccaggagtttgagaccagtgtcagcaacaaagggagaccctgtctctgtaaaaaaccaaaaaatattagccaggcatggtggcacatgcctgtggcctatgccacttgggaggctgagtaggaagggttactggagcctaggacgtcgaggctgcagtgagatatgatcacaccactgcactccagcatgactgagtgagaccctgtctcaaaaaaaaaaaaaaaaaaaaaaagaaaaaaagaggctgggcgtagtggctcacgcctgtaatcccatcactttgggaggccgaggcgggtggatcgtgaagtcaggagatccagaccatcctggctaacatggtgaaaccccatctctactaaaaatacaaaaaaattagccagtgtggtggcaggcgcctgtagtcccagctactagggagggtgaggcaggagaatggcgtgaacccgggaggcggagcttgcagtgagccgagattgccccaccgcactccaggctgggcaacacagtgagactccgtctttaaaaaaaaaaaaaaaaagagaaaagaaaagaacaaataggagcccatgaagggaattatctcttgggatggtaaaccaaaggaaggcagggcagacaggccagatgagagaatggtgagagcagctcacagcgcattcccgtgtgtctgccgcagcaaagcacacacagcacaatgctgttctaaggctcaatacacttaatccctcaggatcctcggggcaggttctgtgatttcctgagccagggcactgacatcacaagagggcgagggccaaccagccctgagaaacaggcacagagaggtaacttccccaagttcacataagtaggatgcagtagaactgggaagacagaggtctagaaactgaaagagacaggagaagggagaaagaaaaatcagaacttgtattaatgtgattcagacagtgaagaaatggcagtgttctttcagcccaggtaagtggaaaactggacagggaatatgcacctgtgaacgctgcaccttgcgtgcccagagttctgattcaacttcctaatttcttcactgcacagcacagcaaatgggttcaggtacttttcccctaggacaacagagcagcccctgaatgtaacaagcagcatcctgctcatgcccacgcctacctggagtctgtgccccagtgcatggcgtagatcttggccaggtgcccccgcagtgtcctcctcgtgcgcatttggattcttcccactgggtcgatgttgtttgtgatcttgaaaataaaaacatttctgtaaatcaacatctgtgattaaacgattctcctcatcacccatccttgtcaaggctgttggctcgcccactgtgcctacctcttcccagcccttcccacagttctccagtggcttccactgtggcattctgcactgaaccccttccgtacctcttaccaagtctcagtctggctggtcatcaggaacctgtgtgccctgccctccaatgcacgcacacgaacatggccagccttgaagcacttgctgttcccttcctgcttccttcctcctctccctgtccatccaggaccatctcctcctaggtctctgagttctttgagatctcgcaactcttcttatgacaccacacagatgtcccacaccacaatttaatagctggttcctatgtcaggctatgtgtgggcctgcatgacacctgcttctgcacgaccatcacttggagcaccagctgtacacacacctgctgagcccatcctacatatagacactgatgttaatgagtttaggttggcaaacggagtaagtggattacaatagtgggttttaaaaacggacagtccaaagtgcttctcagaattgaaattcaggtaattctatgtagcctaatttttttttctttaacttacaatttaacctcaattaaagcacatcccctaaagcatttagacaatgtaaaaaacttaatcatcttcagtagaagtaggaatatagtttttctttcacatttctgtccaattatttggactttatttttattatcttttttttttttttttttttttaagatggagtctcgctctgtctcccaggctggagtgcagtggtgcgatctctgctcactgcaacctctgcctcccgggtccaagcaattctcctgcctcagccccctgagtagctgggattacaggtgtgtgccaccatgcctggctaatttttgtattttagtagggacagggtttcaccatgttggttaggctggtctcgaactcctgacctcaagtgatccacctgcctcggcctcccaaagtgctgggatggacttcatttttttaataaggtgaagttcacgtaacatccaattaatcactttaaagtctacagttcagtggcatttagtacactcattgttgtaaaaccactgccaccatctagttccaaaccatcttccaaaaggagaccagacattgattcagcagtcactccctgttcacttcctctccctctctcccctaacacccctgctggccactagtccactctgtctcagtgaatgttactattctagatatttcatataaatagaactaaacaatacatagccatttgtttggcttctctcactatcgtaatatttatggggtttatccacgttgcagcctctgactgtactgacgtccatttaatggctgataatactccagggcacagagacaccacaatttgtttctccactcattcatttatgcacattttggttgtttctacattttggctattgtgaatggtgctgctatgtacatgtgtgtgtttgaaaagcagtgttcaatcctgttgggcatatatttaatggcagaactgctgagtcatacaataattctatgtttaactttttgaggtattatcaaattggatattagaaatagaagttctgaggcagattctgttgaggagaggagcttcaaaatatcttaagacaataacaatattttacaactattaccctctgtaacaggtagatgattattcaaggcttgagatatctcatttttatctcaataagcccctctatttcctatgcctaccatcagaatgacttcttaataaaagcagtggcttggcatcctcactgcgcaacagagaatgcaagcagagccctcccgaggctccaggtgtgggtgccgtgctagcctcctcacaggcagatggctctgcgtgactcagtgggctcttacctgagagagagttgcatctgcacatgctttcctggcgtcctgggaagcaaggacagtgagaaattagcaacctttcagatacattcaatctcaggtccacacataccaaagtttcaaagagagctttcctaagctgtcaggagcaaaagcagaatgtgaaagaacggcagagtctccttgcatctcaacaccccatggtctactaccatctgtggactgtccaggccacgctgaacagagaaccagtagtacccaaatctgtctaagacctgcagcacaatattcctggggacccacagctgtggccagcaccgaggagaccacactgcaagctggggcagcacccacacacccgggaccctggtgctgcctgtgccctcactgctgcacaggctggcacacacgacttgctctttttacaaagcccatctagggtcaggaaggctgtggcccaaagaaaaggtctattaaaaaaaaaaaaaaaaaaaaaaaagtctaaaaaggaccagatacccagcccaaaaaaacttttcttcagactgcattaactaagtactttgttttcaagagaaacaatcattaattctaaattctatggagggcgcggtctcacgtctgtaatcctagcactttgggaagctgaggcaggaggatctcttgagcccatgagttcaagaccagcctgggcaacaaagtgagaccttgtctctactaaaaataaaaattaaaaatttaaggaaaataggctgggtgtggtggctgacacctataatcccagcactttgggaggccgaggtgggtggatcacctgaggtcaggagttcaagaccagcctggccaacatggtgaaaccccatctctactaaaaatacaaaaaatagctgggtgtggtggcgcacgcctgtaatcccagctactcaggaggctgaggcaggagaatcacttgaacccgggaggcggaggttgcagggagccgagactgcgccactgcactccagtctgggaaacagagcaagactccatctcaaaaaaaacaaaaataataataaaataaaataaaggaaaacaaagaaaaataaataaattctatggaaaacgagcaagggacctggagccagacaatcagatgtacatgagcctcttggctgttctcgttgctcatctacaaatgacctgcggctgcaggtaggcactgtgaagggatccaccaatgctaactcaagtgtcttcattactaagggatcaaagttactagaaaatagacctggaaatctcaaaagagaacgtacgtttagaaatagaaaggtacgtaacatgaaggaaaataagacaatggctaacaggtttaaagtttgagtgttggtataattttttttttaatcacaactattttttttttttgagacagagtctcgctctgtcttgcccaggcgggagtgctgtgtcgcgatctcagctcaccgcagcctccgcctcccaggttcaagtgattcttcccgtctcagcctcttgagtagctgagaccacaggcgtgtgccaccacaccggctaatttagtatttttagtagagatgaggtttcaccatattggccaggctggtctagaactcctgacctcaggtgatccgctcatctcagcctcccaaagtgctgggattacaggcgtgagccaccccgcctggcctctttttttttttaaactatgtatttatttatttttatgacaggatctggctctgttgcccagcctggagtgcagtgatgtcatcacagctcactgcagcctcgacctcctgggctcaggtgaccctcccacgtcagcctcctgaatagctgggactacaagcatgcattactatgcccggctaattttttttttttttttgtagagatggggatctcgtcatgttgcctgtggctggtcttgaactcctgggctcaaatgatccttcccccttggcctcccaaagtgttgggattataggggagagttaccatgcccagctgacactttctagtaagaaaaatgtgtttatatgctgtcatctgaccatctactttcaaaatggcaaatggcatgtgcagcccttacaggcgtgcgtccaagtgccccacatggggaaggtggaggacgagttcccagcggttcaggcttttggggcaaactgctcactgcaaatgatttctactttaggaagcttgtgggaatattataaactgataatatggaaatatattggtcaggcgcagtggctcatgcctgtaatcccaacacctcaggcggctgaggtgggtggatcacctgaggtcaggagttcaagacaagcctggccaacatggtgaaaccccatccctactaaaaacacaaaaattaaccaggcatggtggccggcacctgtaatcgtaactatttggggaggctgaggcaggagaatcgcttgaacctgggaggcagaggttgcagtgagctgagatcacaccactgcactccagcccgggcaacagagcgagactctgtttaaaaaaaaaaaaaaaaaaaaaaaaggaactatactgagattattataaatataccaaatttatacattccaaattcatctttagttaagctctttattggtcattctgcttataattaagacacacacaaaaaaatcgagtatttctatgcaagcagtaacatttggagtaagggggatgaagaatacttagagcagcagaagtctttttgtcaatgaattttactggcaagtactgagtttaatatttgtttttgaaatactattcttgttgatgttacagcctttgattttaaaacatcataagaaaatttaaaatggagaaaataaaacatgagatttaagcaacttcccccggttagtgtccaatgactaaaatgagtttcttaaggtacagtgtaacagactgtggtgatactactgttaaaccgaaggaaaaactactgtaaaaacaacacacagataacttcaattcaatctttattttagccaataaccagcttatttaactgagtgcagcactttgcagaacagacaccttcaacttttaaaactgtaggaagaagtcttttaatggaaacaagctctataactgcttaacaaagaagaaaaagtcttcaagttctttcagattaatttccagtttaatggactcctgtagatacatattatgatgtccacttaaaccagagatgaacatatccaagccactcatcagttgatttctcattctttttggatttgtcaaatgacacagtaacacacttactttggggtttcatcctaaattaaagcctgggccctgctcagcatggagtcgctggacattttggaccgggcatccattgcagctgcctctcgcacgaatggaccctgctcccttgcactggctggcatgccgctccagaacacatctacgcctgtgcatcctgtggagctttccttactccatcagctactctgtgtattttaaggcacaccatgttttaatcagaatccctctgagagcctgtgtttcctcaataataatcaaaaggagcatgcaaggtcctttaagggtcttttggctgaaaaacaaatctaagaaagaaaacagccccttttagaatcatctacaatttcttgtttgattcactatgctctgcattctttaacaagcacgtattccttgggcaatcaggaaaaaatgttctacattttaaaaataagtcttcctttcccatttggggtaaaaggacttcaacagcttttgctgtccctgtctcgtgcaaaggaactaacacagcgcggttcctggtacttcggagacaaagcagctaggcgcctctcctagtgaacgtcccaccgcgggggccatgacctgcctgtggctgctgcgcacagcaaacggaaccaggagacttgggacaaaaacagtgtcaaatatctcaattaaaatgtattaattacacattgcataataaataatattttagatatactgccttagataaaatttgttgggccaggcatggtggttcacacctgccagcactttgggaggctgaggcgggaagatcccttgagccctaggagttcaagaccagctggggcaacatggtggactctgtctctacaaaattgaaaaaaaccagccaggtgtggcagcatgctcctgtagttccagctactcgggaggctgcagtgagctgtgatcgcaccactgctctccagcttgaatgactgacagagaccctgtctcaaaacacacaaacaaaaaaatgaaaaaaaccttgttagggttaattccacccgtttcttttcattctttttcaaaagacagggcctttctaccttacaaaggctggtctcaagcttttgggctcatgcaatcctcctgccttggtatcccaaagtactgggattaacggcatgagccacggtgcctggccgtctctctttttactttttttttttttttttttgagacggagtctcgctctgtctcccaggctggagtgtgcagtggcgcgctctcgcctcactgcaagctccgcctcccaggttcacgccattccctgcctcagcctcccaagtagttgggactacaggcgcccaccaccaccacacctggctaattttttttgtattttttttcttttagtagagacggggtttcaccgtgttagccaggatggtatcgatctcctgaccttgtgatccacatgcctcagcctcccaaagtgctgggattacaggcgtcagccaccgcgcccgacctctttttacattttttatgtggcaacaagagcatgtggggaatgtcacgtgacatttgtgccagcccaagagggagccccctgtgcaagaaggccctggggaattcacaacgtgacagggtccaaacctcggaaggaggtgcaacagttccttttggccttaattttttaaatttgggtgtctttcacctgtgccatacaagctctttccatctgctatgaatagatccaagtccactatttgtgaacaacttatagctgtcagaaaaacaaaatttcttcaaatatgccaaatcaccctactatttaagacattttcagggtaaactttaaaattctgatttctaggccgggcgtggtggctcatgcctgtaatccccgcactttgggaggccgaggtgggcggatcacgaggtcaggagatcgagaccatcctggctaacacggtgaaaccccatctctactaaaagtacaaaaaattagccgggtgtggtggcgggcgcctatagtcccagctcctcaggaggccgaggcaggagaatggtgtgaacccaggaggaggagcttgcagtgagctgagatcgcgccactgcactccagcctggggaacagggcgagactgtctccagaaaaaaaaaaaaaaaaaaaaaaaaatctgatttctataagatgaaatatagtctcaaaagcaggtggtaaagagctgagagtgttctgaacccccccaaaaacccagttagattattattaaataacaacactttgcttttcttttttacttgccaaaaaccatgctgacttaaaatgaacagcagaagcttaagtattaagtcaggcaaaatttgaataccttttggttttatttaaatagatatttcagagaataattttatatcaaactaaatatttcagaacacatttgattaattttggtggaggggacatgttaaacaagtctgatcagagcaaactattaaaaaaatctaagtcttccctattcacctatgtaagatcttttaaatgttaagatttaaaattcttacagtagaggatactttgttttctctttggctgtaaatctcagagaattccattattttttctcaagttcaggaacaagttgcctaaaattatgttggtgtttctctctccaaatcctggtgggctttctaaacatgtaattggccgtttaaaaggaaatacttgacttcatccttgcactggagtcagaaaaataaactgttgttttttattttattttactgtattttgagaaggtgtcactttgtcacctaggctgcagtgcagtggtgcaatcacagcttactatacagcctcaacctcctgggctcaagtgatcctcctgggtagctcagactacaggcgcgcaccaccatacccagcttataaactgttatttaggtatgtactgaatgtcatcagcttcctgtacagcgacactctgaagaacagctaaagcttgacagagcaaacaagagtaagagaaagctcttacatcaaatggacaaaacctaaaaacatactgaagacgtggtttttcctgagaagtctgcctctttttctcttactcttcacatcagcagtttcagaaaggaaacacatacttgcattaaatgtttctctataaaatatttactagaagtactgcttcacaaaagtaggagcagcagaatgaattccatttagacctactgctcctcccttttcagaaagttatgaggcaagagaattgcttgaaagaggttgcagtgagacgagatcgcgccactgcactccagcctgggcacaacagagtgaaactctctctcaaataaaagtttatgaactctgcaatttaacatcctacatcagtcacagactggaatttaatgttttagaattctgtgaaaggtattctttttacagtgcagtttatttacacacggtaaataaatttatcttcaattttttttttatttttcagggtctcactctgacgcccaggttggagtgcagtggcacaatctcggctcactggatcctctgcctcccgggttcaagggattctctgactttagcctcctgagtagctgggaatacaggcacacaccaccacacccagctaatttttatattttttgtagagatgggggtttcactatgttgccctggctggtctcgaactcccgacctcaggtgatccacccgccttggcctcccaaactgctgggattccaggcatgagccccccacacccggcctctatcttggatttagatatatctgctccatctagcagtctatcagaagctgtagattccaatcatcaccgctagggaagatctttcaaaattaggaaaaaatacatcagatatacctgaaatactttttttattgttgttaatactcttacttttaagcaagttttctgctgtcaatagtcccaatattcaggggagggaggtagatatcacagtctgatcagtggcccagggtatcacaaattttcaaggttatgataaagaatgcaaaagacacttataaattctacggagacatctggtgtatattcaaataacaaattgtatacagaaagcaaaatcccaaaaacaatgtactaggctaagtatctagatctataattagtacatcctgggccaactaagattcaatttcatataaaacatagaacaagtcatcctgtaaaccatttttcctaaaacaagtaacatctaacctgaaactcaaatgattaataaaaccaagcacacacaactacatactcgaatctggttcttaagttgctcggcctcctgccgtaactggtcaagctcactcatcttccgatcttagtgctcttcaatgccaccttcaagaatgtgagatctgaaacagaaagacaagcacaatcaataaacaactgttggataatttaatgaagcaggtgagaaaagtaaattgaaagtttaaggtgggcgtggtggctcaagcctgtaatcccagcactttgggaggccgaggcgggcagatcacgaggtcaggagatcgagaccatcctggctaacacggtcaaaccccttctctactaaaaatacaaaaaaattagccaggcatggtggcaggcgcctgtagtcccagctacttgggaggctgaggcaggagaatggcgtgaacctgggaggcagagcttgcagtgagccgagatggcgccagtgcactccagcccgggcttcacagcaatactccgtctcaaaaaaaaaaaaaaggaaagtctgagaactatggtctcattacaaaccagagaacttttcttcagcattcatcagaacttatacaatggctaagtagggccaggtaaataaaatataattatgattatttattggctttgcataatattacaatgtctaaaatactactcaacatatgctggtgggttataaaaagaaaaatctgttaagcatttttcataaaaaaatctaggtctccctataaatccaagaacataagactgacatttaggccaggtgtggtggctcatgcctgtaatcccaacaatttgggaggccaaggcgggtggatcacttgaggtcaggagttcaagaccagcctggctaacatggtgaaacccgatctctactaaaaatacaaaaattagctgggcatggtggcacacgcctgtaatcccaactacttgggaggctgaggtagaagaatcatttgaacctgggaggcagaggttgcactgagccaaaatcacaccactgcattccggcctgggtgacagagcgagactccatctcaaaataaaaaaaataaaacctgacacttaggatagctatcgcatgaagacctaggggaagttacttcagggaacgggggtgagtggcaacctggcaaccaagaatctcaaagccacctcatctcagtaaccatgaaccgctactggtcaaaagctgtcaggatgctcacacagcaatcctgagcacacagggtgtgtccagcagttttttggctcagggacaacccactctcccacccaagtgagccctgggatcccaggaggctcagaaacaacaccttgatccttataggtgcaggctaaattaggctcagtacaagccgccctgccttctcgccctactcacgttagacaatattcctgaaatcaaagtaaaaactaaatcaccttgttaaacaagagacttattttcccaagagaatgtcataaatggaggctgcatttctgaccaagatcttagctgttaatgtatgactgaagatcttggctgttaagtatgactcaagtataacaaagctgaggacacagttgctaatgtctttaatcccttacaattagctctcacatgcaagtacggcttatgcaagcacttcaatttcctacataaattacacagaggatcaattttaccattataacttttgtgtaagtcaaaaggctaatacaatatacatcaaaatctaactgatagcagttattttcttgagattaaaacccatctgtgggaaactatccgatgacctaagaagctcagccgtcagtttccagtctgaactttcctagtgtgcctaaaggaattcgaataacctacagtatagatacttgatgtctacggtccacagaaccagaaaggcctgcaaggcatgccccgtaacacgagcacgcagaccaggcatcctgctgccactgctctctggggaggcaggctgcacagcaacacggtgtcagaaagatttctgaccaaatagttgtttctaaaggcattatttgaaacggatgttttaatcatgaggaaagcttcactaaggaaaaatacctcaggcctccctgcacacatggagcatcaccggaattaggtatggacaaggtcacacctcaagggcagtttattcttaagggataagactggttaattctttccctggttttcacatataaatcctagcgactgtgatttgtggacgttaatgtgttaagcagtaagagtgccaggacaagatgagcagtgtctcagatggaagctgtctggatgccttgtgctttgcattctttctgcatgccctgacactactcacttgtatttcacacatgatcaaattatattatgcacacaattttgcagagttgggggtagttttatttcaccagcaccccgcacgcataatagagaattgttcttagtctgtaaagctactttaatccttccaaaatcaacatgaagaaaacaagttaatgttatgaagtaccccgaattaaactgttttagttaacacacacagtttctgatcatttaaacactaaaaagtaaagctaatttttatagtacgggactaaaaacaacaaactcctgggatctcgggaaagagaaacgcatgttctgagatgcttcaaaaatgatgttccggctgggggcggtggctgacgcctgtaatcccagcactttgggaggctgcggacaacggatcacctgaggtcaggagtttgagaccagcgtggttaacatggagaaaccccatctctactaaaaatacaaaaattagccaggcgtggtggtgtgtgcctgtaatcccagctactcgggaggctgaggcaggagaatcgcttgaacctgggaggtggaggttgcagtgagccgagatcttgccattgcactccagcctgagcaacaacagcgaaactctgtctcgagaaaaaaagagatgtttcttgtggctggagggtggtgggtgggtgtgtaaaggcccaaattccatcattaggtgggataactcctgaaatcttacatactgcttttaattagatgttcttttcacatattatacaagaacatgtacacaacaatcacccagctgtattgcttgagactagagaaacaaatttaccaaaaatctaagtatctttaaaatgagctcaatataacttagtgacctcacaaaatttcagaagtagtaatgccaaaactcgctaactttcatctttagtcacatgcaaagagaaaaaaaccagacggacttctttttcatagttaatagcagaaattattatagcactctgctgtgccaacatttgagtttcaattcagagactcaaaacctacgtttgtcaattttttttaaaaaggcgtattcctggctgggcatggtgggctataatcccaacactttaggaggtcaagtcgggaggactgcttgaatccagcagtttgcgaccagcctgggcaatatggcaaaacgctgtgtacacacacacatacacacatacacacacacacacacacaatttttgttagcaataaaaataaatttcctggtcaggccctcttcagtccacacatagaagtgataagaaaaatctattgtcaggcatttcaatttttttaaaaaaattacattctctagtctccaggataaagatatattttcttttcttttcttttttgagacggagtttcactcttatcgcccaggctgcagtgcaatgatgcaatctctgctcactgcaacctctgcctcccaggttcaagtgattcttttgcctcagcctcccgagtagctggaattacaggcgtatgctaccacgcttggctagtttttgtatttttagtagagacggggtttcaccacgttggccaggctgtaaggaactcctgacctcaggtgatccgcccgcctcggcctcccaaatgccgggattacaggtatgagccatcatgccccgcctaaaaatgtattttctacaatcaaattgaaaaaaatttttggagataaactcaatgatcagtaccatctttttgttatgtggacatgcaccagacaccctgtacaggagttcaggcacagcagtgaactggctgatgggatgaggcaggagagacgagaaaacgtgaccatcacattccccatgggctgcaagggaaccaggtgccaggaagagcgaacttaagggaagcaaacaaccttctggttcccataaacagccttctcagtggctcttagttcatctttaccgtgaagacagtgaacgaaacaaaaacgaacagtgtacaaagcatgatgcttttgtgtgtacaagaaggacaaacgccaatgccagggcaagccatcttttttcttttttttttgagatggagttttgctcttgttgctgagactagagtgcagtggcacagtgctggctcactgcaacctccgcctcccgatttcaagcgattcttttgcctcagcctcccgagtagctgggactacaggcacatgccaccacaaccggctaattttttgtatttttagtagagacagggtttcatcatgttggccaggctggtcttgaactcctgacctcaggtgatccgcccacctcggcctcccaaagtgctgggattacaggtgtgagccactgcgcccggcccgccatcttttttctacacacaccagatgttatggcgttgtttttggagaaagagaaacaggttagcagcttttattcttctcattattcttcaaatatagtttgcttactaacccccctacacaccaacacacgcatacaaagttaacagaggctaatctggggtcctagaacaaagaaacatttttttctttatacttttcagtttcaataaaataatattacatttttttttttttgagatggagtcttgctccgtcgcccaggctggagtgcagtggcgcgatctcagctcactgcaagctccacctcccgggttcacgccactctcctgcctcagcctctccgagtagctgggactacaggcgcccgccaccacgcccagctaattttttatatttttagtagggacggggtttcaccgtggtctccatctcctgacctcgtgatccgcccgcctcagcctcccgaagtgctgggattacaagagtgagccaccgcgcccagccttaatgttacattttttaaaaaaaatttctgtgagggtctcacactcttgcccagggtggagtgagtggcatgatcatagctcactgcagttcaagccatccttctaccttagcctccagagtagccaggactacaagcagactccacccatcacacccagctatttttgaaatttttggtagagacgaggccttgctatgttgcccgggctggtctcaaactcttggcttcaagtgatcctcctgccaaggcctcccaaagcgctagactctaatctattgcatgagccaccacacccagcctaaagttaactttttaaagttacctgatgcagccaggtgcaatggctcaagcctataatcccagcactttgagaggctgaggcaggtggatcacctgaggttaggagttcgagaccagcctggccaacgtggtgaaactccgtttctactaaaaaatacaaaaattagccaggtgtggtgatgcgtgcctgtaatcccacatactcgggaggcttaggtgggagaacggcttgaacctgggaggcggaggctgcagtgagcagagatcgtgccactgcactccagcctgggtgacagaatgaggctccatctcaaaaaaaaagttacttgatgcaattcgctgggtatcgtggaacgtgcctgtagtcctacctacttgggaggctgaggtgggaggatcgcttgagtccaggagttcaaggctgcagtgagctatgatagcaccactgcactccaatctgggcaacagagcaagatcctgtctctaaatagttactggaataactgtaacatattgctaagaacaataaggaagacagtaataatttgggaaaacgcttactatatactaagtcaaaaataatataaatttgcatatagttattttatttgagactgagtctagctctgaggcccaggctggatggagtgcaatggcgcgatctcggctcactgcaacctccacctcctgagttcaagcgattctccttcctcagcttcccaagtagctgggattacaggcatgcaccaccacacctggctaatttttgtatttttagtagagacagggtttcgccatgttggccaggctggtcttgaactcctgacctcaagtcatctgcctgcctcagcctcccaaagtactgggattacacgcacccggtcacatgtagtaattgtagctgctttattataattaaaataggtctgggcgcggtggctcatgcctgtagtcccagcactttgggaggctgaggctggcagatggcttgagctcaggagttcaagaccaggctgggcaacaacatggcaaaaacctggtctctactaaaaatgcaaaaattagctggcgcagtggcacacgcctgtagtcccagctacttgggaggctgaagtgggagaatccacttgagcctgggaaattgaggctacagtgagccatgactgttccactacactctagcctgagcacatggagtgagaccttgtctcaaaaaaaaaaaaaaaagaaaagaaaaaagaaaaatatactcactttaaagaaagatagaatagcatttttattataactattagtcacgtttttctactaaacgtaatattgatgcagcttcctttgaaaattaaagaataaatgtaaattttaaaagtcttactcacatttaattgctcttgcttttctcttcgcttccctcagtcccccagaccttccagaacacccaccaccaggtttccctggcctgggctcctctcctccggtgccgacgtcacggctaagctctggctgtgctgactccaagagcccgcccgtctaatccactaagacaggctctgctaaggcctcatgtctagtcttcctgatgacccatatctgccattggcttttattcagaatctgagttttggaaatccttttgagagagatttgaataacttaaaagcaagcaggtgaagggatctgcccctactttagaacaacatctttgtgagtcaagtgttagcaagatttttaaagtcagaatatttcatatttgcaatgcaatgtgctccgtgtagtgcctctacccttcatggcaatgcagcagcccaggcctctcatccagacccctgagagtctaggaggggcacctcagcggtgccctcaggaccccatattacacagtcaccaataacaacattcaggctgcaagtttgccaatgacaaaatagggtacagatattgaaaaataatttcaagttctggttctgcaacatacaaagaataatgctttcactaaattgttttttactctaatctgcttaattcaaaatgggaatggtgttatctatatcacagagctaaaatgaaaattaaatcagacaaccaatctgaaagtgctctgtcagtctcacagtgattaaactatgacgtgtacctttgactaacaatctcaaggacaacaggcaccatgctcaccaaagtgcacacatgtggtcccaccaccaagcagcaacagggcagtcctgagtcacctggtcaccagctagccgcacacccctgagcctcctgtgcagcactggatggctgcatctctggatggtttggacaacttccgaagtccaaaccggccccagtgtcttacaccggggcaggaaatttgctaacttgaccaaacacacaaggatcacagctcacctccaagacgaagcagcattttgaaagagaggagtttgcatgaggaatttaaaccaatttcactcacttttccatttttctttcattcccaagtccaggtcaatctccaaaactaagactgtgggaattcaaagggcaacggaaaaagtcctcaggccctgcttcccttacgcaccgctcctaacaatactgtgaggaataaggggagcaggggaccaccgcaactgataaaggacacgaccactaacgcagctgcagagcaacgcatgcgcagaccctccctccaacacaacaggcactgtagagcctcagcatggtgctgagcagcatgaaccaggctggattctagtttgagggagacagaagacaaacaggtaaatcacgtggagttacagaggctgggagcgtacacagtcactgcgaacgggtgaagtgtgccaacgagggcagggaggatgctgctttgcatggctgttagacatgaccttgctaatgggccaacatttgagcagcaggcagatgggcaaaaataacacaactgttcttgtttgaggtgctattttttgcaatggtaacaattttaaaaatcttaccttaggattttgcctgtgcctataaagtaatcttaacgaaaaagtgaatgtgaccaaagctctagaactagaagacagggaaacatgttcaatgaccccacagaggcaacggtactacacaatggcctgggaaacactccaggacagacgaccaggcaggtcggttagtctgtctttaacaaataaacttcaagggaaaaaggagagaaagcaaacaatggagggaggatttctggactaagtgaagagactccccagaatcatctccttcatgtcccagtcacaagtgagctcactcacccattagacgctggcaactgggggaagggcaggaactatggtgtgcggtcacaaagccctcagaaggcaattctccagggaggggtctaacagccaggggtgagccagtgaggcacagctgctaagagcttacctctgacccttggaactctgaaatcccagaagtggctactgactctcccgaagccttattatttctcatgcatcacaaaaaacatctgatctcccattctgctctcccttttctaaccctgttagcctatggcctctttttgcttttagggcggagcacaaaatctagcacatactaggacaattggaaatcattcaatagatacacatcttcaaacatgttgaggccaaattggaagtcccactttgatcatttcaaagccaaactttatatgtaactgatggagtctcatgaaatgaatggcatccatccagaagacgggtctaacagggaaaggtggtgagaaactaacaatcatgcagcgcacacaacagaggaggctaaactccaagcactttttttttttttttttttgagatggagtctcactctgttgcccaggctggagtgcagtggtgcgatctcggctcagtgcaacctccgcctcccgggttcatgccattctcctgcctcagcctcccaagtagccaggactacaggcgcctgccactatgccctgctaattttttaaatttttattagagacggggtttcaccgtgttagccaggatggtcttgatctcctgacttcatgatccgcccacctcagcctcccaaagtgctgggattacaggcgtgagccactgcacccggcctccaagcaccttttataaggggcctggaaatccttaggtttagggaaagactgctgtgtgccatgccatctgcactccagtatataaaaataatctttgtttttacatttactgctgcaaactacaatgaatactatgtgctttcccaacagcaaatgggcggtgggggttagaattctgttcctagaaaaacttccgtgtttttattggcatttgcaggtccagcccacttaagcaggaccaatgatgtctgacagccctggctggaagcagagtgacgcttcatggcaggaaagttggaagccccaggttctaacccagactctatctcttctcaccaggtggcctccagtaggtttcctaacttctctctgcctacatttttttgtctgaaagtggggacagtaatagtccccacagctcatgctatgacaattccattagaatccatgcaagccccttagaaccatgactgacacagtaaatgcttactaaatatgacttgctatgaaagcaggtgtaaaactgttgccctgaaagttttaagtaatgtccagaaaactacctcctgcctcacctgccacactttccatccagtcagtgcagtaggcccttttgcagaaatcaaaaatatatgtagcagtggcaaccagtgtaacagtggagttaatcagatagatgtgatactttgaaatctgtgcatgttgttacatgtacaagtctttatgagaacatctgctttcacttctcttgggcagattcctagcggtggaatggctggatcatactacaggtgtgtgttgaacattccaagaaaatgccaggccaggtgcagtgactcatgactataatctgagcactttccgaggcaaggcaggaggatcacttgagcccaggaattgaagaccagcctgggcaacatactgagaccccgtcttacaagaattaaaaaaagaaaaaaaaaaaaaaaaaaaaagccagacatggtagtgcgtgcctatagtcccaactacttaggaagctgaggccagaggatcacttgagcccaggaggtcatggatgcagtcagctatgatcacaccattgtactccagtctaagagacagagtgagaccctatttcaaaaaaacaaaaaacaaactcaaaaaacaaaaaaaaccaactcttttcaaaatggttatgctgggtcacattcccaacatcctataagcaatgtggagagtcccggctcctcacgcccaacaacgctgggtgggtgtcacagccattctaatgggggcgtgggctgtagtctccatctgcatctcgctgactgctgagcttctgaggcactcaattgctgtctatacagtttctggtaaagtgtctgttcaagtcacttgcctcttttttattgggttacctgttttcttaatattgcttttttttttttttttttttttgacacagggtctcgctctgttgtccaggctggagtacagtggtgtgatcgtgactcactgcagcctcaacatcccgggctcaagtgattctcccacctcagcctcccaagtagctggtactacagacacacaacacgatgcctggctaaattttttttttggagacagtctcgctttatcacccaggctggagtgcagttgcacaacctggactcactgcaacctccacctcccaggttcaagtgattcttgtgtctcagtctcccaaatggccgggattataggcataagccactacacctagctaatttttgtatttttagtagagatggggtttccccatgttggccaggttgttctcgaactcccaacctcaggtgatccgcctgcctgggcctcccaaagtgctgggattacaggtgtgagccaccgtgcccgactgctaacttttttttttttttttttttgaagagacaggggtctcactttattgcccaggatggtatcgaacaactggcttcaagcaatcctcctcccaaagtgctgggattacaggtgttagccatagtacctagccaaaattgagttttgagagttcttacctattctggatacaagtcatctaaaagacatttgctaatattttctgccagactatggtttgtctttcgttctctgttttttctaaggagcagaagttttaaattttgaacaaattcaatttataaatgttttcttttacgcattctatctttgatctcacatctaaaaactgtttgcttaattcaaaatctcattttttctaattttacgttttatatttaggtatatgatccattgagttaatttttttttttttttttgagacggagtctcactctgtcacccaggctggagtgcagtagcgtgatcttggctcactgcaagctccgcctcctgggttcatgccattctcctgccttggcctcctgagtagctgggacttcaggtgcccatcaccacgcctggctaattttttgtattttcagtagagacggggtttcatcgtgttagccaggatggtctcgatctcttgacctcgtgatccaccctccttggcctcccaaagtgctgggattacaggcgtgagccaccatgcctggcctttttgtttttgtttttgtttttttgacacggagtctcactctgtcaccaggctggagcacaacggtgcaatctcagctcactgcaacctctgcctcctgggttcaagcgattcccctgcctcaacctcctgagtagctggactacaggggcgtgccaccacacgtggctaaatcttttcctttgtattttcgtagagacggggtttcaccatgttggccaggatggtctcgatctccagacctgatgatctgcccaccttggcctcccaaaatgctgggattacaggtgagccaccttgcctggcctgagttaatttctgtacatgatgtcaagttctccttttgcgtaagaatatccaattgactaaccaggcgtggtggctcacgcctgtaatcccacagctttgggaggccaaggcgggtggatcacctgaggtcaggagttcgagaccagcctgaccaacatggtgaaaccccgtctctactaaaaatacaaaaattagctgggtgtggtggtgagcgcctgtaatcccagctaattgggaggctgagacaggagaatggcttgaacctgggagggggaggttgcagagagctgagattgcaccactgcacttcggcctgggcaacagagcaagactctgtctcaaaagaaaaaaaagaatatccaattgttccagcccctaattgctattcaatttaattttgctttttaatttaaaattatttcaaacttcaaagagttgcaagaataatacaaagaaaccatgtaccctcctcacccagactcactcactacgaacatggcttcattattcccactttattcaaacaaaaaggtttttgttttgttttgttttcctgaatcatgttcaccttacttttttttcttttctttttttttttttgagacggagtctcgctctgtcccacaggctggagtgcagtggtatgatcttggctcactgcaagctccgcctcctgggttcacatcattctcctgactcagcctccagagtagctgggactacaggcgcccaccaccgcacccggctaattttttgtatttttagtagagacagggtttcaccgtgttagccaggatggtctcgatctcctgacctcgtgatccacccaacctgacctcccaaagtgctgggattacaggcatcagccaccgcacccggccatatattggtatttcaactaagatctgatttgaaaaaagggctctcctgctttctaacgaaaaaaactagcgatgtaccactctgattcagaaggtaaatcctcatcactgggaccctaaaccttcttgctcaacactaaatggaagctttttttgaggatcaaattgttttgaaaaccaactttggcttaaaagagatagaaaaaaactgtaacaaaaaccagggtattgaccaggcatgctggcgtatgtctatagcctcagctactcaggatgctgaggtgagagaaccccttgaccccaggagttagaatccagtctgagcaacatggcaaaacactgtctctttaaaaaaccaacccaccagctatttataaaaacaaactctgaagaaatttatatattgtctttctaaaactgatgaggatcaaatatatcaaaattaccttaattcagaagggcttctggtctggtctccaatacatgtaaatttgtctgaaacaaacagaaaaggctgtatttgtattgcactcaggttgtgaataaaatattctattttgctagtagctatattttatgcaacgacacataaatttgacccttccctattactatttctcccccaaaattgctttatttagcagtactgtcatattttgtttttcagcatgggaacaaaataagaaatcagatctcaacttctttaagaatccttagaaatgccccagggaaaataccttgaattaaactgaaaagtatgggcacagaggttagaatcctatcactagaaaaattacagtaacaatttaaaaactaatgcaggccgggcccagtggctaacccctgcaatcccagcactttgggaagctgaggcaggcaaatcacctgaggtcaggaattggagaccagcatggtcaacatggtgaaaccccatctccactaaaaatacaaaaaaaaaaagttagccaggcatggtgtcacaagcctgtaatcccggttactcaggaggcttagacaggagaatcgcttaaatccgggaggtggaggttgcagtgaaccgagatcattccactgcattccagcctaggtgacagagcaagaatctgtctcaaaacaaaaacacacaacagtctgggcgcggtggctcacatctgtaatcccaacactttgggaggctgaggtgggcgcataacctgaggtcaagagttcgagaccagtctggccaacgtggctaactaaaaattaaatgtttttaattttaatgtgttttaagaacacattatgttcttggcagcgaactaaaaaaaaaaacgtttctactaaaaattaaaaaaattagccaggcgtgatggcaggcacctgtaaccccagctacctgggaggcagaggcaggagaatcacttgaacccagaaggtggaggttgtagtgagtggagatcacgccactacacttcagcctgggtgatagagcaagacaccgtctcgaaaagaaaaaaaaaaaaaagctaggtaccgtggctcctgcctgtaatcccagcactttgggagaccaagttgggcggatcacaaggtaaagagttcgagaccagcctggccaatatggtgaaacctcatctctactaaaaatacaaaaaattcgccgagcgtagtggcaggcacctgtagtcccagctactcaggaagctgaggcaggagaattgcttgaacacaggaggcggagattgcagtgagccgagatcgtgccgctgcactccagcctgggtgacagtgcgagactctgtctcaaaacacacacgcacacacacacacagacacaacactaatacaattcaacaaattctgaagattaatttaatccagactttgcctgtttggcatgacagtggagagcatttcatctgaatctcaaggaagccactaaataactactttgtgagtcctggcaagtctatgttgggacacttccaatccctccctctgtccctctcctgctgacacggtcccatccagtgcctggccctggtgcccaggaaggtggcttgaatggtgacagagatcacaagagaggtttctgactcctcttgacatacttctggtggaatgaaaatatgtccaattctagatttcttctgatttcagaacatttattgtattttttttatttttgagacagcagtctcgctctgtcaccaggctggagtgcagtggtatcatctcagttcactggaacctccgactcactggttcgagtgattctcctgcctcagcctcttgagtagctgcgattataggcacatgccaccactcccagccaatttttatatttttagtagagacgggttttcaccatattggtcagtatggtctcgatctcctgacctcgtgatctgcccacctcggcctcccaaagtgctgggattacaggcgtgagccactgcacatggccacatttattaattttttgagacagattctcactctgtcaccctggctggagtgcagtggcatgatcttggctcactgcaacctctgcatcccaggttccagcgattttcctgcctcagcctcctgagtagctgggattacaggcacacgccatgccttttattatttattagtagagatggggtttcactatgttggccaggctggtctcaaactcctgacctcaggtaatccgcctgtttcagcctccgaaagtgttgggattacaggcctgagccactgagcctggcctgatttcagaacatttaaagatgcttctgtaatcgctccctcaaattaaactatgtgaaaagaccacttgtggaggcttcacaggtcaccacctgcctattaattcagtgtcttgtgagtctgcaaactcacatgcacacatctagtctggagtcagtagatgaatcaacaaactgaaatatctcccagttgaactgtgaattctaattcatttacttaaagtagtttcgttttgcaattatgctgcttatgtacaagcaagcacgtacttttccggcagtaaaaatgagtgtggaaggaaaacagtttggcagttcctcaaaaaattaaacacagaattaccccataacccagcaattctactcctaggtatattcccaaaagaactgaaagcagggattcaatgcatgtacacattatgttcttagcagcagtactcagcagccagaaggtggagacagcccaaatacccactgagcatgaatggatgaataaaatgtggtctatccaaacaattgaatattattcagctataaagataaaggaggccgagcgtggtggctcacgcctgtaatcccagcactttgggaaggtgaggcgggtggatcacctgaggtcaggagttcaagaccaacctggccacctcgtctctattaaaaatacaaaaattgccaggcacggtggctcacgcctgtaatcccagcactctgggaggccaaggcgggcagatcacaaggtcagcagattgagaccatcctggctaacacggtgaaaccccatctctactaaaaatacaaaaaattagccgggcatggtggcgggcgtctgtagtcccagctactctggaggctgaggcaggagaatgccatgaacccaggaggtagggcttgcagtgagccaaggttgcacccctgcactccagcctgggcggggtgacagagtgagactccatctcaaaaaaaaaaaaaaaagaagtcctggtcctgtctctgctagaacacagacaaacctcacaaatatgctaagtgacagatgccatacacaaaaagccacatatatacaaccccatttacatgaaatatccggaacacacaaatccaaagagacagaatgcagtggttgccaggggctgcatgtgtctgcgtgtgcatgcacatgtgtgtgcagtggacaattatttaatgggtacagggtttccttttgaggtgatgaaaatgtcatggaattagctagagacggtggttgcaacacattgtaaatgtactaaacggcaccgaatcattcactttaaaatggtttatgttatgtgaatttcacctcagaaaaaaagttgggtgtgaaaaggcacacaggagtaaacagtgaatgatgcaaactaccccagacttcaggaagcgaagcctcgctccggggcagggtcctatgagcatacccgaaaagtgccaccaaatcaagtttcaaagcatgggtctcaacctcagcacaatgaacattttaggcaggggtgtgtgtgtgtccccaggaggatatctggcagcatgccagtagtgctcctttccccagctgtaacagccacctggcatcccgagaggcaatactgaccccagttgagaactcttcaactgtcacaattatctcaaccactaaatataaatcttttcaagtactttccagatcaagggacaggtaggaagagaaatactactaaaaaaaattatacataatctgctctattttatcattattaattatttttttgagacagggtcaccctctgtcagccagtctggagtacagtggcacaatcatggctcactgcagcttcgacttcctgggctaaggtgatcctcctgcctcagcctcctgagtagctgggaccacaggtgtgtgccaccatgcccagctaattaaaaaatatatatatatttgtagacatggggtcttgccatactgcgcaggctggtctttaactcctgggctcaaacgatccttgcaggtcggccttccacggtgctgggattgcaggcacaaggcaccgcacccagctgctctattttaatgcctagattgccctgtggctcaaatcatgactcaagattggagtaaggatgctaaaagtgctatcaaatcaccttagcctggattcacatggagagttgtctggacccatttctggctaaaaacaagatgacccaaatgtatgctctttttctgactatccagctcatagaaccccacactaaggacaggactaccagtcccacaataatgtaaccctaaaccagtagcactacccttaaagaacatcaggagctgggctcgcacctcccagtgctttgggaggccgaggcgggtggatcacctgaggtcatgagttcgagaccagcctggccaacatggtgaaaccctctccactaaaaatacaaaaattactggccgggtgcggtggctcattcctgtaatccgagcactttgggaggccgaggcgggcggatcacgaggtcaggagatcgagaccatcctggctaactcgatgaaaccccgtctctactaaaaatacaaaaaattagctgggcgtggtggcgggtgcctgtagtcccagctacttgggagggtgaggcaggagaatggcgtgacctcgggaggcagagcttgcagtgagctgagattgcgtcactgcactccagcctgggtgacagagcaagactccatctcaaaaaaaaattaaaataaaataaaaataaatttaaaaaataaaaaaattagccgggcacggtggcatgcacctgtagtcccagctacttgagaggctgaggcaggacaatcaattgatcctgagacagggaggttgcagtgagccaagattgcatcactgcactccagcctcgatggcagagtgagactccgtctccaaaaaaaaaaaaaagaaaaagatgggcactttttcaaggctcttgataaaatcaactgactctatacagctaatttagcaatattaaatattaatatgacttctttgcacatatcctagtacttatacttttatttcagcatttttcaaaatctagaaactgaatccttgagacatacctagagaatttctctacaagctgcattaatatttctaatcaagtacaggtatacttgtgggggatgatttcttctctatcaacataatcctaagatgggaaacacataagtgcaccactggttatctacaattctgagatacccaaaccagaataggacacacggcattaggcagactttctcacattcagggtgagcagtcttatgtttactacaaactttggggtatctgattaaagccttgccgtaagtgtggtgcacatgtaacatactcactgcatctttctcaaccctgaaaaagtctatattccggaaaacatccagccccaagagttttgcctaaaggcctgggggcttgtaagaaacaaagtaaactcccttccaaataattctttaattcaaaaacacactgaacaactagaatgtgaaataatactgaacttaatgacaactctgtatcataatcttcaactatatatgatcatactaataaacaggataaaaacaaactagaaatgccttctttcaaacaaaaattagagttcagtatcaataaaaagataacaatacctgtaaaacacaaccaaccaaccaaaaaaaggtctaaagacatcacgttaatttagaatactctaactgtacaaacgtgggggtacattctaagggcaaatagagttctgaaatttaagcgtcatattggtggcataataatgcttaaagtaggccgggtgcggtggctcacgcctgtaatcccagcactttgggaggccaaggcgggcggatcacgaggtcaggagattgagaccatcctagctaactcagtgaaaccccgtctctactaaaaatacaaaaaattagccaggtgggatggcgggcgcctgtagtcccagctactcaggaggctgaggcaggagaatggcgtgaacccaggaggcggagcttgcagtgagccgagatcgtgccactgcactccagcctgggtgacagtgcgagactccgtctcaaaaaaaataataataaaataaaataaaaataataataataatgcttaaaatattaatatggatatgtatgccagagcgaaataagcgaagatatggttatttggggagcaaggctcacactggagaagggaggcacaacacggactatctgaaagcaaggaatggccccctggggttcaatctgaatttggagacaatggaaattctctatacatttattccgctgtagaatcatttgtgtgtaagtccatacacacacacacacacacacacacacacacacacacacacacacacacgtatatctcctatctcttgtcaactgaaaggtctggaagcaacgacctctccacacacaaagcccaaatcttggttttataaaaacggttccctttaaaaggagcttcagggttcctctgagaaatcactccctcaaggtctggcacaggaaccctcttgctatggcagaaaggaagggctccaaaactaaaaagaacatgtcaaaaacacaccagcttgaaggaagtctgctggccaaatttaggacaatctgagggtcaacatgacgaacaatggtaatggaatataccttactggatctaaaaaaagaacacacaagcacatggtaacatataaattaaaaaaaaaaagaggaaaagcgaagctcttctttacagaggaatgccaatacacatagaaggagtaagatttagccgggtgcagtggctcatgtctgtaatctcagcagtttgggaggccaaggcaggcggatcacctaagctcaggagttcgaaaccagccaggccaacgtggtgaaactccatctctgctaaaaacaaaaaaattagccaggcgtggtggctggcacctgtaatcccagctactcgggaggctgaggcagaaggatcgcttgaacccaggagacggaggttgcagtgagcagagatcatgccactgcactccaggctgtgagacaaagtgagactccatctcaaaatcaatcaatcaatcaatcagagtctcactgtcacccaagtgggtgacagccttgaacagctcactgaaaccttgaactcctaggcacagccatcctcttgcctcagccccctaagtagcaaggattcaggcatgtgccacactgcacgtgactaaattttttgtttctttatggagagagggtctcactatgtggcccaggctggtcttcaactcctggtctcaagcaatcctcctcccttggcctcccaaagtgctcagattataggaatgagccactggttctagctgaaagtgaaggacttaaagctagagaatttaatgccagcaaaagggtggcttgatcagtttagaaagagggttggcttaaaaaatgttaagataacaggagaagcagtttctgccaaccaagaggcaccagggttcccagatgccatgaagaaaatcattgaggaaaagaaaatcttcctgaataggtttttaatgcagacaaaagtgccctattctggaaaaaactgccacaaaggacacttattagtaaggaagaaaagtgagccccagcactgaaggcaggcagggagaggccaactctactgctttgtgcaaatgcagccgggtttatgatcaggactgctcttatctacaaagctgctaacccctgagccttgaaggggaagagataaacaccagttgccagtctcttggttgtggaacaagactgggacaacaaaatccctttttctggactggttccatcgatgttctttgtctgcagtcaggaagtacactttgccagtaagggattgccttttaaagttctttagatattggacaaggcccctggccactcagaaccccatgagttcaatactgacggcaatgaagtggtctacttacccccaaacacagcacctctccttcagcctctagattagggggtcataaggacctttaaggctcataacacacagtactctatggaaagaattgtcaatgctatggaagagaatcccaatagacagaacattgtttaagtctggaaggattatcctgctgaagatgccaaggttgttacagaaaaagctgtgaaggccatgagcctgaaacaatcaactcctgctggagaggacgacgtccagatgctgcgcctgacctcacaggatttacgagagccagacgaggaaatcatgaaaagactgtgcatatgcttttaaaagggtaggggggtgggtaaggacttcaacatgtggatcttagagaaattcaagagctattagacaccacaccagaggaattaacagaacacaccttgacagatgtcagtacttccaacgtggtgccaaacgatgagaaagaagcagtgccaaaaacacgtggacactgggcaatctggcagaaggtccccattccccaagactgcacttgacttctttaggacacagagcttttatggcacaggaactaaaactaaagcatacaacagaaggttgctatcatacagaaacttttttagagaaatgaaaaagcaggccgggtgcggtggctcaggcctgtactcccagcactttgggaggccaaagcgggcagaccacgagatcaggtgttccagaccaccctggccaacacagtgaaactctgtctctactaaaaataaaaaaaattagccgggcatggtggcgggcgcctgtaatcccagctacttgggaggctgaagcaggaaaaccgcttgaacccaggaggcggaggctgcagtgagccaagactgagccattgcactccagcccaggcaaaaaaaaaaaaaaaaagaaaaagaaaaaataaaacgaaaaagaaagaagtcagaaattatgtatttcagtaaagttccaccaagtatgcctgtctctcctacctccccttccaccacctccatccaagacagcaagaccaatcccatctctttctcctcctcagcctcaacctgaaaatgagaaggaagacctttatgagggatccacttccactcattaaatagtaaatacatttttctctcccttatgattttcttaatattttctctagcttgatcacaaaaatatataatatataaaacataaaaactgtcttttgactgctatcggtaaggcttccagtcaatagcaggctattagtagttcatgttttgggagtcaagtgatagaagaattttgactgcacagcaggttagcactcctaatccctgtgttaagggtcacgatattccttccctttcactctttgtaacacaactgtctagcattttacttctacatgttttttgaagactccttctgggtctttgttcccagttcctcagaaggagcttcaaaaactattggatgttccggagtgataggcatgtctttgttattcatgagcctccatgtttttgctgagatgagctgactcaagatagaggctggtcaccagaaagacaaaccatgacattagacggttggggtttgaaaccattctgactggggtgggagaggggctagagattgtgctctatcaattgtgcccaagtaacaaagccccaataaaaactctcaacaccaaggctcaggggagcttcctggttagaagctcattgaccccgatttgtcaggagagactccatggggagagggcttggaggatgtgtgcttgagactctgctaggccttgctgtatatatctcttcatttgcctggtctgatttatattaaactagatatagcaccagaagataactgcagtgtgatgggatacacttctgcctgaagaacttcctccatctcacagggcagatctactggcaacaaaccccacaacttttgtctgaggaagtcttttgtgggactaggtctcattctatcacccaggctacagtgcagtggcacaatcttggctcactgcagcctcaacctcccaggctcaagcgatcctcccacttcagtctcctgagtagctgagaccacaggcaccgccagagcacctggataattttttttttgtagagatgaagtctcgctatgttgcccaggctgctctcaaactcctgggctcaagtgagtctgccactcagtctcccaaagtgctgggattacaggtatgacccaccatgcctggcctgtatgaaatactttttttctggctacattcaaaactttctctttgactttcagcagtttgactataatgtgcctaggtgttgagggttttttgtttatatttatggtgcttggagtcctctgaacttcacagacctctggtttgttgtcttttactaatgaaaaaattctcaaccattagctctttgaatatttcttctgccccgttttcttcctagggctccaattatctgtatatttgacagtttgctatagtctcacaactactcaacactttttttttgtttgagatggagtctcgctctgtacataggctgaagtacaatggcacaatctcagctcactgcaatctccgcctcccaggttcaagtgattgtcctgcctcagcctgagtagctgggattacaggtgcccgccaccacacccagctaattttttttttttttccagatggagtttctctcttgttgcccaggctggagtgcaatggcgggatcttggctcaccacaacctccgcctcccaggttcaagcgattctcctgcctcaacctctcgagtagctgggattccaggcatgtgccatcacaccctgctaattttttttatttttagtagagacggggtttctccatgttggtcaggctggtctcgaactcccgacctcaggtgatctgcccacctcggcctccccaaagtgctgggattacaagggtgagccaccgcgcccagcctaaatgctatttttgttctggtttattttcttctgcttgtttcattttggatttctattgacctatcttcagtttcactgattctttcctatctgctgacaaactcactgagaaaattattcatctataatgtttttaaagaatctctaacatttcaatttaactttttctagagtttctgcctcctgaaattctcgatcttttcacatataatgcatgctgtatacctttctcactcaatcttttaccacatccatcacagtcatttaaagtctctggcagttccaatatctgggtcatctctaagttggcttccatttatttctctcttaacaagaaatcgcttttttgtgtatctcataattttttattgaattatcagatgatattcaataaaaccagaattgggtacacctctttgtctgagccactactgtgtggggatgaggggttaattcaatctagtcttcagttgggtttggattttataatcctcaggggaaggctgccttcaacttcgtggcaccatgtatttttctcaaaaacatactggccggccaggcgcggtggcttacgcctgtaatcccagcactttgggaggccaaggcgggcggatcacaaggtcaggagtttgagaccagcctgaccaagatggtgaaaccccgtctctactaaaaatacaaaaattagcaaggcgccaggcgcggaggctcatgcctgcaattcccagcactttgggaggccgagacgtgtggatcacctgaggtcgggagtttgagaccagcctgaccaacatggagaaaccatatctctactaaaaatacaaaattagccaggcgtggtggtgcatgcctgtaattccagctactcgggaggctgaggcaggagaatcgcttgaacccgggaggcggaggttgcagtgagccgagattgcaccattgcactccagcctgggcaacaagagtaaaactccatctcaaagaaaaaaaaaaaaaaaaattagcagggcatggtggcacacacctgtaatcccagctactcaggaggctgaggcaggagaatcgcttgaacctgggataccactgcactccagcctgggcgacacagcaagactgtgtctcaaaaattaactaattaattaaatttaatttaaaaaaatattggccaaagaggaaacctcactactcacacctagaggaggacagaacaaatgcagaaaagcaagccatacaacttcacatgaagatgcaaacagtcttgcaggctaccatgaggacaagcctttactttattttggcagtagactgaatgtctgttaaacaggcattcggccgggcacagcggctcacgcctataatcccagcactttgggaggctgaggtgggtggatcacttgaggtcaggagtttgagaccagcctgaccaacacggagaaaccccatgtctactaaaaatacgaaatcagccgggcatggtagcgcatgcttgtaatcccagctactcgggaggctgaggcaggagaaatgcttgaacccaggaggcagagattgcggtgagccaagatagcgccattgcactccagcctgggcaacaagagcgaaactccgtctcaaaaaaaataaataaagagacattcactttactggaaaaaaaaaaatcaacatattgtggttgaatatataaaaagagatgccaaacgttaggagccaggcgtggtggctcacgcctgtaataccagggggcgatcacttgaggccaggagtttcagaccagcctaggcaacatagcaagatcctgcctctcaaattttttttgagacggcatcttgctctgtcgcccaggctggaatgcagtggcgccatctcggctcactgcaagctccgcctcccgggttcacaccattctcctgcctcagcctcccaagtagctgggactatagacgcccgccaccacgcctggctaattttttttgtatttttagtagagacggtgtttcacgatgttagccaggatggtctcgatctcctgacctcgcgacccgcccgcctcagtctcccaaagtgctaggattacaggctcgagccacggcgcccggcctcaaaatattttttaaaaaaattggcatggtggtgcatacctgtagtcctagctactccagaggctaagacaggaggactggttgagcccaggagttgaaggcagcagcgagccactgtatgtcagcctgggcaacagtgagactctgtctcttaagaaaaaaaaaaaaaagtgaatgtcttgtgtgccttgctatgcacacaggttctcagcccctgagtggagtgcaacttacgggcctaccctacactcaggagccagcaacagcccctcatcctgctctcaccaacccagctccacatctgccacacccagtcacgcccccttctgaaccctcaactggttcttttgtggttcttctctcaagtcgaggatccactccttattccctttccctgaatgtaccccagttcctagaaagctctacgcactgcagcgctctgagggttcaatcctttcagattccaccagtgtaaagcaagcctcagcacccctttcctttccaaacctgctggcagtccctcccagctctcctgcagcacagactcaagcctcccttccatccctttcccctcctgcccctgtgctccactcccactgcttcagcctcttgatggcttaccatctttgcctggcccgttactaatctgtgtctctatcccacctcttttccacttcaatccatcttaacagcactgcctgatttatctttctgaaggacagctctgacatgcgactcctccgctcagaagtcttcaaatactcctcctacggaaaaaatcaaactttttagcctggcctaatttaaagctcttactgactgtattcccaggtactcctccccagggagtcaagtaagcctagaaagggccaaacacatgggcacgaacaccccagacaactttggtggtctctgccgaactctgaccactagtctcttaaagagaaatcctagaaacatgaacatatttttgcctcaaagaatgagagccaatttttaaaggtaaaatatctccccaccaagcaagaaaaaagacatgcttccaaaacttagcttatttcctgcaaaacccacaaaatatagaaagtaccctgagttggaaatgtttttataacccatattctaaatcatctgtgatttagaaagagaactggaaacaggaataatagaaactatgtcttcaggctatttagaatgacacagtgctctataaacctcagctaatgtctaggtttgttaggcggtcactgtgagaaaagcattttgtgagcctactctggtgccaggcaccagtttaggtcagagtaaagtaagcacaaatatttacttgggagtctgagtacatatatagtcatattatataacaacatgaaaataggatagaagtgtcaattgttgataaaacatttaacaataaagtggcctcaatatctgggttcgtatttgtatggcttcattcactcactcaacaacgacctgcccatctccaatcatgtgccaggcaccacagctcaggggagtccgtaggaaacaagacacagcacttgctgttctagaacttgcttgttggtcgaggaaggcattaagcgaacagtgcaagtctttattttgatacatcaactgctatccattgctaaggaaacataaaactacgtaagaaggggaaacaggtgagatggggaggtctctcttagaaggtggccagagaaggccactctggtgtggagaaatctgagcggggtcccaaggacagggtgaacaggtataaagagtccctgagattctgacttattcctactagtcaagatttcttacctgctgaaacactgacaaagcctgccacttctacctctgaatgtgagagacaaattaactttattgtctccatcctggaatgttcagtccaactgctatccttctcttaaattaaactctgacagtacaaaaaagctcagtcataaaaaaaaggtagaggaaggggaccacaatgaagcagcagatacacagcaagagggactcactacaaaacctgttttaaggaagacagatacatctcctgttagtcccagacattccttcctaagtaagtttttaagctgggcgcattggctcatgcctgtaatcccacctactagcgaggctgaggaaggaggattgcttaagcccaggagttggaggccagactggataatatagtaagacgtcatgtctttaaaaaattaaaaagtgcagtggctcacacccgtaatccccgcactttgggaagccgaggtggatggatcacctgaagccaggagttcaagatcagcctggccaacatggtgaaaccccatctctactaaaaatacatccgggcgtggtggctcacgcctgtaatcccagcactttgggagtccaaggcaggtggatcacgaggtcaggagttcaagaccagcctggccaagatggtgaaaccccgtctctactaaaaatacaaaaattagccaggcgcagtggcagtcacctgtaatcccagctacttgggaggctgaggcaggagaatcgcttgaaccctggaggcaaaggttacagtgggccgagatagctccactgcactccagcctgggcaacagagcaagaccgtatctcaaaaaaaaaaaaaacagctgagtgtggtggtggatacctgtaatcccagttacttgggaggctgaggcaagagaatcacttgaaccggggaggtggaagctgcagtgagctgagatcgcccccactgcactccagcctgggtgacacagcaagacactgtgtcaaaaaaaaaaaaaaagaaaagaaaagaagaaaaaagaacccaaattccatccaagttaaccagcaatgacttaaaaagcaagcaaaacaataactcccggccgggcgcggtggctcacgcctgtaatcccagcactttgggaggccgaggcgggcggatcacaaggtcaggagatcaagaccatcctggctaacacagtgaaaccccatctctactaaaaatacaaaaaattagcagggcgaggtggcaggcgcctgtagtcccagctactcgggaggctgaggcgggagaatggctggcatgaaccccggggggcggagcctgcagtgagccgagatcgcgccactgcactccagcctgggtgacagcgagactccgtctcaaaaaaaaaacaaaaaaaaactcccataaaaggaaaaaacactaagtcactgttttccagtgaggaaagtacatcagagtaacctggggaaagagagacacctggtgtttgcttctttggctatttcaaagaggaggaggcaatagtgtctacagaactagatgctatgaccttcttaacctaagagtgaagttgacagcactgatctggggaaggtgataagcagggagctcagggcagggccctctaccttttcaccactgtgttctcaggactcatggcgtaaagcagcctcccaaatttttttaatcaatggactttcttcttcttctttaagagatggcgatcttgctctgtgacccaggctagagtgcagtggcaccatcatagctcactgcagcctcaaattcctgggctcaagtatcctcccatctcagtctcctgagcagccaggactaaaggcatgtgccatcacacctggctaacttttatattttcagagatgggctggtctcgctacattgcccaggctgttttcaaactctcagcctcaagtgatcctcctgccacaacctcctgaatagggctttctttttttaaattagagatggggtctcgctatgttgcccaggcagatctccaactcctgggctcaagtgatcctcccaccttgatctcctgaagtgctgggataacaggcataagccactgcactggcccggaatttctttctttctttttttgagacagagtctcgctctgtcgccaggctggagtgcagtggcctgatctcagctcactgcaacctccacctcctgggttcaggtgattctcctgcctcagcctcccgagtagctgggactacaggcacgcgctacgacgcccagctaacttttgtattttcagtagagacagggtttcaccatgttggccaggatagtctccatctcttcaccttgtgatccgcccgccttggcctcccaaagtgctgggattacaggcatgagccactgcgcctggcctagaatttcttaatgttcctctctccccctccacaatcccacctaatgtagcaattaacagtttggtgatatgttgggacaaccaagaatgtaatttctgaaaacagttgatatttcatttaaaacaaaaaatattattaattcagaaggcccaagaaaaaggctcttgtactgttcactcttctgagggaagtatcctacaaaacagtaataccgtaaagacattcaggagagcccaggtatatggagagcatactctgattttaatcacttcaggtattttcaccaggtaattaaattcactgtccaatcacctgtctcaaaatcctgctgattaatgagaagccttaatgggaaatttggtattaactacatcttttaggaaatcattaattctagaaatggaaaattaaaactactcctgacttcactttacccccacttcaaaagtctacccagtctagccaaggttctcactgggaagtggggagaggaggaatatgagaggtcccaaggaaactaaactggaaacgagaaagtggaaagaggaaccaagaacccagtctcggatggctcttggggctggctggctcctctctctctccttccagtgtgctttctctgctcctctgtgaatctctctattaaccaatcactgtcatcttgtacagggttcaacgcagcctaggattctaaatcacagcaatcatcaaatgtcagccatgtctctgtctccagagtctcctctgcaccaactcactccctcactgtctgcaggccaggtggctggtacactgtggaactggggaggatacagcaagtcctgtgggcagctgcccttgccaaagggacaatgggtggagtacctgagaagggaacatgggtaggccaagcaatgacgatatctttaacatgggaacaaacttctctacatgtgcacttatagcagtacccccatatctgagaaggacatgctccaagacccccaggggatgccagataaactgtggatagtaccacactttatatagactacattttttcctttatgctgtattttttcctatacaaatgataggaacttaatcctgtaacaaagttttatttataaattaggcacagtaagaaattaacaataataactaataatcaagcagaaccaccataacaacataccgtaataaaagttatgggaatgtggtctctctcgtactgtaccgtgatattttatggtgccatacctcaaaagacaaggccacgggtacaggggctactgcaattcttccctctggcactgcactagctgaggacatgccacaaagcagcacacatggatccataatggagaatccagaacaattacagtccccaaaacacacaaaataaaaacacaactgcacagtcactggtgttttttcttttctttaaaagcattcatgaatatccccactgccttatctgcctactatgtcaaaaacaggagagaaggccatggccagaatcatggaacatccaataaaggcagtcacttgttattctgacaagtcatttgttttcagttcatctgtcgcatctgtcaagaaaaacacagactgtcttctaaaagtccgtttttaactattttattttttttcaatgacaaattccacttgtaccatagaagccatattctgcatgttggagaggcccctttgtggtccctcatccctgggttcttcctgggcatcctatggcctcccctctggtgacaggcagcaccccgaagacttaattttgattcttaaaaagggacagatccctccttccacccttgtccaggtacttccagagggtgggtccccttctcatgggaacatactacccccactcaccagaccacagtgatgagtccagcccagactgtgggccatgaaagcctaagctcccaaaacaaacaagatgccagggacactgcagccatctcagaggacaccgaaagacattttaaagccaagggaagcacagcagaacatcagctgctggacaccaagggagccacagctcgagggggttcgtgctccaacagcagatggagctacacccttcccgatgacgtcacatcctaataaagccctgtttgcagtggctgctgtgataaaaaagcaagctctgcatgaaatcaacatggaacaggaaacaaggggtggggtgggacggagtccaatctgattctgaagtttgagaagctgtacaacccattagtaattgtggctatttaaaaataaaatacagtttccttcaatttatgggtatttattttcttttttttttttttggaggcagagtttcacttgttgcccaggctggaatgcaatagcgcgatctcagctcactgcaacctccacctctcaggttcaatcaattctcctgtctcagcctcccaagtagccaggattagaggcatgcaccacaaagcccggctaatttttatattattagtagagacagggtttcacaatgttggccaggctggtctcgaattcctgacctcaagtgatccacccgcctgagcctccgaaagtgctgggcttacaggcgtgagccaccacgccccgacggggattagttttcaaatggctaccctaacttcctaggacataaatagttaaactgtttagatggaaagattcaacaaagggctgggcgtggtggctcatgtgagcctgtaatcccagcactttgagagcagcctgggcaacagagggagatcctgtctcttcaaacaaacaaaaaaattcaataaagggaatgtgaactatgtatcgtggcctaaaggcatttggagacataaaggtgccatgaatctgccctcagggatgagacgccaacggagactgattggcaggagtgggggaggaaagaaaatgtaaagaaagggggagcagggtaaactaaaggagagaaaaggggagaggaaggagaagtggggtgggggagaggggtgggaaagaagagggaggcaggccgggcgcggtggctcacgcctgtaatcccagcactttgggaggccgagaggcgggcaaatcaggaggtcaggagatcgagatcgaccatccttgccaacacggtaaacccctgttctctactaaaaatacaaaaaaggtgtaaggaagggatccattttcagtttttgttgtggggtggggggagaggggacggaaagcattaggagatatacttaatgtaaatgtaaatgaccagttaataggtacagcacaccaacatggcacatgtatacatatgtaacaaacctgcacgttgtgcacatgtaccctagaacttaaagtataataaaaaaaaagtaaacaaagaagaagtaaaaaatagcaaccataaaaaggaatgaaagcatgtcctttgcagcaacatggatgcagctggaagccattatcctaagtgaattaacacagcaacaaaaaactgaataccacatgttctcatttataagtgggagctaaacatcagggacttgtggacataaagatggcaaaaatagacaatggggactattagacaggggcatgatagagggtggcaagagttggaaaactgactgttgggtactatgcttagtacctgggtgatgggattactcatacccaaacttgagcatcatgcaatataaccaggaaataaacctgcacatgcaaccctgaatctaaaataaaagttgaaaaaattagtcaaaaaataaataaataaaaacaaacaaacaaaaaaaaattagccagtcgtggtggtgggcgcctgtagtcccagctacctgggaggctgaggcaggagaacggtgtcaaccttggaggcggagcttgcagcgagccgagatcacgccactgcactccagcctgggcaacagagcaagactccatctccaacaaaaaaaaaaaaaaagagggaggaagagtccccacaaaccagcctgtgggcaacagagcaagactctgtctcaaaaaaaaagagggaggaagagtccccacaaaccgaccagactgcagctcagctctaaatccaccccaaaagcctcacctactgctctgcccctccactttgcagtaagctgtaacacactacacgctcatcaaaaatgggaactgacactttgggaggccgagccggacagatcgcttgaggtcaggagttcgagacccgcctgaccaacatggctaaactccatgtctactaaaaatacaaaaattagctgggcatggtggcacgagcctgtagtcccagctacttgggaggctgagacaagagaatcccttgaacccgggaggcagaggttgcagtaagccgagatgctgccacttgcactccagcctgggcgacagagcgagactctgtctcacaaaaaaaaaaaaaaaaaagggaactgacttcccaatctttgtgtctcagaacaaaacccagcacagctgcgcacagtggctcatgcccataatcccaatattgtgggaggctaaggcagggagactgttagaagccaggacttggagcccagtctgggcaacataaagagtcctcatctccacacacacaaaaaaattttttaaaaattaactggacatggtggtgcacatctgtagctgaggcaggaggatcactgagcctcagaggtcaaggctacagcaagttatgatcccaccgctgcactccagcctgagtgacagagcaagaccctgtgtactgtctcaaaaataataataataataataataaaaacccagcaggaactcagtaactgcttattgaaaggcatccctcaagggaagcaggattggcaagcagccttgagaacagacacatctcagagattttatatcctcagggggttgggggttggtggtgggggagaagtgatggaggggcaagagaggatgtaaggaagacacaggtcagagctggaagcaaccctgaaggaggcttcaatctgtggctaaaacagagctggtgctgaggctccagttagagctcaaactggacccttcaagcaacacagacagcactggaagcattcaccagagaagccccaggacacatctctggggtattcagctcaaaatgcaaaacctgaatccccccatgaggcagccaccagacccaaagtgagggatgtcctacaggataactggcctgtactctttaaacctcaagggaggccgggcgcagtggctcacgcctgtaatcccagctactcgggaggctgaggcaagagaatcacttgagccccgggggtcggaggttgcagtgagctgagatcgcaccactgcacgccagcctgggcgacagagtgagactccatctcaaaaaaaaagcctggtgtggtggcgcacacctgtaatcccagctacttgggaggctaaggcaggacaatcacttgaaccaaggagatgaaagttgcagtgagccaagattgcgccactgcactccgcctgggtaacagagtaaaaccttgtcaaataaataaataactaagtaaagtgtatatgttagcagagcaacgtggcagtcccatgtaccatgaattggaggatgaagagccactaagtaactcctgggacctcctcttcggaggcttgtcaggtaaattaggagatgattacaacagtctgagtgagaagtccacccattaacttctccccacactgagtgagacaatcagtttcctaagtctattacccggtagtgtaaagtacttcatttttattaatttttttttttttgagacagggtctcgttcagttgcccaggctggagcggcacaattacggctcactgcagacttgacctcctgggctcaagcaatcctcccacctcagcatcccgagtagctgggactacaagccgtgctctgatgcccccgatttttgtaatttttgtagagacagggtttcccccatgttgcctaggctggtctccagctcctgggctcaagcaatcggctgccttgacctcccaaagtgttgggactacaggcacaatccactacacctggccagtactttatttgtacagaagcagaacaaatacacccagcagaaaggtaaggaagctgaggagggctccccggtaaggtattacacgtaggcatcacaccttggagactcttagaaaacaccacggaggaggcaaggtggctgaatttgaactgcagtggtgctgaagtccacacaaataactgccatacacacacaagagggaaaaccaaacctcattcagccccacgccaggccacatccctctacctaagagcacagtgctagacccaggctgaatgtgtctgaccctcagcactgtggacactggggtcatcccgggtggtgcagggtgctgaacagcatcactggcgtctgttcatcagatgaacacaatccttggtcactgcccctcttcagccatcagtctacaaatgggctgtagaggttttccaaccaaacaaatgagtaacagaggctcagatgggcaagttgtgaggtggtgctggctagaaatggaagcagtgagggccacagagaaacaaagaaaagaaagtatgtgacaacacccaatcatgtaagttatgcaatttatagccaacctgagtaatatgtgagataatttgactgattttagagcctcatctcccacagaaacctgaccaattcagaaaagcactgccgtcccttgcccactgtggctgctgccactggaggggtttgggagtggggcaaacacaccccagacattgcaaagcgtcaacaaagccctttactgaaacgtctacttaggagacctaactgcctttctatggctaaacctagtgttcaggctccaccaccttctacatgctgctactctgttaactataaaagaacacaaaaaacaaaaacccacaggactcactcttcatccacaaatagctcattttgagatcttctccttccaaggttcttttagtgagcaaacacccaaatttcagatatcacacacagtaagatttcaaaggagatttaagttggaaaaattcagaaaacctacctatgcttaagcactgaatccccactctcagtgtagtatatggcagcacataattgataacatttttttaaagaataggacagaacaatgtttctgtgggaggtggtgttgcacagtgactgaaaacaagagggtctgggccaggcacactggctcacgcctgtaatcctaaaattttggaaggccaaggcgggtggatccagtttgggcaacatagttggaccctgtctctacaaaacaaaaaaacaaaatttaaaaaatttgccaggagtggtggctcacacctgtaatcccagcactttgggaggctgaggcaggtggatcacgaggtcaggagttcaagatcagcctggccaagatgatgaaaccctgtctctactaaatatacaaaaaaattagccaggcgtggtggcaggcacctgtaatcccagctattcaggaggctgaggcagagagttgcttgggaggcggaggttgcagtgtgccaagatcgtgccactgcactccagcctgggtgacaagagcaagactctctcaaaaaaaaaaaaaaaaaaaaaagaagaaaaccccacgaaaaaactattcttagcttctgggccacagaaagagatggctgtagcgtggcaacttctggctcatagcatagggcctagtacacagtaggtagttaaaacggccgcaatgatactggtttctcccactatcatcacaagttattccctccggccgacccatcctgccgattaccacctggcctgtaggttaacttcatgtagccaattctgtgccatgaggagcatgttccacctaacagaaacctgacattcctgcaccccaggaagtacatttttgggtctttaaatcaaactatataatcttgcctaagaactctgaaaaacccagtatacgaaagactttttccactagtttgtactctgagtaaaattcttcgttctgcaatttataactaagaggttatattttagttgctcatctcccaacaccttttactcactgcatcttagagtgctcacttacagctgctgatgcacatctcctctttcacaaaacgtaaaggtttcatcagctacaattagcttaaccaattacattttacttggcctttggttttgcctgattgccttgtacagagttatgaagagtattgctatctaacatctgttataaaaactaccaggccaggccaggcgtggtggctcatgcctgtaatcccagcactttgggaggctgaggcgggcagatcacaaggtcaggagatcgagaccatcctggctaacatggtgaaacctcatctctactaaaaatacaaaaaattagccaggcgtggtggcgggcacctgaagtcccagcaactcgggaggctgaggcaggagaatggcatgaacccgggaggcagaggtggcagtgagcagagatcacgccacagaactccagcctgggtgacagagtgagactccatctcaaaaaacaaaaaaaaaacaaaaaaaaaccaaaaaaaaaaaacaggcaacacattgtggctcatgcctgtaatcccagcactctgagaggccgaggagggcggatcacaaggtcaggagatcgagaccatcctggctaacacggtgaaaccccatctctactaaaaatacaaaacattggccaggtgtggtggcgggcacctgtagtcccagctactcaggaggctgaggcaggagaatcgcttgaacccgggaagcagaggtcgcagtgagccaagattgtgccaccgcactccaacctgggcaacagagtgagactccatctcaaaaagaactaccggattacagttatgttatgttcacaataccagcatccaaaaatatccagtgacaggatacagcaagaaacatgactacaaggtctatgaaacaggagactacagtacctaaaaaggcagatttaaacaaattcctgtaatgtgctcatttcagtcatgctaacttgagaaagcttttaaaacttttaaatgtaaataatccactttcacatttcttccaaaatgaaaaataactccttttttctgtcactgactttggcgaattttccaaaaaataaagagaaaacagttttgttttttggttgttgttttttgagaccacgcctggccttgaaaacagtatttatttattttttttttttttgagtttcactcttgttgcccaggctggagtacaatggcgcaacgttggctcactgcaacttccgcctccgaggttcaactgattctcctgcctcagcctcccaagtagctgggattacaggcatgcaccaccacggccagctaattttttctatttagtagacagacagggtttcaccatcttggtcaggctggtctcaaactcctgacctcaggtgatccacccgccttggtctctcaaagtgctgagattacaggcgtgcgccactgcgcccagccagaaaacagtatcttaaaacagtatgttcctttcctccattcaccccatgagataccacgtttcacagggatgtcttccagactttgatacatatgtgcataatttttcacaagtcaatcaaatgataccatattccccaaactatacatattcaaaatgcccaaccatttactgtattgtggtcatctcttcatgccaataaaggaaggccaccttaaatctttttaacaactgcacagtatgccattccaagtctgccttaatttaaccaatctattgatggacatttagattcatccaggggtgtccaatcttttggcttccctgggccacattggagaattctgtcttgggccacacataaaatacactaactagtaatagctgatgagcttaaaaaaaaaaaaaatcgctaaaaaaaaatctcaatgtggccgggcgcggtggctcacgcctgtaatcccagcactttgggaggccgaaatgggcagatcacgaggtcaggagatcgagaccatcttggctaacacggtgaaaccccgtttctactaaaaatacaaaaaattagctgggtgtgttggcaggcgcctgtagtcccaggtactcaggaggctgaggcaggagaatggcgtcaacccgggaggcggagcttgcagtgagctgagatcgcgccactgcactccaacctggggcacacagggagactccatctcaaaacaaacaaacaaaaaaacctcaattctaggccgggtgcagtggctcacgcctataatcccagcactttgggaggctgaggtgggcaggtcgcctgaggtcaggagttcgagaccagcctggccaacatggcgaaaccccatctctattaaaaatacaaaaattagccaagcatggtggtaggcgcctataatcccagctactcgggaggctgaggcagaagaattgcttgaacctgggaggcagaggttgcagtgagccgagatcaggccacttcaccccagcctggcaagagcgaaactccaccaaaaaacaacattttaagaaagtttacaaatttgtgttgggctgcaatgcggcccacaggcctcaggttggacaagcatgactaggcattcatacagcaaatatttattgagacctactatgtaccaggcactgtcagaggatataccaggaaataaaacatgaagttctctaccctcatggagcttatattttagtggctactgacaattttttgcttttataccaaaaattctagctaggagtttttgagcattgtctgtcttaaatatttggcttttataactaattttataataagcattctcttatttcttcctttggataaatttctaaaaatagacttgctggaacaattattttagaaatgcttttatactaaaaataataaccctttatcatatatattcctaacatttttctaattttcctgcctttgaactatagttcagaggcccccaaacaggcatcttttgctgtagatatgttccgaatgcttaagcagatatcttttcatagcttatagccttattgtcaaactaagaaactctttacctacagctggattgccagttgatccaataccttttacatgacaaaccatccattcccaactgattgtaaatgctacattaatcataaattcccattaatttatagatcagtatctagactgctttgttccacttacctataatacttataaaaaatctactaggaaacgttcccccttttctttctttagaactcccctcaaatatttacttctccaaatcaagtgacatcttgaaaatattcaagcacatgcatataggaatactgcattcaagttctgtatttatgtctatctattcaagttctctttcacctcttcaataatgcatctaaaggttccttcatatagtgtgtgttttgtttttttgtttttttttgagacggagtttcgctctttttgcccaggctggagtgcaatggtgcgatctcagctcgctgcaacctctgcctcccgggttcgagcaattctcctgcctcagcctcccgcgtagctgggattacaggcatgagccaccacatccaactaatttttgtattttttagtagagatggggttttaccatgttggccaggctggtctcaaactcctggcaattgacctgcctcagcctcccaaagcgctgggattacaagcatgagacaccgtgcctggccatgttttcccgtttttaaaagtgaaaaagttagccgggcacagttgctcacgcctgtaattccagcactttgggaggccgaggcaggtgaatcacgaggtcaggagttcaagaccagcctagccaagatggtgaaaccccgtctctactaaaaatacaaaaaaattagccaggcatggtggcgggcacctgtaatcccagttactcaggaggctgaggcagaattgcttgaacccaggaggcggaggttgcagtgagccgagattgtgcaactgcactccagcctgggtgacagagtgagactccatctcaaaaaagaaaaaaagtgaaaaagttttaggcctaacaatcatgaaacaaatgccattagtgtatttgcctaagaactcaaaaaatcttctgaagttaatttctataaagaataagttatttacagccaggcgtggtgactcatgcctgtaatcccaacactttgggaggctgaggtggacggaccacgaggtcaggagatcaagaccatcttggctaacaaggtgaaaccccgtctctactaaaaaaatacaaaaaaattagccggtgtggtggcgggcacctgtagtcccagctacctgggaggctgaggcaggagaatggcatgaacccaggaggcggagcttgcagtgagctgagatcacaccaccgcactccagcctgggcaacagagcaagacaccttctcaaaaaaaaaaaaaaaaaaaaaaaaaagaataagttacttacaaaaaagaagcaaacttacaaagaccagaggctctagtcagtccactgctcctttatgttgttatctgaccattcattatctcagacacttactactgacttctataagaatccaaaaaacagaatttcactagaaggtgacagtcttgtttcagctaaccattcatgcccaagagcttaattacagggtggacctcagcccccaccttagtgtctctcaggtgggtgggatgaagtcagagaaaaggcagtgcagcaccagcaacacaggtccatcaggaactggagcttttcctactgtccctgcttcctcctcccgtgaatcccaacaatcacagccacagaaatagtaagcaggaaaaaacaaggaggtggcagtagaggagcctatttgtcttatcacagttattcatcacgtagctggttcctcttttctgcctcttcttccagatgacccaactaccctcaaactgccctcccaaccccgaaagaaagtctctgattttgtaataggtcaatatatacaaaaacttcagagctatttatattccatttatcaaggacaacctacgctaacacacttgtacaacacaacttgtaatgctgctttgttatgtcttcagattcaaaaacaatcttttctttttttttcttgagacaacatctcactccatcacccaggctggagtgtagtggtacaatctaggctcactgcaacctccacctcctgggttcaagagattctcctgccttagcctcctgagtagctgggattataggcacccgccaccatgctcagctaatttttgtttttagtagagacggggtttcaccatattggccaggctggtctcgatctcttgacctcaagtgatctgcccgccatggcctcccaaagtgctaggattacaggcgtgagccaccgcaccaggcccaaagacaatcttatgtttttgtttgtggggttttgtttttgcttttttgagacaaggtctcactctggcacccagactggagtacagtggcatatcataactcagtgtaacctcaaactccttctgcctcagccatcccagtagctaggactacaggcaccatgcccagctaattttgttttttaaactttttgtagagacagggtctcactacattgtgcccaggctggtctaaaattcctggcctcaagggatcctcgcaactcagcctccccaaatccagagattacagggattatagttataagccactataatcagcccgtcttgtttaaaaatcaaatccctccctatcaaactcagctttctgaatcgcactttgtcttttccaaaacataatattctgagctcagcagacacttccttatgcgctgttacgcatgttagcgttgctggaattacagtaagaataatcatctgccaagagccagttcaacccatttctgatataaaaagccattttagcactttgggaggcagaggtgagtggattacctgaggtcaggagttcaagaccagcctgaccaacagggtgaaaccccacctctactaaaaatgcaaaataaattagctgggcgtggtggcacacacctgtcatcccagctactcgggaggctgaggcaggagaatcgcttgaacctgggaggtggagtgagccaagatttcaccactgcactccagcctgggcgacagagactccatctcaaaaaaataaacaataaaataaaataaaaacagaactctccactgttgcccacatcaccctccaactactgagctccttctctgagccctctagagcaaccttctttaagtcgtatctacacaggtggtctcctcttccatctcctatgtttcaattgactccaatctggctttcactccctaccgtgaaaccaaaagggctgaccacctagtacctgcagtccttaaatttaaggaacctttggccaggtacagtggctcacacctgtaaccccagcattttggataacattaaggccgaggcaggtggatcacttaaggccaggagttagagaccagcgtgaccaacatggtgaaaccccgtctctattaaaaatacaaaaattagccaggcatggtggcacacatctataatctcagctactcaagaggctgaggcaggagtattgcttgaacgtaggaggcggaggttgcagtgagcccagatcgcgctactgcactccagccacggcaacagagtgagacttaagggaaccctttccccacccccattcacctgactcctcaactgcaccctacactgtcacatcccacctctccgtgtctcctcgatctaacctctaatagctgggcaccccacctctccttttaataacccctccaccgaccatcacaaaaacagaaagaccaagacttccagactggactccaggccaacaggctgttagccggcggttggcacttagttgccctatacccattttgagcttcagatattcaaggcatggctctgcacagccaacagatttgcctcccctcagtgctcaacatcaccaccctctacatgtgcaaagcacacacagaaatcatcctggcctccttcctttccctactcccctacacccggtccatcagcaacctggctgactctaccacccatttcttcccatttccttagtctccatcctcagccaaaccacgccatttctcatcaacagtctccttaaaatgacctctgtctcaatctgtgcccccgacaatccatttttcattcagcaatctgaacaatcttttttctttttttttttttcttaagacagggtctcgctctgttgcccagactcgagtacagttgtgtgatcatagctcactgcaaactccaactcctgggctgaagcgatgctccctcctcagcctccccagtagctggaactacaagtgtatgctacaatgcccagctaattttttcttttaagtagagacagagtcttgaactcctgggctcaagcaatcttcctgtctcaacctcccaaactgttaggactataagcatgaaccactgcacccagcctcaacaatcttttaaaattcaccttttgtcacttgaggcttaaaatttttcaacggcttcccactgcatcaaggaaaacatccaagctctctgccagtttggaaactagagaatgcaccatctgcacgaggaccctcacctggtataaatcaagactgtcctgggcaaactgggcctctggcacctgcctgaggccgtgtggccaaggcctggcttccacccctacctctgccctacagctttgctcctgtgtgctgagcttcacccgctgtcccttccgcaggacctctgctgagcttcgcctgctgtcccttccgcagggcctctgcaatcactgccctctccacctgaagcataggggctccttgcctacctggttccttctcatccttcaggcctttactctaaataccctaaacaataccctaaaccaagtgccctctccacccaacagctcacagcacctaccacaggcccaaacttcgcttcttccagttcgccatctccccacagagaatgaaccaccagttgcaacttctcggtactcaaccatcaccaagcacagtgtcttgctcaaagtaagtacttggtaaatatttgttaaagagttcactccatcccacagataccatattattaactgggcatcctaaagcaggaagttcttgaggtcacacagtataggaaaggctgtgatgaaaaatggccacggtttctgcaagtcccaccattaaggaccagagtctatctcctactctccaagcctgtgctaagccttgtttttttttttttcttcattttcggtagagatgcggtctcactatgttgtccaggctggtttcaaactcctggcctcaagccatcctcccaccttggcctcccaaagggctgggattacaggcatgaggcagcactcctggcctatgctaggcctcataacttgcaataagcaagggaatgcaacagaggtgacactgtgacttctaaacatgtcctcaagtagcctgtcaaactctgctcctgcccttttggaattcagccactatgggaggaagcctgagctagactgttggagaggcaggctgaggagatcagaggcaccctggctgaaagcccatgtgggtgagggcaatgggaagcacaagccagcctacctgccaactgttaattgcccttgctagcgtggccagcacagtgaacagagatgagccctgcccacatccatactcccacatgatgatgaacaaggacttactgttttaagtcgcttcattttggggtagtttgttacccaggagcatataactgatgtaaggccatgacaatatgctcttcttaaacttggcgccgagactggacgcagtggctcacacctgcaatcccagcacttcgggaggccgaggtgggcgggtcacctgtaatcccagctactcaggaggctgaggcagaagaattgcttgaaccccagaggcagaggttacagtgagccaagatggtgccactgcactccagcctgggcgacagagcaagactccatcttaaataaacttggcaccgagactgctggactggacaattctccatggtggagcaggatccctgtggcacaccccagctgtcacaaccaccaatgtatccaggcaggcagcgtggggactaaatacaagagggaacgcatacctgcctctaggggactcagcactttcacaggggaaggaaagattccctgctttggaggcattctttatgtcttctcattgacttctgatctaggttactggtccccaaggacagtcagtggaacaaatgctggcagcagcctcgatccatccctgtggaagctaccgaggacaacactcttcagttcccacaaaagaaagactagcaaagcataaacacaacgcgcctcctggccaggtgcggtggctcacgcctgtaatcccagcactctaggaggccgaggcaggcagatcacgaggccaggaattcaagagcagcctggtcaacatggcaaaaccctgtctctactaaaaatacaaaaattaggccgggcgtggtggctcacgcgtgtctgtaatcctagcactttgggaggctgaggcgggcggactgcctaagctcaggagttggagaccagcctgggcaacacggtgaaaccccgtctctaccaaagtacagagaaagccgggcgtggcggtgtgcacctgtagtcccagctactcgggaggctgaggcaggagaactgcttgaaccttggaggcagaggttgcagtgagacgagactgcaccactgcactccagcctgggaagcagagcaagactccatctaaaaaaaaaaaaaaaaaaaaaaaaaaagtacaaaaattagctgggcatgctggcacacgcctgtagtcccacctacttgggagactgagacaggagaattgcttgagcctgtgaggcggagttgcagtgagctgagatggtgccactgcagtccagcctgggtgacaaagagtgacaccctgtctcaaaaaaaaaagacaaaaaaaaagtgcctcctgagcttcgttctgtgaagcatccagaatccttacagcagcggtcaccaacctttttgatgccagggaccggttttgtgaaggacaatttttccacagacagaggggatggttttgggatgaaactgttccacctcagatcatcaggcattagattctcataaggagtgcacagcctacatccctcgcgtgtgcagttcatgacggggttcacgctcctatgagaatctaacactgccgctgatctgacaggaggtggagctcaggtgggaatgctcgcttgcccacctctcacctgctgtgcagcccggctcctaagagaccacagcccaggagttgggggcccatgcttagaagacattttatctttttctggttttttttttttggagacaaagtcttgctctgcctaccagtctggagtgtagtggtgtgatctcagctcactgcaacctcaacctctccagttcaagtgattctcatgcctcagtctcccaagtagctgggtctacaggtgcacgccaccacaccccactaaacttttgtgtttttagcagagacggggttttcacatgttggtcaggctggtctcaaactcctggcctcaagtgatccacccgctgtggcctcccaaagtgctgggattacaggtgtgagccatcacacctggccaaggacactttaccttttctattttgttttgttttagaggcggggtcttgctctgtcacaggttggagtgcagtggcacaatcatagctcattgcagcctcaaactcctgggctcaagtgatcctctcatcttggcctcccaaagtgctgagcttacaggagtgagccactgcatccggcccctttttctatgtaaattatcttacaagtttcttcaacctccaacagagacttcatttcacaaggctggccacaaggggaatgggaagacatggaaggcaagagagctagaaacacaaggggcgaaggatgaagctctaggaactttagcaggttcaacagtgtccccccccccaaaattcatgtctacctggaacctgggaatgtgaccttatttggagcgtctttccaggtatgattagttaagttaaaacgaggtcatactgaattagggtggccctaatctaataactatgtccttataaggtgagtagagacactgagaaaagcccacgtaaaacagaggtagagagtgactcctctacaagccacactgctggcacccaccagaagccagaaagaagaaaggaagtgtcctcccttggagccttcagaagcactggggccctgccaacaccttgatttcagacttctgtcctccagaactgagggaatcaattcattctgagccatccaacttgtgatgatttgctacagcagccacaggaaactaacattgtgtcatttctgaagacctttactaagccagaaccacaagggtagaaatcaagtgcccagatcagcttggagaaggacttgtttttttttaatagagacagggctggagtgcagtcgtacaatcaggtcactgcagcctcgaactcctgggttcaagcaatcctcccaccttagcctcctggatagctgggactacaggtgtacaccatcaggcccagctaagaaaaagagagagcaagagagaggacatgcatgtgcacacgagagagagagagagagagagagcgagcgtgcatggccacgtgcacgagccagtgagcaagcgcacacacatgcaaaaatggggtctcactatgttgcctaggctggtctcaatcttcccacctcagcctcccaaagtgataagtgtcataggcataagccaccacacccagtcaatggagaagcatttcaggaatgaaggcagagtcaaacaccatcagtagtagcggtactggaagctaacactttgaggtcttgcttggcttgaagctaagaattttatttgtagcatgtcattcagtcctcacaacaatcctggaagacaagaaaactaaggtagagacgttcagtaacttgctccagacctcaaatctgagttggcagaaccaggatgtccagcacgtggattcaggtacaagaaataccactgatatctacataattactactcatgttttccaagatgaatgacatttggaaacaattacaaagtagaaaaatcacaattttaaaaatctatatatacaggccaggcgtggtggctcatgcctgtaatctcagcactttgggaggccaaggtgggcggatcacttgaggtcaggagttcgagaccagcctgaccaacatggtgaaaccccgtctctactaaaaatacaaaattagccaggcatggtggtgtatgcctgtaatcccagctactcaggaggctgaggcaggagaatcgcctgagctggggaggtggaggtttcaatgagccgagatcgcgcctctgcactccagcctgggcaataagtgagactctgtctcaaaaaaaaaaaaaaaaaaatatatatatatatacacacacacacagagtgggacccccaatccgaggaaaaacatctctatacacacatgcatgagagatacaaaacactagaagaaatataataatcttacatggttatttcctgattgagagattatagatttttgctgtatgttcctaatttcccttttttataaaattttatttatttttttaaaaatagagacagggtctagctgtgttgcccaggctggtctcaaactcctggcctcaagtgattctcctgcctcagcctcccaaagtgctaagattacaggcatgagccaccatgccaagcccctaatttactacaatgaacattttagatgtttttattagcaaaatgaagaagctgaaaataaaactgagacaacaggaacaagatctccagagaaaggataggatagatggtggaggcaatggaaacagactgcctgttggggagtttaaagagagaaaaacaagaagagtggctagaatagatagcaagattaactgggtgttgagttacataagatttaggcatgtttgaaggtataatagagtagccactgacaaaactgttggtaactgttttccagtggaaaaatgttccttttactaacataggaagaggcaaatgcagacacagaagtcttctcagatgaatgaggagaaagagctcacaccagcaggtctataatgcataggctccaggagcaatgacccaagaactaagttcactgtcaccacggccaactgtctaatctccctgtagatccagtcatctgtaagatggagctattaacagcacctatcagagctgatgtgaggaccacgcagtaatagcatagttcccagcatggtgcctggtgcaagaaagatacccaacaaatgcgagctaatggcacaggcatcttcaacagggcaaaacgcaagtgcaccaactgccatgggagtgtcaggcagagggactggaaggctaaggttgtagggaatttatttcaacaggaaaaccttcaagtacctctcccaacacactttacataatatgtatgccaagcggggattaaccaattttccaggacttatttcaattccaagtccaagcacagccctgacttggggcttctcctgcctggaaccctcttttcccagatgtctgtctggtttgtcttctcacctcctcctactctctcctcaaatgtttggaccacccttttcaacatggaagcaccagcaatgcctagagccctacagcagactcgtccgccatctttttcagcacacagccttttccactgtcgcataggtaacattcctctcaccaaggcaagttggcatctcttattcactgcccatcacctgcctctccttggcacatctttggccctgaatacgcattttacaaaagatctctcctctcttcccctttatgggcgctgccctctcagtattcccatctaaaatccatgcagacagagcctcccctagccccacacttctctctccgactactttcctacaagactctcctcaccccactggaactcactggccctcagcaatctctaccactgacgaatccatctccaacttcggaccattccctctgctctcagaataccttctgtgggttctgcgacactagtgctgagagtctcccaaagtctggtcactcctttaagtgtttctcttcctctgcacatccctaacacaagggcctcttctcaagctacaccaacgggtcttcacctctgacaaatctctgagttctcctccccaggaaaaggcacaatcctacagtactgcacatgggggcagggacagggtgcctgtctccagctgagaacttctctggtccccacaggtgccctgggcctggcccattctctaaaccagcgctgctcagatatttcggctcagaccccctctacatcctcaactattaaggaccccaggggcttttgtttatgagggtttgatctatcaatatttactgtgctataaattaaaactgaaatgtcctaaaaatgtttatcatttgaaaataagcccactgcatgttaccatacataacatttttataaagaacaactactttctaggccgggcgcagtggctcatgcctgtaatcccagcactttgggaggccgaggcgggcagatcacgagatcaggcgatcgagagcatcctgcctaacacggtgaaaccctgtctctactaaaaatacaaaaattagccaggcgtggtggcaggcacctgtagtcccagctattcgggaggctgaggcaggagaatggcgtgaacccaggaggcggagcttgcagtgagccaagatcgcaccactgcactccagcctgggtgacagagtgagactctgtctcagggaaaaaaaaaaaaaaaagaataactattttctaagaaaaataatctggtgataagccatattttacattttacatttaccttgtctgcctcaatgggagcaatggatcttcacatcgtgtctgctctcagcctgatgcaatacacagttttagctgaagtctaagaggaaaattcagtctcacatagatatgcagctggaaaaagaaaagagctgttttttgttgttgttgttgttttttaagacatagggcctcactctgtcacccaggctggagtgccatggtgcaaccatagctcactgcaatctcaacctgccaggctccatcaatcctcctgcctcagcctccccagtagatgggaccacaggcacgcaccaccatgcctggctaattttcaaatttttttgtagagatggggtctcactatgttgcccaggctggtctcaaaatctcagcctcaagtgatcctcctgcctcaccctcccaaagcactgggattacaggtgtgagctaccatgcccagccaagaacagtatttctatagaatttttattttatttttatatgtcaacacaatgaaaagtcaaataacatcttaatatgattatgaaggccggacacggcggctcacgcttgtaatcccagcgctttgggaggccgaggcaggcggatcacgaggtcaggagatcgagaccacggtgaaaccccgcctctactaaaaatacaaaaaattagccgggcgtggtggggggtgcctgtagtcccagctactcggagaggccgaggcagaattgcgtgaacccgggaggcggagctggcagtgagccgagatcgcgccactgcactccagcctgggcgacagagagagactccatctcaaaaaaaaaatatatatatatatgatgatgaaaacagttctgactaagtgaattcctgaaactgtctcaggagcccccaggggtccacgatcacactttgagaaccactgctctaagtgaccactgctccccaagacttcaatcatcacccaaatgttgctaactcccaaaggcctgcctccatccagacctatcttccagagctccccactcacaggcacaggagtcactacgtcagcatttactgtgtaccgttttaggggctggtctgcagtgaaccagactgcctgtgtccatggagcttagaagaagtgggaagagcattatcaggctacgaagacaagagtggggtaaaacagcagagatcaatgagatcagagcacaccctcggaggaagggatacatgacaaatgcctgaacggagagagggagtgaactgtgcaaacacacagccaggagttttccaaggacagggaggagaaagtataaggcctgccgtaccctcgatgcaaaacatgagaaagcctcagagactcctcaaacccaacacacacaaactaaactcatcatgacccacagccacccagagggcagacggaaacctgtggtcatttacatctttctcgccactctcgccttcccttcggtcaccaggtcttatcaatcgtcaacctggtccagacccctttcctcttctacagcagctttgccaactgactagagtcccctccctcccctgagcactctacgctcaactaccaagtaatgatccccatcagatcaatctccttaaaactctttcagggcttcctggagctctcgaggtaaaagttcatttttttctttttttttgagtctcacactgtcacccaggctagggtgatcttgggtcactgcaacctccgcctcccagattcaagtgatccttgtgcctcagcctaatgagtagctgagaatacaggtgtgcgccaccaagcctaatttttatatgtttagtagagacaaggtttcaccatgttggccaggctggtctcaaactcctgacctcaagtgatccgcccgccctggcctcccaaagtggtgggattacaggcataagccactgtgcccggcctcaaggtaaaagctctttatccagactgtaaaccttttggcttccaggtctaaccactctcctagccctttggaacttccgtccctggatgtgctgtgctcttatgcgcttgataaataattactgagcacctggcacacagtattgtgcggggtgctggagacagtgaaggagaccagttggttgccggatgaaaaacacaccatctcatcagcctaggatacactcctcccctccatccccacctgcctgccagacagactccaattcaggtctcaaagctttttttaatgagaagctgccactgaactctggacagggtggtgtccctgggagccacagccactgccctccgctctgtgcctgcgtgtcaggctccctattagaccatgaattcagcaaggccctggatcacatgcattctactatggctcacagcctcagcacccagtaaggtgctaaattggggccaggcacagtggctcacgcctgtaatcctaacactttgggaggccaaggagttcaagagcggcatgggcaacaaggtgaaacaccatctctactaagatacaaaaaacattagctaggcgtggcggcatgcacctgtaatcccaactatttgggaggctgaggcaggagaagcgcctgaacctgggaggcggaggttgcagtgagccgaaatcgtgccactgcactccagctgggtgacagagcaagactccaactcaaaaaaaaaaaaaaaaaaaaaaaagagagaaggtgctaagtcaacatctgttaaacaaatcaccattacagtttttataaaaacaagtggaaaatatttaattattgtccctatcagcaaatcaagggacgtcaacaaattttggtgaaattaaaaaaaaatctagcttcataaatgggaggaggagaattctctaaaaaaatgaacataaatgggcagggcgtggtggctcacgcctgtaatcccagcactttgggaggccgaggcaggcagatcacgaggtcaggagtttgagaccagactggccaatatggtgaaaccctgtctctactaaaaatacaaaaatcagctgggcatggtggcaggtgcctgtaaccccagctactctggaggctgaggcaggagaattgtttgaacccaggaggtggaggttgcagtgagccgagatcatgtcactgcactccagcctgggtgacagggcaagactccgtctcaaaaaaaaaaaaaggacataaacttaccagttttcaaaatgaggcatagttcaagattattctacaaaggtaaaggaaagcctttaagagcaggttactgtggctcacatctataatcccaacattttgggaggctaaggcaggaggatcacttgaacccaggagttggagaccagcctgtctctacaaacaataaaaaaaattagctgggcacggtggcatgtgcccgtggtcctagctacttgtgagactgagagaagaagatcgtatgagcccaggaggtccaggctgcagtgaaccatgatcataccatcacattccacactccagcctgggtgacacagcaaaaccctgtcccaaaaaaaaaaaaaaaagaaaaagaaaaaaaaacctttcaagaaaagataaggatgtgagagatttagtagaaagtaaggcagtaaataagtgatagggatttgcaaagatagctaatatgcatgttccacaccctgaattaatattcttctggaaccatggagaaaaaaagaaaaatctcagtaaactgtcatcttataacatttgttaaccttgccataaaagaaatttttacaaagcaaggccatcagcaacagaaatagctaatccttgcactgagctctgttatcagtgcccacatcaggactcatttaatcctcacaatgaccccatgaaggaggctctaggagcctgtttcacagataaggacagacacagaagtcctaacactgcaggtggcctaaattaaggcaggctcagggaggacagaaagctcctgtggagtggaagggtagaagttgaactgatcttgattttcagtgcgaataaaagtcctaacactgcaaatcagccagtgaggcaacagagctgagctgggctctaactcagacagtgccaatccttttgaaaactactgaatttctctcactccctagattttaggaattattttaaaattcctatgagaaattttctgaaacctattgtagactcttttgacatgctcatctaattataaagtgtccggactttttttttttttttttgaccgagtttcactcttgttgcccaggctgcagtacaatggcacaatctcggctcaccgcaacctccgcctcccaggttcaagcgattctcttgcctctgcctcccgagtagctgagattacaggcatgtgccaccatgcccgactaattttttttttttttttgagatggagtttccttcttgttgcccaggctggagtgcaatggcacgatctcggctcactgcaacctcagcctcccgagtagctggaattacaggcatgcatcaccatgcctgggtaattttttgtatttttagtagagatggggtttctccatgttggccaggctgatccaccctcctcggcctcccaaagtgctggaattacaggcgtgagccaccgcgtctgggctaattttgtattttcagtagagacagggtttctccatgttggtcaggctggtcttgaactcccaacctcaggtgatccgctcaccttggcctcccaaagtgttgggtttacaggcatgagccaccacacccagcccagaattttttaagctttattaactacaacactcggcagaagttgagtgtctgtaatcaacatagggaatatattttctaagtgctacaggactgcacacagacatgcatggagacatgattacccaccagtaaacaagaatacattccactgatgcccttagtattcccattctttttttttttttgagagacggagtcttgctctgtcgcccaggctggagtgcagtggcgcgatctccactcactgcgaggtctgcctcccgggttcacaccattctcctgcctcagcctcccaagtagctgggactacaggtgcctgccaccacgcccggctaatttttttgtatttttagcagagacagggtttcactgtgttagccaggttggtctcgatctcctgacatcgtgatctgcccgcctgggcctcccaaagtgctgggattacaggcatgagccaccgtgcccggccagtattccaattctaacaggtgaatgaattaatacataaagtcctctcttgatataatgcattagtaagtttggagcaatgaattattaaatcataaaaatattttatctatggcaaaataggttcaacagaataaacttaaaaattaagctgggcacggtggctcacacctgtaatcccagcactttgggaggcggaggcgggcggatcacttgaggtcagcagtttgagaccagcctggccaacatggtgaaaccccatctctactaaaactacaaaaattagccaggcatggtggcgggcacctgtaatctcagctacttgggaggctgaggcaggagaatcacttgaacccgggaggcagaagttgcagtgagccaggacagcgccattgcactccagcctgggcaacaggaaggaaactccatctcaaaaaaaaaagaaagaaaaaaggaattaccttagataatcttaatctggtcttttaaatcagtaagcttttaaaaaatgggtctttctcagaattctaatttaagaagacataaataaggaaatacttccacttaatctttttttttttttttttttttgtgaaacggagtctcgctcagtcacccaggctggagtgcagtagcacgatctcggctcactgcaagctccgcctcccgggttcacgccattctcctgcctcagcctcccaagtagctgggactacaggcgcccgccaccacacccagctaatttttttggtatttttagtagcaatggggtttcaccgtgttagccaggatggtctcaatctcctgacctcgtgatccgcccacgtcggcctcccaaagtgctgggattacaggcgtgagccaccgtgcccggcccacttaatcttaaaaaaaaaaaaaagcaagcaagcaacattgctctataaaacagaaagcttttctaccactgaaagccaggagtaatttccactgattaccatggcacccaatggtaggcactgacacaagaacaagaggctaaaaggtttaaaaaagctttcagcattccggcagggcacggtggctcacgcctgtaatcctagaactttgggaggctcagacaggcagatcaccggaggtcaggagttcaagaccagcctggccaacatggtgaaaccccatctctactaaaataaaattttaaaaaattatccgggcatgacggcgggtgcctgtaatcccagctactcgggaggctgagactggagaatcacttgaacccgtgagatggtggttgcagtgagccgagattgcgccactgcactccagactgggtggctgagtgggactctgtctcacaaaaaaagctttcagcattccactaatccactagcaaactcaaatgtctatagattgtctctatttcttcaatcaaagttctagaacaaaatgcatagctttgaaataggtggtgctctgtccctctcccagagcagctgatgtgatgttgcatttctctctcttcatacacactcactcccatatacgttggccctgctttttctttcagtaatgttgaacactgcagtttcataaatttctgatagtttccattttaaatttattttatctcctcattctgtgttcctaaaccaaacacttaactgaattgcctacttcataatctctccaaccactcttaacaaatgcaaacctgaaatcagaatgtaaaccagtttaaaattttttttatttttattttttgagacggagtctcgctgtgtcgcccaggctggagtgcagtggccgatcttggctcactgcaagctccccctcccgggttcctgccattctcctgcctcagcctcctgagtagctgggattacaggtgcccagcaccacgcccagctaattttttgtagagaagtaattttagtagagaaggggtttcaccgtgttagccagggtggtctcgatctcctgacctcatgatccgcctgactcggcctcccaaagtgctgggattacaggtgtgagccaccacgcccggtcaaaccagtttaaaattttataaaaatttttgttccatgtcttgtgagacttacactaaataggggtttcaaaataacatggcctgccatatggtcaagccagatttaaaaattgagaatatctattaccaatccactaatgctaaagccaaagtcacagacagtaagaatgtaatccaatttagagaccaacatgagccaaatctttcgggcagagaaaaacaacgacaaaactataataaatgccaacactgcacttctaaaataataccaatgttattcattaaagtattagctacaaaaagtcaactgatggtagatgaagtctagagatgccctgaagacctttttcatccttttatcaaagctgtttttagctacaaagctacaacttttccagtggaccaacacacacataaaataaaccaaaagacccagaaatttttagcaaagcaaagggaagagaacaaagctctggtacttttgcaggatagtacaacatctcctttgagaaataaattaacttttcaaattctgtttctcaagtgatcaacataaatctacctagatgatactagctttgaaatcaaagtcattgggcatcaaaaggatttacagaggtttttactcttttgagacacagtctcactctgtcgcccagtggcacaatctcggctcaccgcaacccctgcctcccgggttcaagcgattcccgtgcctaaacctcccgagtagctgggattacaggcgcccaccaccacgccggctaattttaatatttttagtagatacgaggtttcgctatgttggccagactggtctcaaactcccagcctcatgtgatccgcccgcctccacctcccaaagtgctgggattacaggcgtgagccaccacacccagtgggttttactcttaaaaacaaacaataaaaaaaccacacactattctgcagtctcttgaatcttctaagattaaaattaaatctgagaaaatttacttcaactttcccacccaccaaaaaaacagaattaactgaagatatcaaagaaaaaacaatattttaaaggtatcactgaagagcactgtcagtacttgtctgatgagataactatggttctgtcataaattcagattacgcgagagaaatagcttttggccagtggatgtgctcttttgagaaagtcaattctgagctgaaatttcatgttggaacagtttcctctataagactcatcttgaaaggttcccgcagaagataaaatgtcatcctcacactgggcctgggcagtgcgcacttaactgggagggggcacaggcacctcagaacttaactggttttccaaactctcaatctcaaaaaaaaaaaaaaaggcgggcggggggagcactttcagtgttgatgaaaccaaatgctcgtaacctgggaccaccgcccaacacctgcagtccagccttcccccagggttgacagcatcagcctctggaccctgcagttgcagttcatttctgcgcagctctaatcgttagaaagttctgccttaccggctgggcgcggtggctcacgctcgtaatcccagcactttggcagatcaaggcgggtgaatcacctgaggtctggagttggagaccagcttggccaacatggtgaaaccctatctctactaaaaatacaaaaaattagccgggtgtggtggtggtagctgtaatcccagctactcgggaggctgaggcaagagaatcacttgaacccgggggcgcggaggttgcaatgagccgagatcgcgccactgcactccagcctgggcaacaagagcgaaactccatctcaaaaagtaaagaaagttctgccttagcataaaccaagacaaaacccaccattcagtcctaccctggggaggctctcagacctgtctccatgtcagtggcaccacctccatccccagcctcgaacccagcgttagcaaagaaggaaccgcctatccactttcttgatatacataccttcccaaagaatccagaatagactatgcatgtcaatagcatgaaaattaaaaccttactttcaataaagagctcctccctctcccaaaagactatcacttcagattagaaaataacttatgcaaaaaccttatcaataacaatgcttgctccaaagaccttattcagtatgcagttcactgaaactttccacaaaactaatacgtccatttgctaatcatgaaaaataatcttcatattttcttaattaataatctcaccagcaactgcttaatcacctaatactatttgagactaatgttatcagatagatagcaacatgaaaatacaatgaaccaatgctccccaaaagaaaaccataggttaccatttctacactatttacccataagtccagtactgtacaccctaactgtaaatgtacaccaactcccttttcaaaacacaaattttaacatcggcgttttccttcaggagcccatttcacaatcttaagaaaaagcttccatgaagacaggctgggcacggtggctaaggccgctaatcccagcactttgggaggctgaggcgggaggatcgcttgagccccagagttcgagaccagcctggttaacaggatctcttttacaaagagatcccatctcttaaaaaaaaaaaaaaaaaaggcttccatgaagatgaattaagcaaacaaaagctgatactgcttctgcatgctaaccatgtaatttaacggacacaagaaatgttaaaatatcatttgaatcaactatcgattcacaagaaaaaatatagcaggttcttaaaagtcaaaagcctcagccgacagccctgtggaattttcaacagatctccccactccccacccccaccccgcttccagccgaaaagccgatccaggcaagaggaagacacccagcctttgtgctatttcctgtcctctcccccaccttcgggccttcggaatatcgcaaaccgggccccgaaactcggcgcggcggcggccgccccacaaaggcagcggtgggagcgccatcttggcgcggccaccgggcccattcattcgcggggccgggccggggtccgcgcaaccctcgagtcgacacgcgcggggcgccagcgccggacagacccgggcctcggcaggagaagggcgaggccacagcgcgactgcctcagcggctcgacacagcgaaaagggccgaaaccgttattttcccatttcccgacgccgcgcccggcttccgctttaaatccctactccgaccgcggcgcgcggcccggcttccccatttcattgttccccttccccacgctcgcgccccgcggccgcccggccctcaaagtcaccccgataggcggcccgcgcgggggctccggccgccgacaccgccccgcctgcaggcccgcccggcctttgttctcgcgccgcgggcccgagagccacgtccggctccccacgcagggcccggccccgcccgacccgcgcccccggggccccggccgccgccacgggaagcgcccgcggcgcacacaaccccgcaccccggtgccgaaactcggcccccagccttgggcctgggaccccggctcctctccctagaccccgccctcgaccccgaccctgcaccccgaacctcggaccccagcccccggcccccccttcggacgccgcccgccgcacccgggcggggcaggaagacgcggccccgaccggcgggtggggtgggggcggggcgggcgcccccagggcgggcgggtggacgaacaggacccgggtccggggctgggggctgccgcgctcacctcagcgccctcgtcgcggcctgacgcgcccacaccgccgcctcggccgccgctcggcaggtcgtcgcgctcgggccgcgctgcgcgctccgcgggcgctgcgggcaggtgcgcgccggcgaggctcggtccagtcccgccgcggcggctgctccactcccggccccgctccccactcgccgcccgctcccgctcccgccgccgccgccgccgcctccgtccgcccctcagacgcctccagccatcgggatgggcgcggcgggcccct

SEQ ID NO: 670 - DNA, 50526 bp, Homo sapiens
tgagacagtattttactcttataggccaggctggagtgcaatggcgcgatctcagctcactgcaacctccgcctcccgggttcaagcaattctcttgcctcagccacccaagtagctgggattacaggcgcccgccaccacgcctggctaattttttgtatttttagtagaaatggggtttcaccatgttggccaggctggtctcaaactcttgacctcaagtgatcctcctgcctcggcctcccaaagttctgggattacaggcatgagccactgtgcctggatggtcaattgatttttgacacggacaacgaatggatcgaatgggatagcagagtccacttgtgccgtggaatacacaaacacgcaccaggggaaatgagcctcagccctgacttccaccacaagcaggagtgaatttgaggtggatcatacacctcaacacaaaagcgatgtcctatgtctttatgaccctggaggagaaaaaaattgcctaaaaatcataaaaaacaaattccaatagaaatgactggtaaatatgcaaagactggactgaagaactttgatttgagaaaagacgtcataaagggagaggaaggcccagccacagactcggaggcagcacctgcaacattcctcagggaggagggctggaatctgggtgcatgaagagctcctatgaatgaatgagaagaagacagacaatcccacagaagaacaagggatagccttaaacagagatgtcacaccaaagaagatacaacttgtaaatgggcccagggaaagacacgcaatctcactggtgatctgggaaaccaaaaagcaacatctcaacagcagaccgtggtgcaggccccccagacaagcagccccgggccgtgtgacctcgtgctcctgcggatgtgaagcaaggccctcaagcccagtgtggccccgtaggaccctctgtgaccaggcagagctgggcttctgggctgtccagtagggcagccgttgcccacaggtcgctatggagcatgtgaaatgtggcccttgtggaggaggacctgaattttcactattatttaatttggatcaatttaagtttaaatagccagatgtggcagtgacagccacgctggacagcacagtcttgtacactgttggtgggagtgtaaacttgcacaaccactttgaaaaagaactcggtgggctaggcgaggtggctcatgcctgtaatccagcaccttgggaggctgaggtgggcagacagcctgagttcaggagttccacaccagcctgggaaacatggcgaaaccctgtgtctacaaaaaaatacaaaaactagccaggtgcggtggtgcgtgcctgtagttccagctactcaggagctgaggcaggaggattgcttgagcccgggaggtcgaggctgcagtgagctgtgactgcaccactgcactccagcctaggcgacagagaccctgtctcaacataaaaagaactcactttggtattagctgatgccagtgaggctggctatgccctgtgatgcaggcatgagccccagccaggtgccctgtgggaactcacacacaggccaaggggcagtgcagaacggccttcgcaacagtgtgtaccacgaacgctcccaagtgtgcactggcagaaggacggatctagaacccgaggctctctcaggaaaggaaacgccacgcagtggtgaggacaggaagtgcggctcacaccggaagtgcggctcacaccggaagtgcggctcacaccggaagtgcggctcacacaggctgtggagaaccggcccagctccgcgctgagctgcagggcgtgcggaacgcgcaccacgcgaagacagacaggaggaggacggaggtttctggatctcgatgcgtatgtgggaaaacgatcaagagaagcaaggaggagacgcaagcgattcccgatggcggcgggctgcagggcaggaggcatggggagggcagggcccgcccgtttctcggcacctctccccgctggtgcgcgtctaacaacagccacagctgcagagctagacagaagccccccgcagcccggcccctccagggggcaccgcagagcctcttccccgccctgtgcggctccgcccgtgctgggcctgctgggccaatgctggaggtgccttcaagtcttcggttagcgtcaacgtgaatgtacattttcgtccactccaaaaacaacacttagtggcacataagaatattttcttgcttaaccgtcacttaacatcgaaggcctaggaaaattctctactttccagccctcccctgggcccctcagccccctggaatgctgccctgaggccctcaccgcccgcccaccctggcttggcctggcagcctggctcacctgcgggctgctcctcctcctgctccttgtccagcttctccagctccttccggctctgcatgtccgcctgggaggactccgtgccctctagctgctgctcagagaagctggtggcggctttgtcatacaagcttttatcttcgtaggtcaggagactgctctagagaggagaatcaacatcctggcttgggaggtttcccacctccttttcccagtcagctgccggaactcccatgaggacaggccgtgttgggggctggaccctggctccagcgtggcccctcagctgcctcctcggctgcctgctctcgtctcacccatcctggttgtgggatcacagcagcagctcacccagagactcagagtcacccctcagcctccctcactccaggccgggtgggcatggctgtgctgccccagcctgggagtgtgagccacatcttcctcttggtccaaccctccttcctccttggctggctagaggctgaggcttctctccacctgagccttgggacacccatacccgtgacaggacaagacgcgctcacacttggaacaggtgcagctgtggccatggagtgcacctgtccagtcctcccacccccacacctggggcttcagagatgcgtcgggggaggctgggtctcctggggccctcgggcctggagctgctggccagcacccctgctgctacgtgcctgagaaagggagtgtcctgctgctgctgcccctgaggccaggtgactgcaggtgtcctacagaagaagctggtctcttctgcttaggctgatttgaggaggcccccacactgccctccttctcccaggcccactgttgataccctcatgttgtcacctctgttcacccacatgggactggatttggggggcaggtccccacactcccccatggctgagtggcacactcactaatttcagggcagactgggagtcgtccatctcacagggctctgaagctggcaggaacttgaaagtcgtgcccaagcccccaacgttggtcagcgtgatggtccgagacgtggtctctcctaccacgtagctgccgaagtcaatgagctccttgtcgagggacagctgccagaggacatggagtgaactcagggccaccgtgccaggcccacagggtgcccagcgtgaggcctgcacgtggctccaggcagggctgccctgagcatttgtgcgcgttgtgcactgcacaagcaggtacacgattcaacccagaaatcaggtgtgtattgctcatgacaaggtgtggcacgcgagtctggttttaagaacatcaaggcaggagccccctcgccacggagtaacaagggttcagtgagaggacgcagggcccggatgcagggcctaaacaaggagcctggacacggggctttggaggtcctgaggatggatggtgtcattcctgggtgaggtcagctggactctggatacagggacccagggagcatccttccagaacgggagcacgccctccatgggggtgcctcaccatgcccgctgtgggccacaggccacagaagctctggtgctggctaaggatgcaggcccgggccatacctcggctctgcccaatggcccctcctcgggaggcttttctgggctctgagtttggaggcccaggggctccccactctgtgctcctgctccaggggcaggaccaggggccaccgacgcaaatggacgtggttcgcagagggcggtcggggtccagccaagggaggccgcctccttcccgcctgcaccgcctgggtcctgttctccccttgttcagatggggttttactgtttttacagtccccagcctggacgctcccctgggagaagcaagcccctgctcaggggagccgagggtctcggtgctcctgtcacagaggagcacttgacactgcaaagaccaaatgcgggagaggccggggcagctctggccaggacacctggggcctcgccgggcacgtgctccatgatgctgatccggagtggagcaggccagtaccagactcctgccgggctcccaggctgagcaggagggagccggagcctggctgtctgcgggggggcgggggacttcctgctgcccctggccctggtgctcggtgtcctgggcctgagtcttggctcaccaagagcccgcacagccgagtgccggcccaaccgtgaccgctctgaggagaaggcggcagccacagggcaaggagctgctcgggtgccctaggacggcagtggtccctgcatgaacccaagcggggccacttgagtgccaagaggaagggagactaaagtgactggaacacaccaaatactcaaacactggtgagcctatgaagaaactgagaggaaaacacttctctctctgccaccatcggtgactctcatcccaacccctctccacggcgacacgcggtgaaggaggaagcacgcgacagagaaagttacacaggtgctcatcaaaggtggcttggggccagcgtggcctggatcacgggtgaccatgagggcgtctgctgatcttcctggggtgggggacatagcgcgcctctgcccttcgcctgccccggcttgttcctcctctagtgtaagaatgggcctcttcctgccccgctgacgcaggctcaggctgtgagacttgccttgacctgagaattcttaggagataatgacgtccccactgtcctctgggagatgctcgtgctgccgtagctgccactctggagtccagcctggacggggctggccgcagagggcttcacactcgcggctgagccaggagccgtttgctgtgtggcaggtgcggtgcgagctgaccaattactcggcgggggccggggggacaatgatgtgtgggttcctggtttactggagatgcatgctgaagtttctgagggtggagtgttgacattttactaatgtactttgaaatggatcagcaacaacagatatagcagttgatggaccaagcaaaggtgtccgaggccgacaatgtggagtctgggaggatgcggggtccgggttgcagcgcgtggagccttgttctgctgttctgttttcctctatgcttgaaatttttcttagttaaaaagaatcaggcgggatccccccaagagctgcagatgaatgttaagttttcctgagccacaggccctgcagtctgggctccacacagagcagggtttgtctcatttttccagcactggtccgagtgccccacgttcgagaccccacctaaggttcggctcaggcccacctgagctgctgttggaagaaggggctcagcccctggtgaagattggagcttccacctggtccccccgccaacctgcaccccctcccaggagatgccgtcccccactggggttcccagccagcatgccccgagaaatgctggctcggacacctttgaactcaccgaacatttctttgttgaacatttcagtggaactgaaaactcgcccgtctgagccaaaaatgagatatttccttctagatccttgtttatctaaaacataaaacaacccccaccacaatacacttctgcaacttttgtgtgttttgttttttttttggacagggtctggctctgttggccaggctggggtgcagtggcacctgctcgattcactgcaacccccctccacccacccccacctggggtccaagcgatcctcccacctcagcctctccactagctgggattacaggcatgcgccaccatatctggctaattgtattttttgtagagacggggtctcgccatgttgcccaggctggtcttgaacttctgggctcaagcgaccctcctgccttggcctcccaaagtgctgggattacaggcataagccaccacacccctccctcctgtaactttagcctgttacatgtgccgtggctacctgggccagggccgcctgccacctgcccagctcgggtgaccccaggggaaagagtcagtagagggcatctcaggagggctggacactagcttcctggaacatcccagccctcccgacttagacccgagagtgcacgccctcggccactaacccagaggagctgcgccgcggttctgcccagcattcaggaatatgttgagtgtatttttggaagtaaaatagcaaaacaggggcctgcgtgatcctcactgagaggccaagtgcatccttcccccatcatgttctgcgccaccatgcccgatcacaggctccacccaccaccacctccccttcgagagagaacgggcccctctgactcaccatcggcttgaaggtgacaagcacttcacaggacattccggctgacagggggccaggggggtcaaagctgcaggacgtgacccatagcacacgggggttagtgctgcggagggcagacgctcgcctcaccacccagagcacagtcaggctgggcctcctggcctcctccccatcccgggcctggccccctgcccagccgccttcaccccggggagtgctggatctgctgcattccctgctgccgccagtacctggcaggcagggggcgctccagtgtgtgcgaacgtttgtggagtgagggagttaatcactgaaggcgtgaggcaagtccccaggccaactgccaggaaatgggaccccatgggtcggagagggccacagttcccctgggcacaggtgccaggcctgggaccggggctctagggctttgataccaatatgggaccagggggctgtgggcaggagccaggaagagagctggaactgggagtcctgagacagctgggaccctcgggaccctctcagcccctttcagggaaagaaccacaaaaatagcccctactgcacaggccacttgagggagctggtctgtcttggcccagatcagggtgagggagcatctccccaaggaattcctgacgccaggctgatttcacaaggttggattttacctaatgtgcttggtttagaaatgcacaagctaaaattttaatgtaaaatgtgtccctggctggcaacattcccacggcaccagcagaagcaaacccaaagctcctccaattgggagggaaatgctttggtgccgactgcacagagcccgggatggagctgccggggagaggagcagaatccgagagggtggacgtgcgtgcctcacataaaccagcagcagagtgcagggccgagctccaaacccttcagatgacagaagcgtggagtggggatgttagaggacgtatagataaaatggttagagacagaaatagagaattccagacgtgagaaaagaacaagacactgtcaagaaatgcagactcatccaaaacagaacttggcatttttagaaatgagagacagggcagctgagtaagaaacttactgagcaatttcaaccgttgattagcagcactaaggggacaagtggtgaaccgagcagcacctagagcaccacccaatgcgaaaaagagacaagaaatttccaacccgacggggaggtttcaaaaggaggagcaggagggcagagccggagaatgaatgggggaggggcgatgcctggggagctggggctgagaagttcccaaaattgttcaaagatctgaatcttcagattcaacagcacagtgaggtctaagaaaaatcagcccacaccagacgcacagcagagctgcgggacattaaggatgagagaatctcagagcaagcaggcggaaagccaggtatcctccaaaaaaaccagcacctggaccgaggccacctcccactccagcaacaagaggcagagggcaggagagtggtggcctcaacctgttgagagaaaataaccgtccatgagaagttctcatcccagcgtggggaggaatgcctcggtggctgagagcacagcgaccacctaaacccacctctgcacgcgccctccagaaaccacatggatcaatgagagaaacaggcgggctgcagaaatcccatgccttcagcatgactagaggacacagaaccctccagacttaaaattaaccataaggtgaaaagtaaacaccaacctccagcatgcattctccatgcccgccttcacagagagctacgaaggtctgaaaaactgcagggaagagaggaaggagacgggaacaaagaccctaagactgacctaaaatcagctccccaaagagaacatcacagcctccacaagaaaataccaagtcccagtgagtcagtgctgatctcagggaggggccatcagagcccacgcgcccctgggggcagcctcaggaagatgcctcgtgggagaagaggaggcccctctggagcctgggcagcaaggggggaatgaggatcctgcccttgctgaccctcttttgagaagctgcacttcacaacgctcgcgggagtggaaactcctgaactgggaatccgaaagccatcctggacctacaaacctgtccacaaagagaaaactggcaggaagcaggaagtagaagagaaagaactttcttaaaaataaagtaagttaggctgggtgctgtggctcacgcctgtaatcctagcattttgggaggccgaggtgggcctcggatcacctgaggtcaggagttcatgaccagcctggccaacatggtgaaaccccgtctctactaaaatacaaaaaattaaccggacgtggtggcaggcgcctgttatccgagctactcaggaggctgaggcagaagaatcgcttgaacccaggaggcagaggttgcagggagccgagattgtgccactatactccagcctgggcaacaagagtgaaactccatctcaaaaaaaaaaaaaaaaaagtaagttactaaggagcagaagaaaagagaaacattgcagaaaacatggaaaaggccgtcagagggaaaaatgaagaaaaataaaataaaagagaaaagaagaaaatgggccaggcacaggggctcacacctgtaatcccagcacttggggaggctgaggcaggtggatcacttgagctcaggagtttgagaccagcctgggaaacacagtgaaaccctgtctctacaaaaaatagaaaaattagccgggcttggtggcacacagctgtggtcccagttactcaggaggctgattgaggcaggaggattgctggagcctgggaaattgaggctgcagtgaactgagatcgtgccactgcactccagtctgggtgacagagcaagaccctgtcaaaaacaaaacaaagaaaaggaaagcagaaagcattaaaggcaaccagaaggaaaacatcagacaccaaagaccagcaaggaggatccaaaacacaggtaagtggagtctgcaaggaagcaaatggaaacattgttacagagtgaaagcacggccttaattcagggaggcagtgctgaaatgaagacagctttcaccttgacactgaaaacactggctaattgccagggaaaacttatcagaatggtcaacatcaaaacataacaatacaaaaggaaactctgacaaggtgtggtggctcatgcctgtaataccagtactttgggaagccaaggcaggtggaccgcctgaggtcaggagttcgagaccagcctgggcaacatggtaaaacccggtctctactaaaaatataaaaattagccaggcgtagtggcaggtgcctgtaatcccagctactggggaggctgaggcaggagaatctcttgaatccaggaggtagaggttgcagtgagctgagaccgcgccatcgcacttgcactccagcctgggcgacagagcaagactccatctcaaaaaaaaaaaaaaaaaaaaaaaaaaaggcagcaaaacaaaacgaagaaaaacaaaaggaaacttgggcagccaggcaaagttccagccattcgtgaagggaaatgggctcggtctcggacgactttgacacaagaagacagaggagccccctctacaaaatcttcgtgaaaatcggacctgagggcttatgcccatatagagcctgttccagccgttctgaacatgaagggacctatgaacctcctgctgtccctgcaccgcgtccctccctgtctgagccgtcctcttactcaacgtggatgaagtcccggaggtgctcctccacgcccaccagcttgcagtagttgatcgtgtaggtggtgtttaccaacgtgatctttttcttgtacactttgccaatatcaaagtcctgggaaaggccgaggtagcagcttcagagcgggtcacagggggctgtgctgtgagcaccgaggcagctttgcctcaaggtaaccgctggtgagcatttgccaactagggagaggttcccagggaacaatttccaaggtttctcccagaatcgagaaggcccctggggtgcatgaaggacaggtctgggggtggaacctgtcacataagagccttcgccacttgaggcaggacagggccttgctggggcccgcaggtgggagtaagagaaaaggctcagacactgtgggttccaaggtgggtccctgactccatggatggacttgagctggggtcaaatacaggagcccacagcctgctctgtcttgcagagtttggcagaggcgtccaggcaccaacctcagcctcacatgttcccaccctgtccctgctacatccctgtcccgaggttcaggggacccccactgccccaagtggcacagggctttcggggccacggcacccccattgctcagactggcgtccagccctccatggggatggggccctctccctccacctcctggaagagaaggtccacacttgggcctgtgcctcctgaggaagcccccgggttttccagcgttaaaaagcgaaaggcaggccaggcgcagtggctcatgcctgcaatcccagcactttgggaggctgaggcgggcagatcgcctgaggtcaggagttcgagaccagcctggcctacatggtgaaaccccgtctctactaaaaatacaaaaattagccaggcgtggtggcaggcgcctgtaatccctgctactcgggaggctgaggcaggagaatcgcttgaacccaggaggcggaggttgcagtgacctgagattatgccgttgcactccagcctgggcgacagagtgagactccatctcaaaaaaaagcaaaaggtgtcaggggttgggctgcggcagggctcccctgctgtcctgtgctgctgcccgtcccgttcctggcccagctgcgggctcacctggaagtggaggagctccggtttgctgttgaaggggcgtccttggaactcacgcccccacaccacctgcttgtggaccaccctgctccgcagccgctccaccgtgcgctccaggatgtccttgtccatctttgtcccgcccacgggctttcggtccacgtcctccttgggcacctgggggtcacagagacagaggctggggctgttagcggctccacctgggcggcgccggtggcagctcggaggcgagggtagcggttagcagagcacggacagcccagccccaccggctgccaccagcgctggagctgggaagagccccatggcccggggagttgctctgagttgctcagaaaggccctggggaccgactgactttctgctccattgacaaggcagggacccctcacttccaaaaaagaggaaaccaggaaacaagagcagacagctccagattcaggtggatttctgggaaatgatgtggagggggaactttccagattgttaaatcaggacaagaggaaggttttgaaaggttctgcaggaagcagttttctcgagcgggcagtgtcagcacacactgggctttctcagatgaaaagccgcttccctggccaacaccagcaaccaggaagatcagaactggagtcctgaactgtcccttcagaagctgcttggactctgcgtgggtcctggctctgggctgtgggctgtccctgctggtgcccatgcccggcagccgggcagcctcctccctggcttcccggggtggggggggcacttggcaccctcctcttgtccagaggcagccttctcccttgggtgtccccagtgggcaggtggtggctctgcctggcctgtcttgttcaccaccctggtcagcccggcatccccagaaccagcagaaccaggtggcttttgccctgacagtagaggtggccaatgcttacagaaaccgggcggcgggcattgccctcccacgtgggacagggccacagcctgagccacactgctgcagagaccgtgtcttgctgtaactgctctttcagaggcagaaggaccccagcgccagatggggcatgtttcttacaaaaggccgtcaaagaaagtttgcacgcttcttctagaaagatgcttctccaatagtacacggagtagctcagagtcattccctcagcctttcagctttggagccccaccgtccctccccgttacaccatggtgaccgagctgtctgtcagggggagcttggggtcgtcgagcacgcgtggtgccctccaggctccgcgaagagggaaaggcatgagtgtggagagggaggcggggggcgtccacacacaggagagggtggcgggagatggcaggcacagccaggagaagcctcagagcagctggtgtggccggggcaggcgtgggaggtggcgagccggcgacagagggccggggtccgtctgcaagcgtctaaaggagcaggagctgatacctggtatggcttgtagtcttcattccaaagcccagagatctcgggctcagctaacgtttcctcctctgagctggccccggggtccccctggataagctcactggaaacgacttccagcaaccgagagggcccggggcctgcagcagcctcgtagtcctgcagtcggggagaggaacatcgcaaagacacgctcatgacagagaacagggaagagaaactcggcccagcccccgccggtatggcccgctgcctgcccccgttcttctgcctcacgtactctgcatggagatagcggtgcacacggttttgtaactttttctacttgaaatataagtattttaatacattattaaatatttttctacaatgctcagaagagtctgcaaaatatttcctttgataggaaaatgttctaattcacggactggcatccttggcgccgatcctcaggcactcatctgttctcatttttttttttttttttgagacgcagtcttgcactgtcacctgggctagagtgtagcagcgcgatctcagctcactgcaacttctatctcccgggttcacatgattctcctgcctcagcctcccgagtagctgggattgcaggcgcccgccaccacacccagctaattttttgtatttttagtagagatggggtttcactatgttggccaggctggtctcgaactcttgatctcatgatccactcaccctagcctcccaaagtactgggattacaggtgtgagccaccgcgcctggcgcagttctcatttctgtggatataagccatgcccgggaaaagccccaggctgaccccaggaggatggctgtggtggtttcctcagaatgagtttggggacggagccttgcctatctgctctggctctgtcccaggcctgctggagaagggggaactgggccgggtagacagggttcttcttcctggggaccgtcctatggagcgacagacaggaagtctggacggggccagcgcattgctgttactgtgacctgtatagtgccacaggtggtgccacagaaaatcgcagggagcagctcacgggtgggggtgggggcaggggaggcttctctggagcaaggaggcgcagcagggtgctcctggcggagggatcggcgggtgcaaaggccccggcgtgagacgggcagtgaggggtggatggggcaaaggctcagcccaggcactgggagcctgggtagcaggaaaggaccttctctggtgccctgaagggcaccgcagagaccctgtggaggccaaagctgaggcagcccaaggctttctctttcccagcagggcatcggttgcagcagtgaccttgaccttcaggttttggggtacacaagggcagagactgcagcactgtgccagactcaggagaggaccatcgtccctaccccacacctttagggaaaggtaaactagaaatacattcccccaactgaagccagttgcctgcagcagcagtggacaccaagcaggccctggatgtgagtgagtgagtgaatgagtaagtgagtgaataagtgaatgtgtgagtgaatgaatgaatgagtgaatcagtgagtgagtgaatgagtgaatgagtaaagaatgaatgagtgaatgagtgagcgaatgagtgaatgaatgagtgaatgagtgaatgaataagtgtatcagtgagtgagtgaatgaatgagtgaatgagtaaagagtgaatgagtgaatgaatgagtgaatgaatgaagaatgagtgagtgaatgaatgaagaaagaatgagtgagtgaacgaataaaggatgagtgagtgaatgaatgagtgataggaaagctgtcctctaggtgctatcaggagtgctttgtagcagggtgatcccaggcatgtggtctgaacggctgtgcacatctccctggcaggcggctgacccagctctacagggccaggcaaggtggtcccagcctggtgggcagcaacactgctgggggtgacgcagggtctggtgggcacaccgagaccaggaggacactggacccttgctggggatgctgcggccatgggcctctctcatgtggtgggtccgtagtgtgtcttgtccccttgtccttgagctgagtggcggccactcagcgggctcagcaaccccctgcaggtggccatggtgctgaggtcctcagaggatgtctcaccacacctgagccctgaggccccacctgccctccacaggtgtgcggcttctgtctacaggaaggcgttttgctcaccagtgtgtacgtgttggttgggactgtggtcttcttgcaaaagtcagaaatgtagttccaggtcttgtccctcagggtcagccggtgcctggcactggtggggggatgctgtttcttcctcttttcctcctcagcctcctctttcagaatccgactgatgatctcctgctttctgagcttctgctcctcctcaaaggccctgcgtggagtcgcttctcagatgagtgcaagaggtcccctgcctccaccttgccccagatgagacagtgcccggcggcccctccctagcgccctcctgggggctccggtcctgcccagcagccccaggtgagacagcgcctggcggcccctccctagctccctcctggggactccatcctacccagcagggctcttggggtgggaacttcctggtcctggagctaaacgcaagctccagtgggaagcagatgggcagaggccaagccagaggttccaggcttaaaccccagccctgccctgcccagtccatccctgccaagcccagtcctgctcagtcctgcccagccctgcccagccctgcccagcccagcctagccctgcccagccctgccctgcccaacccagccctgcccagccctgcccaacccagccctgccctgccctgcccagcccaggccttcccagcccagccctgcactgcccagccctgccttgcccagccctgccctgcccagcccagcccagaccttcccagtccagccctgccaagcccagccttgcccagcttagccctgccctgcccagcccagcccatcccttccaagtccagtcctgcccagccctgcccagcccagccctgcccggcccagccctgcccacttcgcagcccagtcccccagcagccttggctgcccggagggcttcttccaagcccttatttctaggctggcgtggggctgccactgagagtagcaccagggctaaagatgttcatccactcactgcagctgcacttcccgggtgcctcctacatgccaggcctgcgccaggctaagggatgtataggcggtggagctgctgccaggacccccccgcccaggtgggcaggctgatgggtggtggagaactctgatcgtgactcaggggggtggggaggacgcactcagggctctgtggcacccagaggaggatgccttgcccagtgagagggccaggagcccccgcccaggcagatcctaagcagtgattggccagggccgtggacagggagactgggatggggagaaagggccaggctcccgggatgagggcagcttcgggcaaaacccaggacagggtggtttgcgtggaggtcactggggagcgttacgggcagggctgggaaaggcgagactgagcgggagagaggggccttgtaggaacctggccccgaggtctggatctcaggaagcccagtggggcccgtgggtggggggtccgagagggcaacatgggcccccgtttggagaagaacagagagtgaagccagaagcaacgtgttcaccacggacccaagctggcaggaggtggtctgaggggccaggagggccccaaggccgtggcagcaggaagccaggtggacggccctggacagggagtgagcaagggcaggcccagcagcaccaggttccctggaggggcctggtgctccctggagacttctgggtgggccaggaaagagcccgccagtccctccttgtgagaagtcaggacaggagccggaggctctcgacaggggccggggtttcagcgtctgggaggggagaaggggccgagggttgggcgtggactggagtaggggcagggctgggcaggctgagtcaggcccaggcagggcaagggtagcagcctggagcccctgttcccgtgccccacagccgcctgagtgggcgccctgggagagagagcagctttgctcaatgtgaagccgaacccccttggctctccctgcacccactgactgggcgggtgcctcccggtggcacctctgccaccaccctcacctcttctgggcctccagctcctggcgccggcgctggtggacaaggtgcctgaatgcatccctgccctgggccagaatcgccttcttctcagcctggaccctctgctccgccagctctgccttggcacggtcccatgcttggaacttccgcagtgtgtccttggaaacagagagcactgagatgacagcagcagcacccacgggcacatgcacacgctcacacctgcacatgtgcacacacaggttcatacatgcacacgtgcacacacgtgcacacacacatgcacacctgcacatgcacacatcacacatgcacacctgcacacacgtgcacacacacacgcacacctgcacatgcacacatcacacatgcacacctgcacacacgtgcacacacatgctcacacacgcacacctgcacacactcatacatgcacacctgcacacgtgtgcacacacatgctcacacgtgcacacacatgctcgcacatgcacacctggacacacatgcacacctgcacacacgtgcacagacgtgcttacatgcacacctgcacacatacgcgtgcacgcctgcacacacatgcacacactcacgcatgcacacacatgcaaacctgcacacacgtgcacatacacgctcacacatgcacacctgcagacacttgcacacctgcacacacgtgcacacacatgcacacctgcacacacacggtcacacatgcacacacgtgcacacacggtcacacatgcacacatgcacacacacatgcaaacgtgcacacacacatgctcacacactgggccgttgaacagatgtccttaaaccaatgttgacgcctgcagatcctgtgagagaccactggcaaactgtccgcacatcccaagcgtggggctgggtgtccctgcacgtcacctgcccgcctctgctcctcacctctgagcctttgcagatgctgttcccactcttccctccattttcccagcctgaatccccagccttggccccagggcatggcctcgaggcacccaggccctccatgtgtctcatgaggacgccactgcttccccaacaagaccaggccccatgggagcagggctggggtgcctgctcctgcctgactccagtgcctggccctgacccacacggaacccgtgggcaaatctgtggcacaggctcgggaagcctccaggggtcaccaagtgcgcgggtcagccctggacgccagaggacacgggcctggctcccaaggagcaggggcccagggacggaccccggcagggcgccaagggagaggctgggtggggctgcgggggcctacccggttcgcggagatgctgcccttcagcgccaccaccgcatccatgcgtcgcctcatgtactcgtggcactccatctcctccttcttctcttgctctcggattctgaggaaggacatttaaacatttttgaggctctgtcgcccaggctggtgtgcagtggtgcgatcacagctctctgcagcctcgacctcccaggctcaagtgatcctcctgtctcagcctcccaaagcgctgggatcacaggcatgcaccaccacaaacggccacatttttaaccgaggaagtgacacagcgatgccgtgtggggtgttaattacaggagcctcggtgctatcatttccaccaggaatgtgattaatggtgagaacacaagaggtgggatgggcaaaaggtgctggcgcagaggccgggccatgacgacatggtgggaacatgccctggagggccaggccacgaggacatggcgggaacacgcccagcgcatctcaagggcctcttctgaaaagaaacagtacctcagcactaaaaatacacacttattggtttttgatgataaggtggtgattcaataataaaatcaggaggctgggtgcagtggctcacgcctgtaatcccggcactttgggaggctgaggcgggcagatcacctgaggtcaggagttcaagaccagcctggtcaacatggtgaaaccccatctctactaaaaatacaaaaattagccgggcatggtggcgcgtgcctgtaatcccagctactcaggaggctcaggcaggagaatcgcttgaacccgggaggcggagcagtgagccgagatcgcgccacggcaccccagcctgggcgacagagcaaggctccatcttaaataaataaataataaaatcagggcatttcaagacaaaagcaagtgacccgtattcttgggtttctccttaaggacgtcgaagggaggccctaccttcccagggaggccttcaggaaccgcacggcaaccttgtggttcttccgggcgtcctccagcagcttctggtgcctgagcccgagctccttctgggtgttcagggacttcctgtggggatatggggccgtcagagggaaactcggcatcacacgtcccatctgcccccaagccctgcacggctggagctcgtgtcccagagacgccgtgggccctttcgctcagctctgtcccgcacagcctcccttggggaggagcgagggtccctggagagctgatgccgtgggccacacagatgtcaaactctccacgctactggggctccagtgccagggagccaccaaaggcaaggtttgatcccagctgggcaggggtctgggaagaggacggtgcaggcacagcagtgctgtggggagggaggaggcaggggctggggaccttgtgtctgcagccagggcctggattccacaggggtttgtggcctgggcagctgaagggaaggaatgagatgggggaggggatggaggccagaagggggtcccgaggagagaggctcacggcaggttgggacagctggcctgatggcctgtggagcacttggggactggcctagtaggtggccgggccctggctgagcaggagactcatgacagaagacgtgtggggaatgggcctgagtgctccacagccacgcaggtgggggccgtgggaggggtgcaaaggagcagccagaggtggggatggagcccagagaatggcctggctgggaagaggaaggggctgccggagggaaaggggaggggcagtcttgctggagcgtggctttagtagccagctttagcggctgtatggtggctgcggcatcttgggagggctggggctctgggcaggtgcaggggagtgcctgacacttgggaaggactcaagggcccggtggaggagcaagctgggaggaggcagggaggggtggaggtggatctggacagatgtggagggcgaggctgaatctggagacccctgggggagagggcggaggggctggcagaagctgctgggaagggatggaggtgggcctgggtgtcgcctacctgatcctcagcagtcggttccgctccaccttccccagggcctcctgctctctgcagagctgctcggctgcgcgcacctggagccgccgccccgtggcctccacctcctcacggtcagctgtccggaaggcctcgagtcgcccctcctggatctcgatgtgccacatggtgttccttcaaacaagaggcaaagcagctggagacgggccccacagtcatcctggggtgggggtttcggcattgagttctgacaaatcctccaggcagatgttgaacaccccagatgggttagctccctcctctaggggccatctccgctctgagtcacccagacactgaggcccgccctgcctgcctccaacctcaggaaaatcactatgggttcaatccagcccggctagagcctggcctgcactcccgcgtgccacctgccggcctgaggctgtgtccgttggctgcggtgggcctggggcaggccctgcccagcctgaggaaggccttcaggaagggacagccgtgactctttggctgggctggaggatccctggtgcaaattgaccggcacccaagaccacccctcagtcttcaaatgtgcctggggtgggggctatggagcgtggagtcagccagccctgcccggggccacatgtcctggatgacaggggacctgcctgacccctggtcttgggcgaatttgtcctcgactgtgagtgtggcgtctgtggtggccccagatgacacagtgccccttggttcttggcacaactcagggaaatttccggtgaatctttagttggaggagtgcgtgtgctgtggaggctcaggctgggaaagttccttctgaggatgtggacagtgtccttctaacagcggccaggtgagagccgctggagaggcggcctggaaagagacacctggtggagggatgcaaggagccgctcctggagactgcgaacggttccacccagagatgcggctcaggccggggctggccacgcgaggatcagaaccctggacaaggtcagacgcaggcgttgagccggcatcctcactgcattgctgacattccacgtgacgtgtgccacagctctgtcctagacacccgcgatcatgttcatttccacttcgtctttcgttaaaagcttttcctgtggagccgagtccagtctctctccccactgcaacacccggggcaggggtcccaccgccttggccctccgtgaataaagtctgctttacatctttttgaaaaaatcatgaacatatgttgaattgagatactcaatggttttctcttttaacgtgttaatgtcaaggatttctaacgttgagcctttttcggggctcctaggatataaactccaacttggcaagggaggtgtgtctgcgtgtctcacacgtggctggatttcaatgttgaatgtttgatttggggttttctgatttgcctcctgagatcgggttctactttccctctctcgtacgcccacttggttttggcatcgaggttgtgtcactgcattttagaaactgggcataccatgttctttgttggggtaattttaaacagagggctcctttccagggagcatgggtcacttcggatctctggctggtgtcctgtcatgcagcacgttcattgctccccaagtctgggggactccgcggagcttccacgggcgggttatttctattcctccctcgcgtgactcatgaaattctttaatctgaggattcatgctcccatcaattctggaaaacgctcagtcattgttctgctggctgtcacttcccctgcccggtgatcagtgctccagtggccgtgggagctaacagcctgcagggtctcttagtaaagaggcaagacgctgtcccagatgctgtcgtcgcccattcctgctgctgtaggaaaacacccacgaccgggtcttcgcaaacaacagaatttcattcctcagttctggaggccgggaagtccaaggtcaaggtgccagcagcttcgatggcctatgaaagcctgttcctcaaaggcagtgcctgtctgtgtcctcacgtggcagagggacagaaaggctccctcaagcccttttacgaggcactaatcgcccccacgagggcagggcccccatggccgaatctcccagagaccccacctcttcctgccgtcacctccagggcggatttggtttggacgcgtgtcccccgcaggtctcgtgttgaaccggagcccccagtgttggaggtgggcctggtgggaggtgttggggtcgtggggcggctccctcatgaacgggtgggccgtctccttggtgacgagtgagttcacggaagatctggatctttgaaaatgtgtggcacctccaccctcttgcttcccctctcaccatgggagacacggctccttccccttccactgtgattggaggcttccagaggcttcccgaggcgccccgagaagcagatgccatcacgttccctgtacagcctgcagaaccctgaccaatcaaacctcttttcttcttatttttatttcttttaaaatgagtcttgctctctccgccagtctggagtgcagcggcatgatttcagctcactgcaaactccacctcccgggttcaagcaattctcccgcctcagcctcttgaatagctgggattacaggcatgcaccaccacgcccagctagtttttgtatttttagtagagacggggtttcaccatgttggccgggctggtctcaaactcctgacctcaggtgatctgcccaccttggcctcccaaagtgctgggattacaggtgtgagtcactgtgtctggcccaaacctcttttcttttttttttgagacagtctcgctctgttgcccaggctggagtacagtggtgcggtctcagctcactgcaagctccgcctcccgagttcacgccattctcctgcctcagcttcctgagtagctgggactacaggtgcctgccaccatgcccggctaattttttgtattttttttagtagagacggggtttcaccgtgttagccaggatggtctcaatctcctgacctcatgatccacccaccttggcttcccaaggtgctgggattacagatgtgagccacctcgcccagccacctcttttctttatatgacccagtgtcaggcatttctttatagtgacacaaagactgacgaacaatagcgttgagttccagcagaccaatttcaggggcactggccttcagaccacagcagaggctgattgggaaagattgggattttgagaatgggagggaggacatttgagggtatctgcacacatctgagcgagtgccccaaaccgccaagcccctctgcatatccgtccacagggaagcagccttcccctccctcgaaggcaggctctgctgcctgggggccccgtaacacctccctgaggggctgccagagctcctcatgacccccttgccatcctctctggcccagatgctcccaggggcaagaacaaagtctgaactgaactgagaggagaaggatcccagaggagaagaatgtagccaatctacacagcaggacgtgggggaaggtgtgtgggaatgaattccaaccctgccagaccgcagagggaagagcctgtccgaggctggcctgggcatctgatgtggacatgccaccagctcacccacccactgcaggcggctcccatcacaaactcagctgatcgaggaaacctggacccaagagagacctacactgcagaaagctagatgccagaaagtcatgcagaaggaatccaaatgtttggagagacaacccgttggaaagtttgttgttgctgttgttgagatggtgtctcgctctgtggcccaggctggagtgcagtggcgcagtctcagctcactgcatccttgacctcctgggcttgcttaatcaatcctcccacctcagcctgtaatcttgagtagctgggattacaggtgcacgccaccacacccagctaagtttggtattttttgtacagatggggtttcaccatgttcccaggctgatctcaaactccggggctcaagcgatctgcccaccttggcctcccaaagtgttgggattacaggcgtgagccactgcatccagctgttggtgagtgtgacagtgagtgtgaccacatatagaagacatgttcttcattatggctccagtgaggagagtcctgtgccctttgaaagcaccgaggggcactccggactgcgcgggggcctggcagggatgttgcctttgaggggctccctgttgccttggggcgatgctggacctgggaggggtggtggagccctggggtgctgctaggcctgggagggagccgggctggttcctcggtgggcagcagggcagcgtgtctcagcggggatgggtggaaggggtttggggcggtggttaattgattttggggtccctagggctgaagtagatggggaccccactcaagtccagtttatctgaagagccagtgtggtcagtcgcagaggtgatgatgaaggttggaggctggacagatgggacctggctggttttgaagatggaggaggaacgcaggcagctttggagctggaaaaggcgaggacatggattctcctcggaggcttccgtggggaaccagccctgcccacaccttgactttagcccagtgggacccgtgttgggccaatgacctctagaactgcaagctcataaatccgcgtcctgctgagctgttaggtttgtggatttgtcactgcagcgatgggatacgggtgcagtcagggaagcctcagagcaggccgggacacagcaccagcgccctgccgtgggtcccatgtggccaagcggggtgcacacaaagcctcttcttcgtgctgagctgggcgtgggaaggcatcatgtgacgaggctgcacagaacacgtgtgtcgtgctgagctgggcgtgggaaggcgtcacgtgacgaggctgcacagaacacgtgtgtcgtgctgagctgggcgtgggaaggcgtcatgtgacgaggctgcacagaacatgcgtgtggtactgagctgggcgtgggaaggtgtcacgtgacaaggctgcacagaacatgtgtgtggtactgagctgggcgtgggaaggcatcatgtgacaaggctgcacagaacacgtgtgtcgtgctgagctgggcgtgggaaggcgtcatgtgacgaggctgcacagaacacgtgtgtcgtgctgagctgggcgtgggaaggcgtcatgtgacgaggctgcacagaacacgtgtgtcgtgctgagctgggcgtgggaaggcatcatgtgacaaggctgcacagaacatgcgtgtggtactgagctgggcgtgggaaggcgtcacgtgacaaggctgtgcagaacacgcgtgtggtactgagctgggcgtgggaaggcgtcacgtgatgaagctgcacagaacacgcgtgtggtactgagctgggcgtgggaaggcgtcacgtgacgaagctgcgcagaacacgcgtgtggtactgagctgggcgtgggaaggtgtcacgtgacgaggctgcgcagaacatgcgtgtggtactgagctgggtgtgggaaggcatcacgtgacgaggctgcgcagaacacgtgtgtcgtgctgagctgggcgtgggaaggtgtcgcgtgacgaggctgcgcagaacacgcatgtcatgctgagctgggtgtgggaaggcgtcacgtgacgaggctgtgcagaacacgcgtgtggtactgacctgggtgtgggaaggcgtcacatgacgaagctgcgcagaacacgcgtgtggtactgacctgggtgtgggaaggcgtcacatgacgaagctgcgcagaacacacgtgtcgtgctgagctgggcatgggaaggtgtcacgtgacgaggctgcgcagaacacgcgtgtgatcgctcacggcctgcctcccaccaccgaagcagcctccaccaggcagggctctgctgcttcattcatgggagaggcccaaaggcttcggacggcgtctggcacgcagtgggcaccctcttaccgcgtggggaggacgggtgaacgagagtgtatctaagccaccggcacagatcgcagtgggcgccctcttaccgcgtggggaggacgggtgaacgagagactgtatctaagccaccggcacagatcgcagtgggcgccctcttaccgcgtggggaggacgggtgaacgagagactgtatctaagccaccggcacagatcgcagtgggcgccctcttaccgcgtggggaggacgggtgaacgagagactgtatctaagccaccggcacagatcgcagtgggcgccctcttaccgcgtggggaggacgggtgaacgagagactgtatctaagccaccggcacagatcgcagtgggcgccctcttaccgtgtggggaggacgggtgaacgagagactgtatctaagccaccggcacagatcgcagtgggcgcctcacagcagcccccgggcacagggatgggacctgcgcaggcgctgaggaccgggaggtggtgtgagcgggcagggtcgtctctagggccttctttgggggttcctgggacctgctggccaggaaatgcccgtgagtccacagacgcttctgccagcccatggccccttgcgtgcagagatgctggtcctgggagagctgcgggtgagacacatgcagcatcccgtctccaagatgattccaaggaccctcggctgttcatgcctgaagcccctccacggggtctctctcgggctggcctgaacaccccaagcccaaccccctgcccagaccacgaccctcagaaaccgagaccctcagaaaccgagaccatcacgcctgctgccttaggcggctaagggctggggcggcctgttctgtggctgcggatgacgcgcatggtgtggcagcagggacacgtgctggggaaggttcaggtgctgtttccagaacgcggtttgggtcccgaagcagcggccagcctcgtggccgccacctgtcccagagccacaacggaggcctcccgggaccgacgctggaagcggggaccacgctctccaagctgcccctcgcacacacccgtgctatttcgtttctgtgctctctccgttgggctctaccgctggaagcccccgttccagagggaggaggccttgcagagaccctgcaacaatcccactgagtggaagctgaagctgcacccagccgtccagtgcccctgtgcccgcagtgcccagagacgacaaaaggagtcaccacattggccacggagaccttgactgcgagagggagggggcgctgcctccaacgggacccagcgggaaagcgcctggaacccggggaccctcgggggctggcacagccagccgcggacagacacgggggcacgcaggacacccagccgcggacagacacgggggcacgcaggacacccagccgcggtcacacgcgggggcacgcaggacacccaaccacggacagacatgggggcacgcaggacacacagccgcggacagacacggggggcacacaggacacccagccgtggacagacacggggacacgcaggacacacagccgcggacagacacgggggcacgcaggacacacagccgcggacagacacaggggcacgcaggacacccagccgcggacagacacgggggcacgcaggacacccagccgcggacagacacgggggcacgcaggacacccagccgcggtcacacgcgggggcacgcaggacacccagccgcggtcacacgcgggggcacgcaggacacccaaccgcggacagacacgggggcacgcaggacacccagccgcggacagacacgggggcacgcaggacacacagccgcggacagacacgggggcacgcaggacacacagccgcggacagacacgggggcacgcaggacacacagccgcggacagacacggggggcacgcaggacacccagccgtggacagacacggggacacgcaggacacccagccgtggtcacatgcggggacacgcaggacacccagccgtggtcacatgcggggacacgcaggacacccagccacggacagacacggtgacacacaggacacccagccacggacagacacggggacacacaggacacccagccacggacagacacggggacacgcaggacacccagccgtggtcacacgcggggacacgcaggacacccagccgtggtcacacgcggggacacgcaggacacccagccgtggtcacacgcggggacacgcaggacacccagccgtggtcacacgcggggacacgcaggacacccagccgtggtcacacgcggggacatgcaggagtcccagctgtggtcacacgcagggacatgcaggacaccccgccagggacagacacggggacacgcatatgcatgagccccatgcctcaggctgtgcccaggagctccatcggagcaccctgcaaacatctgctggagtgaagtcctagaaaatttaacactgggtggagagcagaccagaggttgcctggtggggtggggctacccactgaagatatgcagggaacgttccagatgctttgtactgcatgcaaattagacccagataaagctgacttaaaggaaagtccacgggcagtccggcagcagccgggcccacaggaggagggcggcaggtgggctccgggcgctcggggccgcctgcgggtagggatggggcaactacctgcccgaaatgagggtggtgggaggcagggttcacaccatcagagaagggggtgaaatagacctgtggctttggttgcaattggaattacagatgtgaacgggtggttttcaatacaggcaggcagagctgcgtgcgtttcccacctctgtctactgacggttaagggtctgggtccaggcaagggcagggaagaagaagggaacctgagcctctcactgtgcccgaaaacgcccacagagcggcagacacgaacgcaggatgcggaaggatgccaccgccaaacgcaaggcggctggagcacccagaccaatcctgatgggccggatcatacccgcagggacacagcacccccagcctacacggagagcgatcacggagggggaacgctcccctaacggtggaaagccaactaataggaagggatggtgcaactggaaactcaccccttagaagccatcacagcaggaatgaattctggcaagaaacacggagggatgccagcgctcgtgtgaaaggggacacggagcgggatttcccagcctcaaagcttctgcccacaagctacgcatcagtttccaagggaacggtgtcgctgcactgaagaagccagcggccccacagtggggctggcagccatcacgtgtcccatgagaggacacccgagggactggtcatcacccccaggggcatcgagcacgggcgctgtgcgggacagcccctggcctgcaatcctcagaaccgcaacgtccgcctgtcacagaagaaccgaggctccttctgactgggggaggcgaggggccaccctcgacacaacgccacatgggcttcaggcacggctctgggatgcggggccgaggggcacagggggtcttgctgccattctgcagctcttctgtaagttcggaattgtttcaaaataaaactttatttatttatttatttttgagacggagtctcgctctgtcgcccaggctggagtgcagtgacgcaatcttggctcactgcaagctccgcctcccgggctcacgccattctcctgcctcagccttccgagtagctgggactacaggcgcctgccagcacgcccggctaattttttgtatttttagtagagatgggggtttcaccgtgttagccaggatggtctcgatctcctgaccttgtgatccacccgcctcggcctcccaaagtgctgggatgacaggcgtgagccaccgcgcccagccattttttttttttttaaaagacagagtcttgctcactctgtcgcccaggctggagtgtggcagtggcgcaatcttggctcactgcaacctctacctctgggctccagcgattctcctgcctcagcctcccgagtagctgggattacaggcatgcaccaccacgcccagttaatttttgtatttttagtagagacagggtttcgctatgttgcctgggctggtcttgaactcctgacctcaggtgatccaccagcctgggcctcccaaagtgttgggattataggcatgagccactgggcccagcccaaaaactttttttttttttttttttaaagaagtggacaatcacatcaacctagtaaagtgaggccttctggggttcattagccctgtgaagcccctcaccctggcgcaggtgctgctgagcagtgagaggggcatgacagagccagttgtcaaaggagtgtcgcaggggacagtgttctccacgctcagccacagctgggttcagcgtcctgtcctcccctgcacccctcccactgcccacacaggtggggccacagtgcagggcactggacaccagcttgggtcgtgactgtatcacagcgagcgtgggtcagagactgggccagaaactacgtcacagcaagtgtgggtcagagactgggtcgtgactacatcacagtgagtgcaggtcagagactgggtcaaagctcagtggtgtcttcagtggagtgaggctgagatgttaggttgcatgagggctggcggcatgggcactcttaggggtggggtggcctgaggcctgcactcagccctctctgtgcctcctgccctgcccaggctggaaagcttaggtcatcccgggcacgtgcagggtcagtgctgtggatgtcatggacctggctgcagctcccggggctgggggctgtgtggttcgggagtcctacttgaggtcagctcagggtcccctcagtcgccctgagaaattcgtgcaccttcccaaaccccttcttgccaaactcgccgaaggcaactcgacgcatccaacccaactccacaggaaagcatttaggacgaggcagctgtctctctcctgggctttgaaaacccagctcgctgttctgtggaagcacaaagcatgagaaacgaggaaagaggaaaaagaacctgattttggagttcctaggaacataaacaaacccagagaaactgaaaaaggcaacgtgaagactaacccttccaaccactgcattcaccgagtcccctttccacttccccgcagtttgccggtcaggtgcaaaaccccccagatcttgctctctgcccccagatgggaaggactcgcaccgttctggggcctgcctgctgccagtcccggctgcacaccgactcactcgctctccttcagcacggcctcagtcctcgactgcaggtctctctcgttctccagctctgcaaacaggcgtctggacacggcctggaggcggcccacagcggccctgcagtggtgaacggacaggccgggcgtgtgtcaggcctcagtcatccaggggccatccaggttcacctggcactccctggcctcctctcgctcaggagggaaatctcggcactgggccacctagccaatggagcgtggggctggcgggaggctctccacatgcccctttccgctgggcaggcagtgcccacatggcacagccccagggggagtgagggcttggggagcctgccctggaccctcagtggcccctgcatgaagcccctgggggcagcagccatccaggcctgtgacccgggaaggacccagcacgtgcgacaagccccaagccctcgcgtcagggcgccctgggtcccctccctccctcctgttcccctcctgggcatcatccaccccagcacacatccagtgccagcccagccacgttcctagagaccacttcccgggcggtgggcggttgcccacgagagcggcacagtgtgatgctggccagaggtcccggccatgtggacacgggtggtgggctttgagcagctggccgggtatggcagtcacccctagatcctgggtgccacagtccaggaatgaggcaggtcaaaaccctgcagagggctgggtgcggtggctcacgcctgtaattccagcaatttgggaggccgaggcgggtggatcacaaggtcaggagttcaagaccagcctggccaagatggtgaaaccctgtctctactaaaaatacaaaaaaaaattagccaggtgtggtggcacatgcctgtaatcccagctactccggaggctgcagcagagaattgcttaaacctggaggggcagaggttgcagtggcccgaagcccctcaccccccagggccgggaggacctgctggttcccttgcccctggctgctggccctctgctccccatggctgcactagcccctccaggtcgggcaccctgctggggccttccagggctgggctgaactcggcaggccctgcaggcacctggtgcccccagagggtgaggcgaggccagagctgcagccgtggagccatccaggctcccggagcaatgcctgttggtgagtgttggcgtttccagcgtcccccaggcccctcccacctgggagtgtgggacgcatgcaggcctctcacctctcacctcgccctcagctgcctcaccctgctgctccaggcaagagtggcccaagaggccttcccctgactgctgacccactcggccttgcctcccagagatccagccccagtgccctccaggccccagcagtgccgacctcacatgcttctgcatgttcgtgttgtggcctcacactggggctcctcattggcctgaacacagcaggtgcttcacgcctcactttgggtgaaccagtgaacctccggccctgacctcatgcccggttccctgccccctggcgagggccacctacatgttgcccgcctcttcctctgtggcgatctcggctgccacagcctcctgctgcttgtcgatcaggtcccgcctctgccgacaggcgcgcagctcccctctggaacagggaaacaaaggtcagatgatggttccctgaaactccagcctccaaagtgacagtgggcgtggcaatggggccaggtgaggcagagccagacccccagagcccccctcacccgggccaggggtctctctaacaccttcaagccacacaagcagggtcttgtcgtccatttttggaaaactgcccaggggcagctgtgtggcccccacccgaaggtgacatgctccccagggccgaggacggtgcaggagcgggagggaacctgggtctgcataaacaagcgcactcctgcgtgtgaagggcacgtggtgggaggtctggggcccacgggaggggaggagctggagctcctccaccatcttccagagagcgggccaggcaggcccaggtcaccagtggggcatgggccgggacagaatccagttcacatggtagctcctgggggcgactcaggcctcaggtacaaacaacggagcaaagcccagagcatgaactctggaggtcgcttttttttttcccgagacagagcctcgcttgtcacccaggctggagtgcagtggcgcgatctcggctcactgcaacctccgccccccaggttcaagcgattctgctgtctcagcctcccaagtggctgggactacaggcgcccaccaccacgcacagctaatttttgtatttttagtagagacggggtttcaccatattggccaggctggtctcaaactcctgacctcgtgatccacccaccttggcctcccaaagtgctgggattacaggtgtgagccaccgcgcccggccatgacggtcacttggaaaacacacgggcgctgccggagccgaggagggaaatcgtagtttccccgggtgaagtacccaagttaggtgcccgagttatgggcaagaagttatgcagaagaacatttgtctttcagttttttatttttagagacagggtcttgctctgtcacccaggcttgctgcagccttgacctcctgggctcaagccatcctctggcctcagcctcccaagtcactgggaccacaggcgtgcgccaccactctccgctgaatgtttttagtttttaggagacgctgaaatatttaggagtgacgtatcatgtctgtgatttgctttaacataatttagcacaaaatcccatagatataaaatacaaacacacacaaacacagaaagaagctacaacgaaagcttgacaggtggcaactctgggtggcgctgggggcagcggggccacttgtttccgccttttctgtgggaagggggctgggagcgctgggcactagctcccgggtggggcttgcagaactgctcctccatggagaccctgtgcgaccctcccttgcaggccctcagggtgacgacaggtacaggaccacccctgctgcacccatgtcacggcctggggggcatcaagaggtgcaggtgcagcggcctcagccccagctcacctcatcttctcagtgaaaagctcttgctcctcatgcatcttatccagggcgctcaggttctgccgcaggtgaaatgcctgcgttctgtcctcagctgttttcttcttcaatttatcagcatcagtatctagttctttcactgagcttaggatgaaaaggacgtcagctgccaccaccccagctgcaggctcagaactcattcctcggtgtggctgccggggtaggtgcctgacagttctgcttcagggcgggagctgcgggagctacagcctgtgggagggaggaagcagccgccccgctcccttcacccacccccccacccccacccccacccccacccccccacacccacctccacccccgatcctccgagttacctgctgtgtcccgggtccacgtcatcctcagcttcctgtagaagacatttgatgtcaaactccggatcctctaattcatctctttctagaaatcaaggcaagagtttaaaaaaaaaaaaaagcagatcaaacatttgcatctgaagttttaggataaatctttttctttttttgggacagggtgtaaggaacctgctgcactgcagccacacaagcacaggcagaggtaaacagcctgggtgactcagtgggactggggcgctggcgccttgagagagagagagagagtcagggacatccgtctttgcagacggacagcggggagcaagggcacagcaccgcttggctggtgtccagagaaagagttaagctgctgaccctgaagtcaagggagagccggccacgcagctgtgtgtgtgggagccgccggactaaccagccaggacagggcggacggtgtgagacaaagccgttggggagagctgctgctgaataaaatcctttttcacctgcctacggcccccgagcgttccttctgctcatccacccactccctttggacctcaacatgacgttcggcgtagtcatgaacctgacgtggagtctctgttgcccaggctggagtgcggtggcgtgatcttggctctctgccaccttcgcctcccaggttcaagggatcctcccacctcagcctcccgagtagctgaggctacagatgtgtcctaccatgcccagctaatttttatatttttagtagagagagggtttccctatgatgaccaggctggtcttggactcctgacctcaagtgagccacccgtctcggcctccccaagtgctgggatgacaggcgtgggccaccacacccggcccgtgttaggataaatcttgacacgcactaacttggtggtaccacacccggccagtgttaggataaatcttgacaagtctaacttgatggttctcaaagcaaaatccgaggaaccctgagggtcccttagtgtccttcagggcctgtgaggtgaaaactgtcttcatgatcacactcgcacgccatttgtctcctcactctcttcccatgagaggacagtggcgttttccagaggctgcatgacaggtgacgtcacaacagacagctctaagactccagctgtcttccattaaacccaactcttaacgttactgccaataggttcgttattgctattttaagtggctacgtattaaaatgtttccagctttaatttttgatacagtaagtatggaaagatacaggcaacataaacaaatgttctctgtgtcttcaataatttttaagaatgtaaaggggttctcagacaaaagaggctgaaggtcactatctcagaagattacagcggacttccggcaaaacacggcaaagggaacacagtttttcttcccttcattaaatctcagtaaaaatgatggaaaaggcagaaagccacagtcacaaggggggcgggagagggagacagtggcggggggcaggggggagaaggccacacagcgccaggagctgactcagcacacaacagaacccaaaacggggtggggagtggggtgggggtgggaaggaaatgcgttcccagattgcgatggcctgcctgtgcccagaactagaaccaaatcaaggcacgtctcagtaacatttcagatcatcagagattttttaaaaacagcttccaggaaaagaaaacaaaaataggtcacattcaaaggattgggataaaaatggcatcagatttctcaatactgatgttggaaactagaaaactatggtctgccgccttcaacatctcagccacaatttatctttctttcaaataaagacaataatataagctccctctttgagagaaaaatatgagtgtaaaagataccctctcccagaaataaagggaattaaagggctactatgaagcatgtcatttgtttgtctttttgctgaaacttccgttactgtgaaagaagctttattaccatcttccaaaagaagggcatcggccaaaagctcgtcctcagggagcaggctgccgtcatcctccatgctgggagatagaaattagctgcaaaagatgatcgcaaaatatagatcaataaaatcatagatttaaaagacggtgaattaaccatttctcttaaagaaggcattaagaaaacaaacgacagattaggaaaaaatatttgcagcacacacatatctgacacaagtcttacatctggaacacatgaagagctcctatcaaccacatgaagtccaaactccagtttaaaaggtcaaagaggccgggcgcggtggctcatgcctgtaatcccagcactttgggaggccgaggcaggtggatcacctgaggtcaggagttccagaccagcctggccaacgtggtgaggctacagtgagctgtgatggcaccactgcactccagcctgggcaacagagtgagaccctgtcacaaaagaaaaaagaaactgcccaacagtatcctcgagtatcactttacactcccaccagcaaataccaaattaaaataatgaaatacaacattagctgggtgtggtggcgcatgcctataatcccagctactcaggaggctgaggcaggagaattgcttgaacccgggaggcagaggttgcagtgagccgagatagtgccactgcactccagcctggggacaagagcgagactccatctcaagaaaaaaatgtcaaaagatttggaattccataagaaaagagatatacaaatggccaatatgcatgtgaaactgtgtaacatcagtatctttaaggaaatatgaatcaagccataatgagatactattatatactgagtagaatgcctgagattggctgggcgtggtggctcacacctgtaatcccagcactttgggaggccaaggtgggcggatcacgaggtcaggagatcgagactatcctggctagcacagtgaaaccccatctctactaaaaaacagaaaaaattagccgggcatggtggcaggcgcctgcggtcccagctactcgggaggctgaggcaggagaatggtgtgaacccaggaggcggagcttgcagtgagccgagatcgcgccactgcactccagcctgggtgacagagcgagactccgtctcaaaaaaaaaaaaatgcctgagatcaaaacgctgccaacagtgagcactggcaaggctatggaagggctggcatcgtcacgcgttgctggtgggagtgtaaagggatactctggaacactgttgggcaatttctgttttcttttgtgacagggtctcactctgttgcccaggctggagtgcagtgacacaatcacagtttactacagcctcaaacttctgggctcaagcaatcttcccgcctcagcttcacaagtgctaagactacacgcacatgccgccatgcccaggtaattttcaaattattggttgagatggtgggtctctctttgttgcccaggctagtcttgaactcctggtctcagccaggattcacccacctcaacctcccaaagtgctgggattacaagcttgagccactacatctggcaccaaaaacaatttttttttttttggagatgaagtctcgctcagtctcccaggctggagtgcagtggcgggatcttggctcactgcaagctctgcctcctgggttcacgcccctctcctgtctcagcctcccgagtagctgggactacaggcgcccaccactacgcccagctaatttttttgtatttttattagagatggggtttcactgtgttagccaggatggtctcgatctcctgacctcgtgacccacctgtctcggcctcccaaagtgctgggattacaggcgtgagccaccacgcctggcccaaaaacaattcttaaataatttcaaaattatcattacactttgcttatcattttgggaatgttaggagcttgctcgtgtggaactcttggtaccgaatcttctgtgtccagatgttggaactaaataatttcacttaagaaacaggccgggcacagtggctcgcgcttataatcccagcactttgggaggccaaggtgggcagatcacttgaggtcaggaatttgagaccagcctggccagcatggtgaaaccccatctctactaaaaatacaaaaactagccaggtatggtggcaggcacctgtagtcccagctacttgggaggctgaggcccgagaattgcttgagcccaggaggcggaggttgcagtgagccgagatcacgccactgcattctagcctgggcgacaggggaagactgtctcaaaaaaaaaaaaaaaaaaaagaaacaatgttaaaatcacaaactctttacttatttttttctggtgagaattaaatttaatggctaactttcttttatttttttgagacagggtttgactctgtcacccaggctggagtgcagtggtgcgatcacagctcactgcagcctccaactcctgggctcaattgatcctcctgcttcagcctcccaaaggagctgggactacaggcacgcaccaccacacccaactgatttttgtattttctgtagagacagggttttgccatgttgcccaggctggtctcaaacttttgggatcaagtgatccacctgccttggccttcccaagtgttagaactagaggcgtgagccaccgtgcccggccggtggctgttttctattagaccttaaatatgtgattggttttaacgcctattaatcacattgtgcttgtaccatgattaatatacaaaacagctgatgtcaaatgcttataaatcagcagggcacagtggctcacgcctgcaatcccagcactttgggaggccgaggcaggtggatcacgaggtcaggagatcgagaccatcctggctaacacaatgaaaccccacctctactaaaaatacaaaaaattagccgggcgtggtggcgggcgcctatagtcccagctactcgggaggctgaggcaggagaatggcgtgaacccgggaggcggagcttgcagtgagccgagatcacaccactgcactccagcctgggcgacagagcaagactccgtctcaaaaaaaataaaaataaaataaaaataaaaaaatgtagccaggcgtggtggtgggcacctgtagtcccacctattcaggaggctgcggtgggaggatcacttgagcccaggaggtcgaggctgccgtgagctgtgattgtgccactgcaggccagcctgggtgacagagcaagaccctgactctaaaagggttaaaaaaaaaaaaaaaaaaagctttaagtcaatgtacctagtatagagacagacatttaacattgggaattagcactaccattttgcattgaaataatgagtaattccgggtgaaatgtacataaatgttgacattatgtatgagatgctaaaactgtaaaattgtagaggactgtgtttcattgcttaacttagcaatcgcttcagaataattcactaaaaatattttcagtgcctagcaatgtttcttggataaattattaatgtatcaatgccagtaattttttaaacttacaaagaaacaattgcattttaaagtcctgggaggcagaattttaaggcatcttgtaaaattccaacaatattttttccacttgaaagaactgattaagctgctagtctttgaatggcaggattttcagaaactatttagaaaatggccaaacctattcagctctgtgcttgtgaattccatgcggcctccgcgacgtcattttgctggacaccccgtggatgtcagtcttctaaaaggtgtcattgcacacacacagttcctctgaagatgatcacactaaaccatatacactgagcatccggttaaagacggcacttccaacaggcagccacctctgatctctcctgagtcctcactaacaacagggggtagatttattgttttcagtacatgaatctaccagggcaagggtcattgggagaaacaggagcaaagagaagcgggaggtggagggatgagggtagctgtccctgcagacagaggcgctggctgaccctctgcaggagaagctgagaacaaacccgacgtcgccacacagctgtgaaaggttcaggactgggcagcttcaggtggtcctccagtgggagcagtgggattgggaactgagagacccaggaaagcgtgctgaagaagcagtggaagttccactgtggtgacatggctagccagtgtgctggcatcacactgaaaatcatcagaaatgccggataggactgtactttaattctcgtaaaaatgttgaagaacaaaccaggtgaggtggctcacacctgtaatcccagcactttgggaagccgaggtgggcggatcacttaaggtttgagaccagcctggccaacatagtgaaaccccgtctctactaaaaatacaaaaattagccgggcgtgatggcgcatccctgtaatcccagctacttaggaggctgagacaggagaatcgtttgaacccgggaggcggaggttgcagtgagctgagatcataccactgcactccagcctgggcgacagaatgagactcagtctcaaaaaaaagaaaaaaaaaaacagttgaagaacggacaaaataagaaactttcaggttaaaacctaagtaaaaatatagattaaataagcaagctaaagggaagtatattatcgagttgcattaaaaactaagaacaggccgggctcggtggctcacgcctgtaatcccagcattttgggaggcagaggtgggtggatcacgaggtcaggagatcgagaccatcctggctaacacggtgaaaccccgtctctactaaaaatacaaaatttagccgggtgtggtggcgggcacctgtagtcccagctactcaggaggctgaggcaggagaatggcatgaacccgggaggcggaacttgcagtgagccgagattgcaccactgcactccagcctgggcgacagagcgagactccgtctcaaacaaacaaacaaaatgaaaacaacaacaacaacaaacccaagaacaaccaaaaaaaatcaaactaactttttttgtttttgtttttgttttttgaggcagagtctcactctgtcgcccacgctggagtgcagaggtacgatctcggctcactgcaacctctgcctcccggagtcaagcaattcttgtaccccagcctcctgggcagctgggattacaggcacaggccaccacgcctggctaatttttgtatttttaatagagacggagtttcatcatgttggccaggctggtttcaaactcaagacctcgggtaatccgcccgcctcagccttccgaagtgctgggattacaggtgtgaaccactgtgcctgcccaaactctctacagtttaagagagagacgtctaaaacacaagcttaagaagcattgcgtcagaaagaaaggcaggaagcataaacaggaagttagtggagttgtctagaaacagacaaaaaacttaggcaaaaagcaggaacggcagtggggacacattctaaccgcatgttcaattcaccaggaagactcagcagcttcaattctgcacttcacgttgattgatcagattattcactatgggagctactttaaacatacgaaaaaatagagaaaaaatcagattaagtgtgtgtaatctcatgtgggcttctaagtggactggcagtaacagaaagaaggtctcctgaaatactggccgggtgcgggcgctcatgtctgtgatctcagcacttttggaggccgaggcgggtggatcacttgaggtccggagtttgagaccagcctgaccaacatggtgaaaccccgtctctactaaaaatacaaaaattagctgggtgtggtggcaggcacctgtcatcccagctactcaggaggctgaggcaggagaatcgcttaaactcaggaggtggaggttgcagtgagccaagatcatgccactgcactccagcctgggtgacagagcaagactctgtctcaaaaaaaaaaaaaaagaaaaaaaaaaagaagaagaagaaatgaacatctgtaatgtgatagagtatatatataccaaaaattaccacagcaaacgtcacacttaaacattaaaaacattcccttaagaccgagaacaaaacagggacgctctctaaaaccacttctcagtattcatcacgtccccagccagaacaatcagatgtaaaagaaataaaaggcggccgggcgcggtggcgcacgcctgtaatcccagcactttgggaggctaaggttggtggatcacctgaggtcaggagttcgagaccagcctgaccaatgtggggaaaccccgcctctaccaaaaatacaaaattagccaggcgtggtggcgcacgcctgtaatcccagctacttgggaggctgaggcaggagaaacgtttgaacccaggaggcggaggttgcagtgagctgagattgagccactgcactccagcctgggcgacaagagcgaaactccgtctcaaaaaaaaaaaaaaggaaataaaaggcataaggaatggaagggaaaaatggtcattatttcagataaaatgactctacatagaaaatccaaacaaatatacagataagttatttaattaaaacaacttagtaatgttgcttggtacaacttcaataatgaaaagcaagtatatttctatttatcagaagaaataatgagaaaatgagatttagaaaagctaccgtttataatcacatcaaaaaccatgaagtactcaagaagaaatacaacaaaagacacacagacctctacagagaatgcgaggaaccccctcgggcagcatgaaaggagacagacataaaaataaatggaacaaacgacccatttcttcaacaaataaatggcctggaggaaaataaggaaggggaggtctttaagtgaaaagagcctcaagagacaagtcggccacatgcaacctggggatcttgttcaaatctcgattcaagcaaaccagctgtaaaagacatttttgagacaattcctgaaagtgagcacaaactggcattagtttccattaagaaattatcaatgtgggccgggcgtggtggctcatgcctataatcccagcactttgggaggctgaggcgggtggatcacctgaggtcaggagttcgagacctgcctggccaatatggtaaaacctcatctctactaaaaatacaaaaattagccgagtgtggtggcgggcacctgtaatcccagctacttcggaggctgaggcagaagaatcacttgaatctgggaggcagaggttgcagtgagccaagatcgtgccattgcactccagcctgggtgacagagcgagacttcatctcaaaaaaaacaagaaattattaattgtattggggttgatgatgattttgtggttatgctaaaaatgagtttctatctgtcagaggcatctgcaaaggtttttacaggtgaaatgatatatcgcctgggattttctttgaaacatgctagtccagatctacacgtagggaggggtaatgggagaggaatgctgtgaggctgatagttgctgaggcagggacgggcacctggggcttcgtattatcattctctttacttttttgactttgcaattttccataataaaagttttttctaaaagaaagtctaaataaatagcctgggcgcggtggctcacgcctgtaatcccagcactttgggaggccgaggtgggcagatcgtgaggtcaggagatcaagaccatcctggctaacagggtgaaacctcatctctactaaaaatacaaaaaaaaattagccgggcgtggtggcgggcacctgtagtcccagctactcgggaggctgaggtaggagaatggcgtgaagccaggaggcggagcttgcagtgagctgagatcttgccactgcactctagcctaggcgacagagtgagactccgtctcgaaaaaagtaataataaaataaaattaaaattaaaaaataaaataaataaataaatagctcatgttcaagcactacaaactcaatgttgtcaggaagtcagttccttccagattgctctatagattccctaaaacccctatccaaatcccaacagaaatgtgtgtgtgtgtctacatgcaagagcaagagaatgagaaactcgtctggtgaattttaaaatgtatatggaagaacaatggaacaatagttttgaagggggaaggggtgccccaccagatatcaagattgattctaaagctgtaaaactaagacagtagagtgctttggacaagacaaacagaccaatggaacagatcagagaggccagaaacaggcccccacgtactagcgctatgcaggatagaagcagggttgctgaacagcagccacggaatggacatctttgtcggcacccacccaaagatcagtctcacgtggattaaagactcgtatgggaaaaatcaaaattcagctacagtgtgtgttagcggggagtcgatggggggtgggaatggagccttgttacttcagaatttctcaaataaaacgctaaagacattaggcacaaagggaaaattgggtagagtcgcccacatttcaattaaaaattttcattcaggccaggtgcagtggctcacacctgtaatcccagcactttgggaggccgaggcaggtgggtcacttgaggtcaggagttcgagaccagcctggccaacatggtgaaaccccgtctctacaaaaaatacaaaaattagccaggcgcggtggcgtgcggctgtaaccccagctactcgggaggctgaggcaagagactcctttgaacctgggaggaggaggttgcagtgagccaagattgtgccactgcactacagcttaggcgacagagcaagactctgtctcaaacaaataaacaaaaccaaatcttttgttcagatgacatcctagggaaagttaaagaaaacctacaggccgggcgcggtggctcacgcctgtaatcccagcactttgggaggctgaggcgggcggatcatgaggtcaggagatcaagaccatcctggctaacacggtgaaaccccgtctctactaaaaatacaaaaaattagccaggtgtggtgcaggcgcctggagtcccagctcctcaggaggttgaagcaggagagttgcttgaactggtgaggtggaggttgcagtgagctgagatcgtgccactgcactccagcctgggcgacagagcgagactccatctcaaaaaaaagaaaaaagaaaacctacaaagtagaagacaatcacagcacataacccagaattttactgtcaagaccatgtaaggaatatccatgaatggataaagacagacagccccacagcaaaatgggcaaaagacgtcaacaggcacttcacagttaaggacgtgccacgtcccctaacacgcgcatgggttcggaggaccaggacatgggttttttggggaagggggagatcatcctgcctatggcaccctctggctctgcgattcctctcccaggagcacaccctacagaaaatcccacctgttgtgttagcttcccggggtcgccataacaaagtaccacaacctaggtggcttcaacaacagagttgtctcacggttctggaagccatcgtctaaaaccgagttgatggcagggccatgcttcctctgaaggcacgagggaagggcctgtttcaggcctctcttttagcttctgctagttctgtggcttgtggcagcaaaattccaatcttcataggacattctctctgtgtgcatttgtatgtccaaatttctcctttttataaggacaccggtcataccagatgaggcactcaccctattctagtatgtcctcctcttagctacttacaggcatcactgtaagtccaaataaggtcatattctcaggtcctgaggcttagagacagccccgatggccacggtgccactgtgtggatgaatctctcgcacaaccccgaggagaaaaagacagaggcccgcctgatgctcttcctctcccccttcccttcactgtcacagtaggttccctgggtagggcaggtggagcaggatccacagtggcccaggctgggctgtcggagcctggctgggtgaggagggtgagggtatgtggctgaggctcagagctgtttgcaggtgcctggctgggtgaggagggtgccggtgtgcgtggctgaggctcagagctggatgtcagagcctgagaagaaagagggcggccccaggtgtggtccagcagagggtatcagagcccaggcaggagaagaaggtgtccaccatgagagcctcccaggccaagcctgggagtgatgacatatttgcatagcttccaaatacctcctacaaaatgcttgtgtttttgttttgttttgtttttcattttgtttttttttttttgagacggagtctcgctctgtcgcccaggctggagtgcagtggcgcagggtcggctcactgcaaactccgcctcctgggttcacgccattctcctgcctcagcctcccgagtagctgggactacaggcaaccgccaccacacctggctaatttttgtatttttagtagagacggtttcaccgtgttagccaggatggtctcgatctactgacctcgtgatccgccctcctcagcctcccaaagtgctgggattacaggcgtgagccactgcacccggccaaaatgcttgttaattacgaaggaaaaaagaacttcccagtggagatgttggcagataccaccttaatcaagagctcaaagtgaacatcatcagtaacgtgacaacgtgaccactgtgagccactgactggatggaatgaacaggccacggtgtcacctctgcgactttcctgtccgagacgtgcagtgggaatctaatcacgaggacacagcagacgaaaccaaatggagggactttctccaaagtaattggcccatgaccttcagaggtgtcagggtcatgacagccaaagcaaggccaaggaatgttctggactgaaggggaataaagaggtatgtgagaattcagtgcaaagtgactctaggctggatccttccacgctggggccctgatgcaatcaactggcaaagcgtgtttgacaggctgaggggtaaacacggcaacaggcctgtgtcctctcctgactcgggccatgtgtggctgtgttggagaatgtcctcgtttgtggaaaatacactctacaagggtggggggcgacagagcatcatgaaggcaacttactctcaaatccttcacgagaagtttttttgtgctgagcttgcaacttttatacaagtttgggattgtttcaaaaaatgttaaagaatgtatgtggtattacataaagtttatatatattattaaacttatataaaccttatataataccacacatattctttaaaattttatataaataaatttatataaaatttaaaataaatgaaagttggctgggtgtggtggctcaccgcctgtaattccagcactttgggaggcggaggtgggtggatcatttgagatcaggagttcaagaccatcctggccaacacgcggaaaccccgtctatactaaaaatacaaaaattagccaggcatgctataatcccagctacttgggaggctgaggcaggagaatcgcttgaacccaggaggtggaggttgcagtgagccgagatcgccctgctgcattccaacctgggcaacacagtgagactctgtctcaaaaaaacaaaaatttaaagaatatatgtagtattatatgaagtttaatatatattattaaacttacataaaactatatgtggcattatatatagtctatatatttatattatatattgtttatataacaccacatatattctttaaaattttatataaagtttatataaagtttaaaataagtgaaagttaactatattgtttagggacacatgcataggtagtaaaactaaagaaatttatatatcatctttaaaattttatataaatataaagtttatataaagtttaaaataagtgaaagttaactatattgtttagggacgcatgcataggtagtaaaactaaagaaaaagtcagccatggtcaagaagagcgggtctgtgagtggcatgggggagagactttggggtgctgatgaggttctatttcttaacttgggtagtggctactgatgttcgatttataaccaatctctaagtcgcacatgcgcatttatgcaccatcgttatgcagagaatatcagtccatttcttttcaactgtgggccctacagcaggcctgcttactacctcagtacctggcttatgcagataaaaggagtattcctttaagaaaaacaaaatactagaggcaaatcagcttccaaaactaggttatacatactaaaactaaatgactttggggctatggaccatgctctcctttttagctaggcagacactcacgagtcttaactgttcaccagacaggctggcccttgatttttgtttaatgtttttgtaaatgtgttataataatactttattataacatctgctgcaaagtcaggggcgggtccctcaacagaggctgtgccagcgccggggttccctgaaacgaaccagggactagaactattaacaaagtcatttttctggcacagctttccgggaaaggcgtttcatatgggacggagttctgcctggggggcgggggtcaaacccttccagctcagccccagggtcaaacgcatccgcccccacacccacctctggctggcctgggtcccaggttctcgggctccggaggcacagacaccccgggctgctcaggcaggcggcggtccttggcgattgccctccgcggcgccggcggcgtggtttggggcgggcagctccatggcaac

SEQ ID NO: 671 - DNA, 1713 bp, Homo sapiens
gaccacttaaatacaaactttattctctctccaagaagatgcagacgtcacaggtggccctgagctcccacccgaggcttaggcccaaggggcctcttccaggctgagggcctgctggggctgggccaggggctgaggctgaaagcagcagcctgcctagtgggtgacgccaggggccggtgtaacatggcaccgaggttggggccacagcaatgtgtgggacggtggggtgggctggggcccttggctccaagcattagttctccaagctctggtccgttctcctacctccttcaaggggcaccagggctacaaggtggtagttgagtattggggcccgactcctggggcactggagtggtctctaggcccgaggccccaaggagagggctgggtttctgggagagtgctggtccttcctctctgggcttggccatcttgacagcttcatcgtaggagggtggaggctccggggtgtacaggctgtaggcaggaggagccatggagtccaggtccagctccccaaagggcaggggcaaccgcatgcccagtgggtactgcacggagctgtaggctgcagggaaccagagtgggttcgtggaggcgggcttggcatttacccccgccatctccaccctcaactggcgggcccctaggcactcacaggtcacagtgctgtgtacagggctgtcactgtccatagggatgactgccacgtcgcagggctgccgtgctggtggcagatgtggctgggcctgtgcctgcttccggaggcagcagaaccggacacaaccagctgtgacaccacacagcagaagcaggaggaccgccagcaggatgagcctaggagagcaaggctctaccactggactgaccctcggccaccgggcacctgcaccctggggaatgtcgtggcacaaccaccgaagacaggttaacaggataaaaagcagacaatgtctctccatgtcggagaccgccgtggccagagcctggcctcgggctgctgggcctgccctggctatctctcctgggctggccaggggtggccttgggctcactcccaggactcgctgtcctcagcgagtgccccactgctgagcgggatcgtaggggactcccgcggaggccaggcgggagaggtgggagggaaggtcctgcttgctccaggtcagttcccgccagcggccgggactgggcgacagcggaggcggcctggtgaggtaagggcctggcgggcctggccccggtgacccccgccccagaaccgtcggacgcacggctccgccgcggcctccacttaccccacgtgccacaggctgctccagcgggcctggggcgggcacctgtggggacggcggcacctggagcaggcggggcatgggacggccgacctcgccacccgtgcctccccatagggcggggccaggccccggctccctcccccccgacttactggtccgaggggtcgcagctgccgtccgcgaagcccagcgccacctgtggggacaagggtgagcccgggaggggcgtggtccgagcagggacccgccccgcggtggccgaaccgagagagaacgccgcccgacccacctgcggcagcggcaggagcggcaggagcggcaggagcggcagcagcagccgcagtccgcgggcggccagcggcccccgggccatgctctgaggaggttggagcaaagcccggcggcgcgg

SEQ ID NO: 672 - DNA, 2469 bp, Homo sapiens
gggtaattagacccagacagggagggctcagtgcgggtctgaggagggaacacacgtgtgcaggcgtgtgctccacggtggcatgttgatacggaccagcctgggcaccaggccccctcgggagccagctttgctgttctgagtggaagggagatcaggtttccctgagaaaccccaaaatagcccccaactgtgcctggcttccagcgggcagcccagcccccaggccctgttttgctccctttcccccttcacccccagcccatgtcctgctgtctcctccctgaatggtggaccctcagcccctcctgtacaagatggtcaagcggtgcctcatgcatttgttcattcgacctgtcctgagagtttgtgacatgctggcacggggccaatgttgagtccaccaggatgggagggtggccaggctctgagccactgagcaccagctggccaggatgggtcttcaacaagaaatctcactggtaagtgatgacagcatgggaccagggtcccatgaagacctgctggagggccgcacctctgggaaggtagacttggagcttggtccagtgaagagggaacagcacggggaacagcgtgtgtgagggtcccgccatgtctcagccctttcctggcccccgcacttagccttcggtgcccatcttcagggtcaggggaagcccaggccaaagcgggccgggaaggggccctgtggataaggccgagagcctgtcccaaaatagggccggcaggatttcccacccataaaaggctcttggaatctggaccccggggaccccaggcagccaggcccagctaaaactcagctgccaccactgccccagcactctgcccacagcagccctggtgtcaccaccctgcagaatcctgtcagacaaccaccgacatggtaaggctgctctctgtgcccgatggagtctctggtgggctggctgggtaggttgagctggaacctggaggtgcaatgacctgccacggagcctgggcaggaaggggctgaggtagaagagggggccaagccctgctgccaccaacacagcccttgttccggggccagggtggagcagccctttctgaaagctggctcccagatgggcagcagcagtggtggcaggcaggtgtggcccggtgctggactctccctccggaatgccacacaggctggagcccagggttctgcttcctgggctgtatcccaatcctgggctggaagcctttcccgggccagggctgggctcctccccaccctgctctcggcttccttcacctgcctcacctggtgtccattgccaggctccagggccgctgcctggcccgcctggccctgcagctgctgctgttccctcgcacgctggctcctgcctgtctggcccttgcccctgttagctgcctggcagagccctgctggccctgcaaacccctggcgtgtgaccccttgtcctggaagcctgctctccgctgggggcctcctctcttaccactcaccttgaaaggctgccaatggaggaatgggtgcagggggtacctctgacccttccctggacacaggggcagaaggggctcctggtcaggccggtgcgggtgtcccctgcagacagagcgcctgtcggctgagcagatcaaggagtacaagggagtctttgagatgttcgacgaagagggcaacggggaggtgaagacgggggagctggagtggctcatgagcctgctgggtatcaaccccaccaagagtgagctggcctcaatggccaaggatgtggacagagacagtgagctcatggctggagtggggtgggcagcctcgggggggccctgggtcaggtgtcagtgcctacggggggaagaggcaaagcccatggggagtgctgtgccccatcccttgagccccagctgtgccccttgcagacaaagggttcttcaactgcgatggtttcctggcactaatgggagtttaccatgagaaggcccagaaccaggagagcgagctgagggcggcattccgtgtctttgacaaagagggcaagggctacattgactggaacacactcaagtagggcccgggttgggggcgggtggtgggcgggcacgggcagggccgatggagtggctcagcgccaggccccgtaggtacgtgctaatgaacgcaggggagcccctcaacgaggtggaggcggagcagatgatgaaggaggccgacaaggatggggacaggaccatcgactatgagggtgagtggcctggagccctgggagccgttggctgggccggggcaagctgctgacctgcccctctgttcccagagtttgtggccatgatgacgggggagtccttcaagctgatccagtaggtgcagctgccgcagccgggggaggcctgcccgggaaggctgctgcccctgccccctggcccccactcccccggctccgtgtaaaataaatgttccagccc

SEQ ID NO: 673 - DNA, 5390 bp, Homo sapiens
tttttctggatagctttattgaagtgtcatgtacaaagcatacatttcatgcacttaaaatgattaaaaatcaatgatgtttagtatattcgcagagttacaaccatcaccactactgaaatttagaaagttttcatcacgacacaaagaaacgttctatcaattagtggtcatctcctatttcaacctccctgagacattggcaaccactattctactttctgtctccatgggtttgactgttcttggtacttcctataagctgactcacataacatgcaacttttagaaaggctgaaaaccacaaataccatgttgagcaaaatgagcccgacacaaatgctaggatgtctgtactttagtaattgtgtgcatcctatttcaataattgatttagaatttttgtatcagagcaaataacataattcattttcagatttatgcaatcataatatttctattttaagaaatataaaatgtatctgatgcactgcaaacgcaaatgctttacttctaaagcttatgcttacaatgatatatcattgaagatccacactgggctgatttaagtcgatttacttgtagcactgcacagttaagttcagcattatctgagtcttttatcctgtaatggagaaaaatccattttctgttacattttaagcaaatgattcatgagacgaaagcattttccatgtactgtaagaaaagaatttcatggaaaagggtaattaaatttttcataatattagtaagagtcattattctgaacactcaacagagtagtccctcttcatccacgagggatatgtttcaagaccccagtggatgcctgaaatggcagatagtgcagaacctatagagagattatgttttctctacacattcataactgtgataaagtttaatttataaattaggcacaataagagattgacaacaataactaataataaaaaaattatagcaatatgccaacagcactattattgtgctttgaggatattcttaagtaaaaaagtaagcgtggctttttaataaaaacaagcactgcagttccctgatagtccagctcgaggttgtccaactcgctgcccatgggccgcacgtgacccaggacagctttgaatgcggcccaacacaaatacgtaaactttcttaaaacattctgtgattttttttttttttttagctcgtcagctatcgttagtgttagtgtattctatgtgtggcccaagactattcgtcttctaacgtggcccacagaagccaaagatgggacacccctggtccatctgataaccaagaaggttactagcagaccaatgagcggttgaaatatatggactactatggtctattgtaaaatatttatatcaacatttcactaactttccacatctttcttcatgtcaatgattccacataaatttattcatattattcttctgaatttatcctttatatatattttttatatagcgccatacaaaagaacttacttatgtttgaaagccaaaccatttattgtcacccatggatgatgactgctgttacgaaacacaccaatccatgaggaaggtaaaatgctggccagaaatttctaaaagaaaagaaataattttcacttaaataataattatgaaaacattacaaaaacaatatattaaagttgaaaaccactatttgcagtgccaaaaactttcataaatgtttgaattttttatttaaatgaactcttcaacgtttatacttagtactttcattcttattctcatgttaataaagacattttaattcttgcaatgtaatagttactccaattaacagaataaacgcaggaagggttttaataagtttcctgatactgtgcattcattcctccagatactgtgactaaatcaatctatttttgtgctatatttctcagagttggagatttagaagggaattgaggggttgtcattcagaaatagatgacatggaagctacagattgggttttctgggtaccacaccattctttaactagataagccctcaatttttatccgattcggtttttgcggaataacaggggtcctggccaggtggtgtagactcgtctctctctgctactcccgactaaaaacaactataaactctgggattaatgaaagacaaaagcaatggagaactctgaaaggtggaaagagaaagatgaaattgtctgggaccctagcatcagggatcaaccaagtgtccgagtgagcatgttaagtcctccacacgacagaagaaggtgacctaggcctgctgtttccctacacccaacctggcaataggaggagggtatcgaaggagagtcccctccacaataccaggcaaggctggtgccactggcaaggatgatctaccaggagacctgctaccaatatggagctagagaaagtgcttccttctcataccaagagacaccaggatggctgtggatgaggaggatcagcaaagggaccccatgactaacagtgcaccgtaaaccacctagggtcctctttgtccctgagggcatgagacccacttccccatccagagacaaggactcaatggattcttactgttctttgtacatagtacagcagtgaacagtaacatactactgataactgcaataatatggaggaattgcacaaatatcagataggattgaaaaagacatgaaattcacactgcttgattccctttatataaataaattcaagaacaggcaatcattatttataatattaaaagtcaagactgcgttttggagaggagtcaggataagtgatgagggcatacacaggggtggaactgctagagctggaaacttttatttcatgatctgacttgtatcacatgcattcattcactttgtgatcaatctgcatgaccagatgatatcatgcccgataaaattagatagcaaaatttattgtggattcaaagcacttatagaagcatggttttccttgaaaaacaaaaactgaaaataaatgtacattagcagtatataactttaaaaacattattaagtcaatcaattgaatattacatacacttgaaaatatatgagataaatatatgtacacacatatggatgttttctacaaatgtattattcactgaaggaagcttttcataaaatgtttgaaacatttacatcttaccatttcttcttcattatctatagaaagcagactggagttcttcgaagtacaggccagcaaactctcttcccaagttcttctttccttaccaatgtaataacaactgttggaatatgtaatccactcctcaggacaatggccacaatgacgtgctaataaagatatgaattactatctagaccaatatgaatttttaaaaatgaaaattagttcacatatttcaacagtataaacatatatgtgcttaacatatttacgcatccttacaggcttataaatgtatatttttaataactgagtcagtcatacacacatgcacagacaagggttagcctctcctccctaattgtgttcccatataaagcaaatgaacaaacaaaaatacactctacacatgtgttgaacatcgctgatacacaactgcttttttagaatagtaaaattatttatttggtatcatctcacagcagtaggaaacctctgttaattgggagaaagagggtagaatgattttaagtgagtatttctactcactggagaaaaggaaatgctgcctcataatctttctttataaatatttatggctgaatttatggcttattttctgcaaaaatgccactattcttttacatgccttaaaacagacacaaaatataaattgtactaatatcagaacattgaaaataaaaatgtacctttctgcgttcttgtattcggggaaaaattgttctgctccaggactgtaatagaaaaattaaaatgatttttataaaaactgatatctagataaaccataacgagtttagtttcttactttgaaactttgtgtgttatttaaaatggggagaatctttaataaaattaactttttctataaaaatatataaagtaatagacctttgaaataaacatttttaaagactttagcacaaacttcaccatctcttgtagtatttgatgtaaccactttcaaaaattaatttgtttttctaaatacttttcttctatagcatgcctttgaattatgaaatcagaaaatatctttgtgtgtgtatgtatatacatatatatagattacacacaaaaaataaacacatgttctctacaatgattttgttatttatgttgtgaaaaattcagaataaccatattacttttggttccaaattgtactaatatcagaactttgaaaataaaaatgtacttttctgggttcttgtatttggggaagaattgttctgctccaggactgtaacagaaaaattaaaatgatttttataaaaagtaatatttagataaaccataatgagtttagtttcttactttgaaactttgtgtgttatttaaaatggggacaatctttaataaaattaactttttctataaaaataaatgaagtaatagatctttgaaagaaacagtaaaataagagttctattcttcaacagtatgaaatattttgaggcacttccaagcattaaagtaaaacgttcccttctaatctttcaagaatatgcttacaaggaataagaactattgtttttaacacagtggccatcaggacaatgcaaatgattcctaggacctcggcagtgagcttctctggaggtggcagtaaacctgcagggagagaaatagaggcactgagagaggggagatagagagttgattaggattacatactagagaattacatactagagaacccacatgcacagggaaacataatgataaactctggcctctaaatctacatctactctagtaatctttctctcagaatataccatttcattttcagtaaatataatgttccatgagtggaccgcagattacagttgaacaatgcccgaataaaattagtcttctgatttcatattagaattttagatcccaattatgaactccgattctcacaagtgcaaaatattccctaatctttcctcacccttctgcattcaactgcacatcctagaacaataatattgaagatatatttaatgttttaccttggcagtcatatattttatcaatcccttgatgattcagggaaggattttgaagatttaattctacttggaatatttcctgttcggttcctgaaatggagcttttattgcctttaggtttcctttgctgccgctttgggtcctgggccagactcacttctgagaaggttcctctttgtttattcatctctgca

SEQ ID NO: 674 - DNA, 7344 bp, Homo sapiens
ttttctggatagctttattgaagtgtcgtgtacaaagcatacatttcatgcacttaaaatgattaaaaatcaatgatgtttagtatattcgcagagttacaaccatcaccactactgaaatttagaaagttttcatcacgacacaaagtaacgttctatcagttagaggtcatctcctatttcaacctccctcagacattggcaaccactattctactttctgtctccatgggtttgactgttcttggtacttcctataagctgactcacataacatgcaacttttagaaaggctgaaaaccacaaataccatgttgagcaaaatgagcccgacacaaatgctaggatgtctgtactttagtaattgtgtgtatcctgtttcaataattgatttagaattttcttattagagcaaataacataattcattttaagatttatgcaatcataatatatttctattttaagaaatatacaatttatctgatgcactgcaaatgcaaacgctttacctctaaagcttatgcttacaatgatatattattgaagatccacactgggctgatttaagtcgatttacttgtagcactgcacagttaagttcagcattatctgagtcttttatcctgtaatggagaaaaatccatattctgttacattttaagcaaatgattcatgagacgaaagcattttccatgtactgtaagaaaataatttcatggaaaagggtaattaaatttttcataatattagtaagagtcattattctgaacactcaacagagtagtcccccttcatccacgagggatatgtttcaagattccagtggatgcctgaaacggcagatagtgcagaacctatagagagattatgttttctctacacattcataactgtgataaaatttaatttataaattaggcacaataagagattgacaacaataactactaataacaaaattatagcaatatgccaacagcactactcttgtgctttgaggatattcttaagaaaaaaagtaagtgtggctttttaataaaaacaagcactgcaattccctgatagtccagctcgagcttgtccaactcgctgcccacgggccgcatgtgacccaggacagcttcaaatgcggcccaatacatatacgtaaactttcttaaaacattctgtgattttttttttcttttttttgctcgtcagctatcgttagtgttagtgtattttatgtgtggcccaagactcttcttcttccaatgtggcccacagaagccaaagattggacacctgataatcaagaaggttactagctgaccaatgagcggttgaaatatatggactactatggtctattgtaaaatatttatgtcagcatttcactaactttccacatctttcttcatctctatgattccacatagatttattcatattattcttctgaatttatcctttatatatatattgttatatagcgccatacaaaacaacttactcatgtttgaaagccaaaccattcattgtcacccatggatgatgactgctgttacgaaacacaccaatccatgaggatggtgaaatgatggacagaaatttctaaaagaaaagaaagaattttcacttaaataataattatgaaaacattacaaaaacaatatattaaatttgaaaaccactatttgcagtgccaaaaactttcataaatgtttataattttgatataaatgaacccgtcaatgtttatacttagtacttttattcttctcatgttaataaagaagttttaattcttgcattataatagttaccccaattgactgaataaacacagtaaggatttaaataagtctcctgatactgtgcattcattcctccagatactgtgactaaatcaaactatttttgtgctatatttctcagagttggagatttagaagagaaattagaggttgtgattcagaaataaatgacatggaagctacatattgggttttctgggtaccacaccattctttaactagataagccctcacttttttatctgatttggttttggtggaataacagtgatcctgaccaggtggtgtagactcgtctctctctgctactccctactaaaaacaactataaactctgggattaatgaaagacaaaagcaatggagaactctgaaaggtggaaagagaaagatgaaattgtctgggaccctagcatcagggatcaaccaagtgtccgagcgagcatgttaagtcctccacacgacagaagaaggtgacctaggcctgctgtttccctacacccaacctggcaataggaggaggcccagcaaagctcactcctgttctgtattgaaggggagtcccctccgcaacaacaggcaaggctggtaccactggcaaggatgatctaccaggagacttgctaccaatacagccagaggaagtacttccttctcataccaagagacaccagagtggatgtgggtgaggaggatcagcaaaggaacccaatgactaccagtgcaccacccagggtcctctttgtccctgagggcatgagactcacttccccatccagagacacaggattgaatggattcttagtgttctttgtacatactacagcagtgaacagtaataaacgacagataaccgcaataatatggaggaattgcataaatatcagataggagtgaaaaacacagacatgaaattcacagtgtatgattccctttatataaattcaaaagcaggtaaacgttatttataacattaaaagtcaagacagtgttttggagaggagtcaggataagtgatgagggcatacacaggggtggaactactagagctggaaacttttatttcatgatctgacttgtatcacaggagttcattcactttgtgatcaatctgcatgaccagatcacatcatgcccgataaaattagatagcaaaatgtattgtggattgaaagcatttctagaagcatggttttccatgaaaagcaaaaactgaaaataatcaaaagtacattagcagtatatgaattttaaaacattattaagtcaatcaattaaatactacataaacttgaaaacatataagctaaatgtatatacccacacatatggatgatttctacaaatatattatcgaccgaaagaagcttttcataaagtgtttaaaacatttacatcttaccatttcttcttcattatctatagaaagcagactggagttcttcgaagtacaggccagcaaactctcttcccaagttcttctttccttaccaatgtagtaacaactgttggaatatgtaatccactcctcaggacaatggccacaatgacgtgctaaataaagatatgaattactatctagaccaatatgaatttttaaaaatgaaaattagttcacatatttgcaaacatataaacctatacgtatgcaacatatctatacatcttcatgggctggtaaatatatagtgtcaaaatacccagtcacttatacacacatgcgcaataaagggtcagcctttcatctcctaattgtgttcccatataaagcaaaccagcaaacaaaaatccactctatacatgtcttgaaaaatcaatgaactaatctgatttttaaggaacaataaataacttgtatcttatcatattatagcagtaagaatttgaacacaacagataaaaagaaagcatagtgattttacttatagttgatgacaagtgaatgccttactctaattttatttatgaacacttattgccaaattttataatttttcacccaaaattttatttttgtacagcctaagatcaagaaaaaataaactgtacaatattaaaactttaaaaattattatatacctttctgagttcttgtattcagggaagaattgttgtgcctctgtattaatgtagctagaaaaattaaagtaatctttgtaaaaaaattagcatctaaatcaatcataataattttaagtttttgtttgaatttttttgtattatttagagttagaataatatggaataaaattgattttaagaaaaatttgataaagtaatggtggttttttggaaaagtatttcatagatctaaagaaccaaatttcaccatctcatatagttcttataattcttgatttaactactttcaaaaattaatttctatttctcagtaaggtttttcagactcctagaacatatttttgagttatgaaatccaaatatatacatacgattgcatcagaagcgaatactttcaacaattattctttcatttattctttgacaaattcagaataatcattccacatttagtccaaatatatacattacaatgagaactctattccctgaaaatatgaaatgtttagaggcacattcaatcattaacgtgaaaattccccttgtaatcttcgaaaatagacttacagggaataacaactatcgttaccacagaggccattaagataagacagataattcccaggatcccaacaatgagcttctctggagctgatggtaaatctgcagggagagaaatgggaacagtgcgaaaggagaggtggatacagtcgtttagaagattcacagacaagagaacctgaatgcacaggaatcatacagagaaacttggaccccaaaccctcatctcccattgtaatctttttctcagaataatataccattgaattttcaggaaaaataatgctccatgaattatttgacaaagactacaaacttcaacaatgagttcaatcagtcttcatactttacattgaaatagcatatctcaacttggaattctgatctttgcaaatagaagatatatgagcactcccttctctttccccacattcctgtaccccaagctgcacatcctagactgttatattgaggatcttttaaatgctttacctttgcagtgataggttttgtcattcccttgaaaatcctgagaagctttttgaaggtttaattccgcataggttatttcctgttcagttgctaaaatggagtttttattgcctttaggttttcgttgctgcctctttgggtttgggggcagattcaggtctgagtagattactccttggttatccatctctgcagtgtgtgatgtcagggactgtactctataataacagtagttaagaagttaataaatggtttatatacaggattccctagtgcaattaaaagggtgaggtggagaacgagtattggagctcattttgcattaaataatctaaagttctttctctgattttcttcaagcctaaacacgtttcttatgaatatttgttttaaaaaaagatttttaggccgggcgcggtggctcacgcctgtaatcccagcactttgggaggccgaggcatgccgatcacgaggtcaggagatcgagaccatcctggctaacacggtgaaactccgtctctactaaaaatacaaaaagtagtcgggcatgatgtcaggcgcctgtagtcctagctactcgggaggctgaggcaggagaatctcttgaacatgggcggcagaggttgcagtgagcggagattgtgccactgcactccagcctgggcgacagagtgagactccgactcaaaaaaaaaagataaattttctgcatttgacaaaatattattgctggggcaatgagaagcaataaattactaaggaataaagaagttcaggaataaaaatatatttcttaaagtctgatgttttacctgtgttaaaaattaaaatgttgtattagaaaaacttctgcactcatttttatgttaattttgaaatccagtaatggttaagactatgtggtctgcacatgagtaatagtaaagttgacatatatatatataaaaatttcttgcactacattacttttaattagtaatttatacacattaatgaaaatcaatagaggtaattaaatggtcttttcttaatggctgaaatgttctaagaaattattaaaaattatttattaaaaattataaaaaattaaatatttgtatatgacagaaaatgctatgtgacacagttaacttatgcataacctaaatagtattaggaacactacataaattgttaatacttacagaagtattggtaatttaattagtaattggtaatttatttcctggctaaattatgaaccaaaaaatgataaataaaagtataggtaattcatgttaaagcacatttcatttaaacttatagaatgattttatggttgtcaaagtgagtaaaggccactttagttgtataagtacttgtaaaatttcagataatgtaattaaatcatttagtcaatgggctctggagtcagtgagatctagaattaattctagctttgacacttataatgtgcgacctttaaaaagttattctatttttaataacccagtttgttaatctaaaatgggcataagaacatataaaacgttgcatgtaaaacatttaccactcaacctggcacttaaagttctcaataagcattagctactttaattattattttagtcacaattgttatgttactgtttctgattcatgtcagttaaagcatggaaaataaatcttcagataagtctcctatgtccatgcgctacatctttttttgcaatattttgatcaatttttaaaaagtatttttattgctttgtaatacctttagcattttatgtaatctacctcattctgatttttattaaaaataaaaactgcttttctctaatctacgtgtctgaggaattgtatttggctttcatcaattgattgatttattttaataatctttaatggctaagctaaatataaattattattcaaagatacatgatgtactgattacaaaatacaaaattaattgttcattattgtgatgttaatagctttcccttaaacgatattgatcaacaaacccactagatttccacaaacaataatttgaaaactttaagaaatccttcaacatatttcatattttaggtttttaccctgagttattcaaatgaagacagcaatattctactttgattttattgtatattaattatacctcctttgtatcatattgagcacttgaaatcacccactaaatgaggtaggctagtagagagttggagagtagcaatacataccttctgtccccagaaagtcacacatcctttagtggagaggccaggttagtctcataaaaaggcctgctatagctgtgtaataaaaggtgaaatttaaaggcataaatccaagacaagaacaaacaatgcctgcaatcttcgcagactgccctgtgaaggctcagagtgagtcaagagtggaaa

SEQ ID NO: 675 - DNA, 8580 bp, Homo sapiens
ttttctggatagctttattgaagtgtcgtgtacaaagcatacatttcatgcacttaaaatgattaaaaatcaatgatgtttagtatattcgcagagttacaaccatcaccactactgaaatttagaaagttttcatcacgacacaaagtaacgttctatcagttagaggtcatctcctatttcaacctccctcagacattggcaaccactattctactttctgtctccatgggtttgactgttcttggtacttcctataagctgactcacataacatgcaacttttagaaaggctgaaaaccacaaataccatgttgagcaaaatgagcccgacacaaatgctaggatgtctgtactttagtaattgtgtgtatcctgtttcaataattgatttagaattttcttattagagcaaataacataattcattttaagatttatgcaatcataatatatttctattttaagaaatatacaatttatctgatgcactgcaaatgcaaacgctttacctctaaagcttatgcttacaatgatatattattgaagatccacactgggctgatttaagtcgatttacttgtagcactgcacagttaagttcagcattatctgagtcttttatcctgtaatggagaaaaatccatattctgttacattttaagcaaatgattcatgagacgaaagcattttccatgtactgtaagaaaataatttcatggaaaagggtaattaaatttttcataatattagtaagagtcattattctgaacactcaacagagtagtcccccttcatccacgagggatatgtttcaagattccagtggatgcctgaaacggcagatagtgcagaacctatagagagattatgttttctctacacattcataactgtgataaaatttaatttataaattaggcacaataagagattgacaacaataactactaataacaaaattatagcaatatgccaacagcactactcttgtgctttgaggatattcttaagaaaaaaagtaagtgtggctttttaataaaaacaagcactgcaattccctgatagtccagctcgagcttgtccaactcgctgcccacgggccgcatgtgacccaggacagcttcaaatgcggcccaatacatatacgtaaactttcttaaaacattctgtgattttttttttcttttttttgctcgtcagctatcgttagtgttagtgtattttatgtgtggcccaagactcttcttcttccaatgtggcccacagaagccaaagattggacacctgataatcaagaaggttactagctgaccaatgagcggttgaaatatatggactactatggtctattgtaaaatatttatgtcagcatttcactaactttccacatctttcttcatctctatgattccacatagatttattcatattattcttctgaatttatcctttatatatatattgttatatagcgccatacaaaacaacttactcatgtttgaaagccaaaccattcattgtcacccatggatgatgactgctgttacgaaacacaccaatccatgaggatggtgaaatgatggacagaaatttctaaaagaaaagaaagaattttcacttaaataataattatgaaaacattacaaaaacaatatattaaatttgaaaaccactatttgcagtgccaaaaactttcataaatgtttataattttgatataaatgaacccgtcaatgtttatacttagtacttttattcttctcatgttaataaagaagttttaattcttgcattataatagttaccccaattgactgaataaacacagtaaggatttaaataagtctcctgatactgtgcattcattcctccagatactgtgactaaatcaaactatttttgtgctatatttctcagagttggagatttagaagagaaattagaggttgtgattcagaaataaatgacatggaagctacatattgggttttctgggtaccacaccattctttaactagataagccctcacttttttatctgatttggttttggtggaataacagtgatcctgaccaggtggtgtagactcgtctctctctgctactccctactaaaaacaactataaactctgggattaatgaaagacaaaagcaatggagaactctgaaaggtggaaagagaaagatgaaattgtctgggaccctagcatcagggatcaaccaagtgtccgagcgagcatgttaagtcctccacacgacagaagaaggtgacctaggcctgctgtttccctacacccaacctggcaataggaggaggcccagcaaagctcactcctgttctgtattgaaggggagtcccctccgcaacaacaggcaaggctggtaccactggcaaggatgatctaccaggagacttgctaccaatacagccagaggaagtacttccttctcataccaagagacaccagagtggatgtgggtgaggaggatcagcaaaggaacccaatgactaccagtgcaccacccagggtcctctttgtccctgagggcatgagactcacttccccatccagagacacaggattgaatggattcttagtgttctttgtacatactacagcagtgaacagtaataaacgacagataaccgcaataatatggaggaattgcataaatatcagataggagtgaaaaacacagacatgaaattcacagtgtatgattccctttatataaattcaaaagcaggtaaacgttatttataacattaaaagtcaagacagtgttttggagaggagtcaggataagtgatgagggcatacacaggggtggaactactagagctggaaacttttatttcatgatctgacttgtatcacaggagttcattcactttgtgatcaatctgcatgaccagatcacatcatgcccgataaaattagatagcaaaatgtattgtggattgaaagcatttctagaagcatggttttccatgaaaagcaaaaactgaaaataatcaaaagtacattagcagtatatgaattttaaaacattattaagtcaatcaattaaatactacataaacttgaaaacatataagctaaatgtatatacccacacatatggatgatttctacaaatatattatcgaccgaaagaagcttttcataaagtgtttaaaacatttacatcttaccatttcttcttcattatctatagaaagcagactggagttcttcgaagtacaggccagcaaactctcttcccaagttcttctttccttaccaatgtagtaacaactgttggaatatgtaatccactcctcaggacaatggccacaatgacgtgctaaataaagatatgaattactatctagaccaatatgaatttttaaaaatgaaaattagttcacatatttgcaaacatataaacctatacgtatgcaacatatctatacatcttcatgggctggtaaatatatagtgtcaaaatacccagtcacttatacacacatgcgcaataaagggtcagcctttcatctcctaattgtgttcccatataaagcaaaccagcaaacaaaaatccactctatacatgtcttgaaaaatcaatgaactaatctgatttttaaggaacaataaataacttgtatcttatcatattatagcagtaagaatttgaacacaacagataaaaagaaagcatagtgattttacttatagttgatgacaagtgaatgccttactctaattttatttatgaacacttattgccaaattttataatttttcacccaaaattttatttttgtacagcctaagatcaagaaaaaataaactgtacaatattaaaactttaaaaattattatatacctttctgagttcttgtattcagggaagaattgttgtgcctctgtattaatgtagctagaaaaattaaagtaatctttgtaaaaaaattagcatctaaatcaatcataataattttaagtttttgtttgaatttttttgtattatttagagttagaataatatggaataaaattgattttaagaaaaatttgataaagtaatggtggttttttggaaaagtatttcatagatctaaagaaccaaatttcaccatctcatatagttcttataattcttgatttaactactttcaaaaattaatttctatttctcagtaaggtttttcagactcctagaacatatttttgagttatgaaatccaaatatatacatacgattgcatcagaagcgaatactttcaacaattattctttcatttattctttgacaaattcagaataatcattccacatttagtccaaatatatacattacaatgagaactctattccctgaaaatatgaaatgtttagaggcacattcaatcattaacgtgaaaattccccttgtaatcttcgaaaatagacttacagggaataacaactatcgttaccacagaggccattaagataagacagataattcccaggatcccaacaatgagcttctctggagctgatggtaaatctgcagggagagaaatgggaacagtgcgaaaggagaggtggatacagtcgtttagaagattcacagacaagagaacctgaatgcacaggaatcatacagagaaacttggaccccaaaccctcatctcccattgtaatctttttctcagaataatataccattgaattttcaggaaaaataatgctccatgaattatttgacaaagactacaaacttcaacaatgagttcaatcagtcttcatactttacattgaaatagcatatctcaacttggaattctgatctttgcaaatagaagatatatgagcactcccttctctttccccacattcctgtaccccaagctgcacatcctagactgttatattgaggatcttttaaatgctttacctttgcagtgataggttttgtcattcccttgaaaatcctgagaagctttttgaaggtttaattccgcataggttatttcctgttcagttgctaaaatggagtttttattgcctttaggttttcgttgctgcctctttgggtttgggggcagattcaggtctgagtagattactccttggttatccatctctgcagtgtgtgatgtcagggactgtactctataataacagtagttaagaagttaataaatggtttatatacaggattccctagtgcaattaaaagggtgaggtggagaacgagtattggagctcattttgcattaaataatctaaagttctttctctgattttcttcaagcctaaacacgtttcttatgaatatttgttttaaaaaaagatttttaggccgggcgcggtggctcacgcctgtaatcccagcactttgggaggccgaggcatgccgatcacgaggtcaggagatcgagaccatcctggctaacacggtgaaactccgtctctactaaaaatacaaaaagtagtcgggcatgatgtcaggcgcctgtagtcctagctactcgggaggctgaggcaggagaatctcttgaacatgggcggcagaggttgcagtgagcggagattgtgccactgcactccagcctgggcgacagagtgagactccgactcaaaaaaaaaagataaattttctgcatttgacaaaatattattgctggggcaatgagaagcaataaattactaaggaataaagaagttcaggaataaaaatatatttcttaaagtctgatgttttacctgtgttaaaaattaaaatgttgtattagaaaaacttctgcactcatttttatgttaattttgaaatccagtaatggttaagactatgtggtctgcacatgagtaatagtaaagttgacatatatatatataaaaatttcttgcactacattacttttaattagtaatttatacacattaatgaaaatcaatagaggtaattaaatggtcttttcttaatggctgaaatgttctaagaaattattaaaaattatttattaaaaattataaaaaattaaatatttgtatatgacagaaaatgctatgtgacacagttaacttatgcataacctaaatagtattaggaacactacataaattgttaatacttacagaagtattggtaatttaattagtaattggtaatttatttcctggctaaattatgaaccaaaaaatgataaataaaagtataggtaattcatgttaaagcacatttcatttaaacttatagaatgattttatggttgtcaaagtgagtaaaggccactttagttgtataagtacttgtaaaatttcagataatgtaattaaatcatttagtcaatgggctctggagtcagtgagatctagaattaattctagctttgacacttataatgtgcgacctttaaaaagttattctatttttaataacccagtttgttaatctaaaatgggcataagaacatataaaacgttgcatgtaaaacatttaccactcaacctggcacttaaagttctcaataagcattagctactttaattattattttagtcacaattgttatgttactgtttctgattcatgtcagttaaagcatggaaaataaatcttcagataagtctcctatgtccatgcgctacatctttttttgcaatattttgatcaatttttaaaaagtatttttattgctttgtaatacctttagcattttatgtaatctacctcattctgatttttattaaaaataaaaactgcttttctctaatctacgtgtctgaggaattgtatttggctttcatcaattgattgatttattttaataatctttaatggctaagctaaatataaattattattcaaagatacatgatgtactgattacaaaatacaaaattaattgttcattattgtgatgttaatagctttcccttaaacgatattgatcaacaaacccactagatttccacaaacaataatttgaaaactttaagaaatccttcaacatatttcatattttaggtttttaccctgagttattcaaatgaagacagcaatattctactttgattttattgtatattaattatacctcctttgtatcatattgagcacttgaaatcacccactaaatgaggtaggctagtagagagttggagagtagcaatacataccttctgtccccagaaagtcacacatcctttagtggagaggccaggttagtctcataaaaaggcctgctatagctgtgtaataaaaggtgaaatttaaaggcataaatccaagacaagaacaaacaatgcctgcaatcttcgcagactgccctgtgaaggctcagagtgagtcaagagtggaaaaagtagatttctcatcaacgtgttactaaggtttgaacaggaaattctacacatgggctattgtgaaatcagttttatctcatcacacacctccaaaatataggatacttggtctattaaaagtacaaggttgactttgaaagtgtgtcatttagttggttcatttttcaagtgcctatgagaattttttttttttctgtcttgatcacgaacattgtcaaccctcaccttgttaagagtgccttttagactaggttgctaaatcttaacattgcatacttcttttctttatattattttattatgtcacttccattataatagaaaacattctaaaactcatagtaatattatcaactgatatctactgattttttccttaattattctgaaaaattactgcagtaattactcaattgattgtagctggcacaaaaagcatcattgccaaagttatattattaacttctcttagttcttaaatttttgcacttaatttttaaaaatagattatttaatcttcagattacccttgataaaaatatcttggataggtaaaatattaatcaattttgaaatatattagcataccagaaattgaaatattaaatagctattcattacattcttcatttattcatcctccgccataacaaattatgtcgactttcatagaaatatttagttgtaaatgacaaaaactgaagtcaaactatgtatggggaaaaagtaattttaaaatcttactaggaggaaagtcagtaaattggcagaataggtggtcccccacacatatgcccccacagcaacaataatttttcagccatccacagacaaaagttcctttgagggagtttggaattcaagtaggagtttgtaaaatgccagtggaacccaagacctaggaaggttgttttagggaatagatttgcatccaagtggcagacttaccaacagtgattccatctccagacctgaaaagggacccatcctcctgtgcttgccttcagccccatttaggccttggtcatgctgccaaaaccatttgcccaggggcccaggaggagactcacacactagtgtctcaggaggtaggcatatcaactgtagtctcaatgtagaccctgaaacagccctctaacttggctttaactagtgtcagccacaacttgagatcagtccttcacccacagagacttcctgggagacatatacatctgtacctctggggcatgc

SEQ ID NO: 676 - DNA, 8580 bp, Homo sapiens; identical to SEQ ID NO: 675

SEQ ID NO: 677 - DNA, 7344 bp, Homo sapiens; identical to SEQ ID NO: 674

SEQ ID NO: 678 - DNA, 8282 bp, Homo sapiens
atattgttcattgatttattttccaatcataacggtctgcattttaatattaatatttgttgtaaatgactaatgcttaaatcaaactatatagagagggaaaagtaatttttaaaacatcatctagttaaaaatagggagggcagaaaaagtagatttttaaaacacaagctaaatggtacatgagcactcaggggcggtggcttgtgtcagtaatcccagcaacttgggaggccaagatgtgttgatttcttgagctcaggagttcaagaccagcctggtcaacatgatgaaaccccgtctctacaaaaaaatacgaaaattagccagcatgatggtattggcctgtagccagctactctggttgctgaggtgggaggatcgcttgagccttggaggtgaggtcgaggctgcagtgagccgagatgaaatttactgaaattggggaaatatacttcataatgataaattaattttccaaaccattagtaatatattttttatcattgcatatacctaatgatacaagttcaacatatagttgaataaagtgaacaagtaaacaatcataaatgggatttttaaagactcttctcttgatgcttaatacaagacaggccagtgagcctatagaaagatttaaactagacaagtaaccatcactcatatgaatgcattcacacacatatactcacacggatactcaatttcaatgtagtaccgctagccaagcttggctaggagacagttgaaatgtagctattcaaatttaacattaattaataaaaataaataacatttaaaaccagtacctcaccacatgagccacatttataaagggatgaagaacatttccagtttaatagaaaatgttctaactatattttacctacaacagaagtcaataaacaaaaatctgagaaccttatatggtttttaattcagtaatatatgtcaaaataacatatgggccaaagaaattatcaagatgaatggtcacaaaggactactaagggaagattttgaaaaggcacagatattttattcccagtttaaacatggcaataccattatggtctttacagttattaaacaggcaataaaactatattatcaatgcattttaatgtccatatgaaatagaaaattcctgggaaatgctcattaccaaaatatagtacctcaaatagaaatctgagtaaaccctacatgtattgaagaaattcagtttagccataaacttttctacaaaaatagcctgcaaactcagatggcataactagtgaatgataacatttaaaaataaagcggtactctttattattattattatattttaagttctagggtatatgtgcacaacgtgcaggtttgttacataggcatagatgtgccatgttggtgtgctgcacccatcaactcatcatttacattaggtatttctcctaatgctatccctcccccaaccccccaccccccgacaggccccggtgtgtgatgttctcctccctgtgtccatgtgttctcattgttcaattcccacctatgagtgagaacatgcggtgtttggttttctgtccttgtgatagtttgctgagaatgatggtttccagcttcatccatgtccctgcagaggacatgaactcatccttttttatggctaaagcagtactcttaacaaatgcttccaggttatagagaaacagaaaatcttcccaagatagccttgagaccaaaactttttcaagtacatagctacaaataaaaacgtggtcaaatatccttgtgaacatagatgaagaaacatatcttaccctagatatagtagtatgtgcactgatattttataaggggcaatatacaatgatcagcatggatttgtttcggaaacaaagcctagtttaacatttgacaaaaataaaattattttataaaatgttgtataaagaaaacatatatcattctaagtaataaaaaataaaaatgttacaattgataacatctattgaaaaaaggaatattataaaaccacttcaatataagaaagatatgatgaaaaaaacaccaaactttgtaaatatgaataatatgttgaattattttttgccaaaaccagaaaatgatacatatgatacatgtaaaatttgattgtaccttctattcaactctggatataaagtactagccagagaaaataaatgaagaaaaaataagttgtggcacatggatagaaaaaataaaagtgtgattatttgcaggacacaggcaggggaacatcacacacaggggactgttgtggggtggggggaggggggagggatagcattaggagatatacctaatgctaaatgacgagttaatgggtgcagcacaccaacatggcacatgtatacatatgtaacaaacctgcacattgtgcacatgtaccctaaaacttaaagtataataataataaaaaaagaaaaaaaaagaaaaagaaaagaaaataaaattgctgtttatatagaaaatccagaaaaatctgtttgaaatgatagatttaaatatgtaaaataagtgaaaatgcagacatcagttgtatttctatttacagtaacaaaagttattaaagggaatattaaaatcagaatgctatttacaaaagcatgaatgtaaaatatctgcatttctgtatgattcaaacccccaaaatacataatatgatagagagaaattaaagaaaaccccatacattgaacccagtacattgaaggacacaatatgatattgtatggaaatgtcaagaagctaatctttaaaaattactttagagattaaatgcagactcaagcaatcccaggacagtatatatttttgttttggacagcttcattgaggtacggtgcacatagcataaatttcatccacttaaaatgattaaaaatcagtgatgtttagtgtattcacagagttacaaccatcactgctactgaaatttagaaagttttcatcactgacacaaagaaacattctagcaattagtggacacctcctatttcaacctcccttaggcattagcaacgctattttattttctgtctccatggttttgcttgttcttgatacttcatataaactgaccaacataacatgcaacttttaggaagcctgaatgccacaaacatcacgttcagcaaaatgagcctgacttaaatgcgagggtatctgtacttccgtaattgtgtgtattatatttcaataattgatttggaattttcttattattagagcaaataacacaattcattttaaggcttatgcaatcataatatcatttctgtttgaacaaatataaaattttatctgatgcactgcaagctcaagcgctttaattctaaagcttatgctcacaatgattcttgaagatccacactggtctgatataagtccacgtacatgtagcattgcacagttacgttcagcatgatctgagtcttttatcctgtaatggagaaaaatccataattctgttacattttatgcaaatgacccatgagacaaaagcattttccatgtactgtaagaaaataattttatgaaaaagggtaattaaatttttcatatgctattactaaaagtcattattctgaacactcaatacagtactcccccttcatccacgggggatatgtttcaagaccccactgaatgtctgaaatagtacagaacctatagagagattatgttttctctacacattcataactgtgataaagtttaatttaaaaattaggcacaataagagattgacaacaataactactaataaaaaattgtaagcaatataccaacagcactactattgtgctttgaggatattcttaagtaaaataagggtgactttttaatgaaaacaagcactgcaattccctgatagtccatctcaagcttgtctaacttacggcccatgggccgcatgtggcccaggaagctttcaatgcggcccaacacaaatacataagctttcttaaaacattctgagatatttttgcaatttttttgtttagctcatcagctagcgttagtgttagtgtcttttatgtgtggcccaagactcttcttcttccaatgtggcccacagaagccaaagattagacacccctggtccatctcataaccaagaaagttactagctgaccaatgagtggtggacatatatggactactatggtctattgtaaaatatttgtatcaacatttcactaactttccacatctttcttcatatcaatgattccacatagatttattcatattattcttctgaatttatcctttatatttttttatatagcaccctataaaacaacttactcatgtttgaaagccaaaccatttattgtcacccatggatgatgactgctgttacgaaacacaccaatccatgaggaaggtaaaatgctggccagaaatttctaaaagaaaagaaataattttcacttaaataataattatgaaaacattacaaaaacaatatattaaagttgaaaaccactatttgcagtgccaaaaactttcataaatgtttgaattttttatttaaatgaactcttcaacgtttatacttagtactttcattcttattctcatgttaataaagacattttaattcttgcaatgtaatagttactccaattaacagaataaacacaggaagggttttaataagtttcctgatactgtgcattcatttctccagatactgtgactaaatcaatctatttttgtgctatatttctcagagttggagatttagaagggaattgaggggttgtcattcagaaataaatgacatggaagctacagattgggtttccttggtaccacaccattctttaactagataagccctcaatttttatccgattcggtttttgtggaataacaggggtcctggccaggtggtgtagactcgtctctctctgctactccctactaaaaacaactataaactctgggattaatgaaagacaaaagtaatggagaactctgaaaggtggaaagagaaagatgaaattgtctgggaccctagcatcagggatcaaccaagtgtccgagtgagcatgttaagtcctccacacgacagaagaaggtgacctaggcctgctgtttccctacacccaacctggcaataggaggagggtatcgaaggagagtcccctccacaataccaggcaaggctggtgccactggcaaggatgatctaccaggagacctgccaccaatacggagctagagaaagtgcttccttctcataccaggagacaccagggtggttgtgggtgaggaggatcaggaaagggacccacgactaccaatgcaccatccagggtcctctttgcccctgagggcatgagactcacttccccatctagagacataagacagaatgaattcttagtgttctttgtacatagtacagcagtgaacagtaacaaactacagataaccgcaataatatggaggaattccacaaatatcagataggagtgaaaaagacagacatgaaattcacactgtataattccgttttttataaattcaagaacaggcaaaccttatttataacttcaaaagtcaagacagtgttttggagaggagtcaggataagtgatgagggcatacacaggggtggaactgctagagctggaaacttatttcatgatctcacttgtatcacatgagatcattcactttgtgatcaatctgcatgactagatcatatcatgctcaataaaattaaatagtaaaatttattgtggattcaaagcattaatagaagcatggttttccataaaaagcaaaaactgaaaataaaagtacattagcggtatataactttaaaaacattattaagtcaatcaactgaataatgcatacacttgaaaatatataagctaaatatatgtacacacatatggatgttttctacaaatgtattattcactgaaagaagcttttcataaaatgtttgaaacatttacatcttaccatttcttcttcattatctatacaaagcagactagaagagttctttgaagcacaggcctgcaaactctcttcccaagttcttctttccttaccaatgtaataacaactgttggaatatgtaatccactcctcaggacaatggccacaatgacgtgctaataaagatatgaattactatctagaccaatatgaatttttaaaaatgaaaattagttcacatatttgcaacagtataaacatatatgtgcttaacatatttatgcatccttacaggcttataagtatatattttttaataactgagtcagtcatacacacatacacagaaaagggttagcctctctcccctaattgtgttcccatataaagcaaaccaacaaacaaaaatacactccacacatgtcttgaacctcactgatacacaactgcttttttagaatagtaaaattatttatttggtatcatctcacagcagtaggagacttctgttaattgggagaaagagggtagaatgattttaagtgagtatttctacttactggagaaaaggaaatgctgcctcataatctttctttataaatatttatggctgaatttatggcttattttctgcaaaaatgccactattcttttacatgccttaaaacagacacaaaatataaattgtactaatatcagagcattgaaaataaaaatgtacctttctgggttcttgcattcggggaagaattgttctgctccaggactgtaatagaaaaattaaaatgatttttataaaaactgatatctagataaaccataatgagtttagtttcttactttgaaactttgtgtgttatttaaaatggggagaatctttaataaaattaactttttctataaaaatatataaagtaatagacctttgaaataaacatttttaaagactttagcacaaaacttcaccatctcttgtagtatttgatgtaaccactttcaaaaattagtttttctaaatacttttcttctatagcatgcctttgaattatgaaatcagaaaatatctttgtgtgtgtatgtatatacatatatatagattacacacaaaaaataaacacatgttctctacaatgattttgttatttatgttgtgaaaaattcagaataaccatattattttggttccaaattgtactaatatcagaactttgaaaataaaaatgtacttttctgggttcttgtatttggggaagaattgttctgctccaggactgtaatagaaaaattaaaatgatttttataaaaagtaatatttagataaaccataatgagtttagtttcttactttgaaactttgtgtgttatttaaaatggggacaatctttaataaaattaactttttctataaaaataaatgaagtaatagatctttgaaagaaacagtaaaataagagttctattcttcaacagtatgaaatattttgaggcacttccaagcattaaagtaaaacgttcccttctaatctttcaagaatatgcttacaaggaataagaactattgtttttaacacagtggccatcaggacaatgcaaatgattcctaggacctcggcagtgagcttttctggaggtggcagtaaacctgcagggagagaaatagaggcactgagagaggggagatagagagttgattaggattacatactagagaattacatactagagaacccacatgcacagggaaacataatgataaactctggccgctaaatctacatctactctagtaatctttctctcagaatataccatttcattttcagtaaatgtaatgttccatgagtggattgcagattacagttgattacagttgaacaatgcctgaataaaattagtcttctgatttcatattagaatattagatcccatttatgaactctgattctcacaagtgtaaaatattccctaatctttcctcacccttctgcattcaactgcacatcccagaacaataacattgaagatatatttaatgttttaccttggcagtcatatattttatcaatcccttgatgattcagagaagcattttgaaggtttaattctacttggaatatttcctgttcggttcctgaaatggagcttttattgcctttaggtttcctttgctgccactttgggtcctgggccagactcacttctgagaaggttcctctttgtttactcatctctgcagctgtgtgatgtgagggactgtgctctatgataactgc

SEQ ID NO: 679 - DNA, 5013 bp, Homo sapiens
caaataacacaattcattttaaggcttatgcaatcataatatcatttctgtttgaacaaatataaaattttatctgatgcactgcaagctcaagcgctttaattctaaagcttatgctcacaatgattcttgaagatccacactggtctgatataagtccacgtacatgtagcattgcacagttacgttcagcatgatctgagtcttttatcctgtaatggagaaaaatccataattctgttacattttatgcaaatgacccatgagacaaaagcattttccatgtactgtaagaaaataattttatgaaaaagggtaattaaatttttcatatgctattactaaaagtcattattctgaacactcaatacagtactcccccttcatccacgggggatatgtttcaagaccccactgaatgtctgaaatagtacagaacctatagagagattatgttttctctacacattcataactgtgataaagtttaatttaaaaattaggcacaataagagattgacaacaataactactaataaaaaattgtaagcaatataccaacagcactactattgtgctttgaggatattcttaagtaaaataagggtgactttttaatgaaaacaagcactgcaattccctgatagtccatctcaagcttgtctaacttacggcccatgggccgcatgtggcccaggaagctttcaatgcggcccaacacaaatacataagctttcttaaaacattctgagatatttttgcaatttttttgtttagctcatcagctagcgttagtgttagtgtcttttatgtgtggcccaagactcttcttcttccaatgtggcccacagaagccaaagattagacacccctggtccatctcataaccaagaaagttactagctgaccaatgagtggtggacatatatggactactatggtctattgtaaaatatttgtatcaacatttcactaactttccacatctttcttcatatcaatgattccacatagatttattcatattattcttctgaatttatcctttatatttttttatatagcaccctataaaacaacttactcatgtttgaaagccaaaccatttattgtcacccatggatgatgactgctgttacgaaacacaccaatccatgaggaaggtaaaatgctggccagaaatttctaaaagaaaagaaataattttcacttaaataataattatgaaaacattacaaaaacaatatattaaagttgaaaaccactatttgcagtgccaaaaactttcataaatgtttgaattttttatttaaatgaactcttcaacgtttatacttagtactttcattcttattctcatgttaataaagacattttaattcttgcaatgtaatagttactccaattaacagaataaacacaggaagggttttaataagtttcctgatactgtgcattcatttctccagatactgtgactaaatcaatctatttttgtgctatatttctcagagttggagatttagaagggaattgaggggttgtcattcagaaataaatgacatggaagctacagattgggtttccttggtaccacaccattctttaactagataagccctcaatttttatccgattcggtttttgtggaataacaggggtcctggccaggtggtgtagactcgtctctctctgctactccctactaaaaacaactataaactctgggattaatgaaagacaaaagtaatggagaactctgaaaggtggaaagagaaagatgaaattgtctgggaccctagcatcagggatcaaccaagtgtccgagtgagcatgttaagtcctccacacgacagaagaaggtgacctaggcctgctgtttccctacacccaacctggcaataggaggagggtatcgaaggagagtcccctccacaataccaggcaaggctggtgccactggcaaggatgatctaccaggagacctgccaccaatacggagctagagaaagtgcttccttctcataccaggagacaccagggtggttgtgggtgaggaggatcaggaaagggacccacgactaccaatgcaccatccagggtcctctttgcccctgagggcatgagactcacttccccatctagagacataagacagaatgaattcttagtgttctttgtacatagtacagcagtgaacagtaacaaactacagataaccgcaataatatggaggaattccacaaatatcagataggagtgaaaaagacagacatgaaattcacactgtataattccgttttttataaattcaagaacaggcaaaccttatttataacttcaaaagtcaagacagtgttttggagaggagtcaggataagtgatgagggcatacacaggggtggaactgctagagctggaaacttatttcatgatctcacttgtatcacatgagatcattcactttgtgatcaatctgcatgactagatcatatcatgctcaataaaattaaatagtaaaatttattgtggattcaaagcattaatagaagcatggttttccataaaaagcaaaaactgaaaataaaagtacattagcggtatataactttaaaaacattattaagtcaatcaactgaataatgcatacacttgaaaatatataagctaaatatatgtacacacatatggatgttttctacaaatgtattattcactgaaagaagcttttcataaaatgtttgaaacatttacatcttaccatttcttcttcattatctatacaaagcagactagaagagttctttgaagcacaggcctgcaaactctcttcccaagttcttctttccttaccaatgtaataacaactgttggaatatgtaatccactcctcaggacaatggccacaatgacgtgctaataaagatatgaattactatctagaccaatatgaatttttaaaaatgaaaattagttcacatatttgcaacagtataaacatatatgtgcttaacatatttatgcatccttacaggcttataagtatatattttttaataactgagtcagtcatacacacatacacagaaaagggttagcctctctcccctaattgtgttcccatataaagcaaaccaacaaacaaaaatacactccacacatgtcttgaacctcactgatacacaactgcttttttagaatagtaaaattatttatttggtatcatctcacagcagtaggagacttctgttaattgggagaaagagggtagaatgattttaagtgagtatttctacttactggagaaaaggaaatgctgcctcataatctttctttataaatatttatggctgaatttatggcttattttctgcaaaaatgccactattcttttacatgccttaaaacagacacaaaatataaattgtactaatatcagagcattgaaaataaaaatgtacctttctgggttcttgcattcggggaagaattgttctgctccaggactgtaatagaaaaattaaaatgatttttataaaaactgatatctagataaaccataatgagtttagtttcttactttgaaactttgtgtgttatttaaaatggggagaatctttaataaaattaactttttctataaaaatatataaagtaatagacctttgaaataaacatttttaaagactttagcacaaaacttcaccatctcttgtagtatttgatgtaaccactttcaaaaattagtttttctaaatacttttcttctatagcatgcctttgaattatgaaatcagaaaatatctttgtgtgtgtatgtatatacatatatatagattacacacaaaaaataaacacatgttctctacaatgattttgttatttatgttgtgaaaaattcagaataaccatattattttggttccaaattgtactaatatcagaactttgaaaataaaaatgtacttttctgggttcttgtatttggggaagaattgttctgctccaggactgtaatagaaaaattaaaatgatttttataaaaagtaatatttagataaaccataatgagtttagtttcttactttgaaactttgtgtgttatttaaaatggggacaatctttaataaaattaactttttctataaaaataaatgaagtaatagatctttgaaagaaacagtaaaataagagttctattcttcaacagtatgaaatattttgaggcacttccaagcattaaagtaaaacgttcccttctaatctttcaagaatatgcttacaaggaataagaactattgtttttaacacagtggccatcaggacaatgcaaatgattcctaggacctcggcagtgagcttttctggaggtggcagtaaacctgcagggagagaaatagaggcactgagagaggggagatagagagttgattaggattacatactagagaattacatactagagaacccacatgcacagggaaacataatgataaactctggccgctaaatctacatctactctagtaatctttctctcagaatataccatttcattttcagtaaatgtaatgttccatgagtggattgcagattacagttgattacagttgaacaatgcctgaataaaattagtcttctgatttcatattagaatattagatcccatttatgaactctgattctcacaagtgtaaaatattccctaatctttcctcacccttctgcattcaactgcacatcccagaacaataacattgaagatatatttaatgttttaccttggcagtcatatattttatcaatcccttgatgattcagagaagcattttgaaggtttaattctacttggaatatttcctgttcggttcctgaaatggagcttttattgcctttaggtttcctttgctgccactttgggtcctgggccagactcacttctgagaaggttcctctttgtttactcatctctgcagctgtgtgatgtgagggactgtgctctatgataactgc

SEQ ID NO: 680 - DNA, 10935 bp, Homo sapiens
cggataacaacttccgctcgggaagtttgtaaaagtctgggctaccggcgcggcgtagtggatgcagcatcctagtggaggacgcccctgtggtgagtgcgcccgtgtcccccgccgcccctccgtccctgggtcgtgggctgtcaaaccttctaattctgcggccgccccagggctgtgagacccagcgtcgcggctgctgggacagaccggggaggctgcccgtgccctcggctattcgggggctgttcttcagcttcttccggctcggcctcctcttctctcctcgctccttacacttgcaggtttgtcaggacccggttgcgtatcctcttgaagctggtttcttcctggccgaccccgtccgcgatcgtgaccttagttatccctcatagacactttccacacctgtgtctccagccctatcgctccgatgagacccgagcgcttagacttgattcataacacccaaagctccccggccccaggctgagctcctgcaacctccacaccccaccctctggtcctcccaggcattccaccgcgaaggggaggaggcagaaacccgagattcgcttcttctcctttcctgcccacgcccagccacacagtcactggtgcgttagctccataactgaaccatttgcctccttgccattcccaccctgtaagtcccaatcctggccgtcttcctctctcacctgaacgcctccctgtcttctccccacccccatcctgttttgctgctttctcatttgttcatcacagaggatcttttataaaatgtagcttagccaggcaaggtggctcccgcctgtaatctcagctcttgggaggccgaggcaggtggatcacttgagtccaggagttctagaccagcttggtcagcatgttgaaaccttgtctctacaaaaaatacaaaaattagccgggtgtggtggtgcacgcctgtaatcccagttactctggggaggctgaggcaagagaatcgtttgaacccaagaggcagaggttgcagtgagcagagatcgcgccactgcactccagcctgggcgacagagcgagacatcatcttattaaaaaaaaaaaaaaaaaaaaggtagcttaggccggatgctgtggctgacgcctgtaaccccagcacttggggaggctgaggccagaggatctcttgaggccaggagtttgagatcagtcttggcaacatagtgagaccccgtttctgcaaaaaacttaaaacaattgcagggcatgttggcacatgcgcttttggtcccagctactggggagactgaggtgggaggatcacttgagcccaggaggtcgaggctgcagtgagctgtgattgcactactgcattccagcctgggtgacagagcaaggacctgcctcagagaaaaaaaaatcctgtgttaatttgcctaggggaaaaaaagtagctatgacaatatccttctgttctcccgtattaaactttgttgcattacacatgaaaccacggctcaggaggccttgaggaatctggctttagcccctttcctggcctatctcacggttctccctgactctgctttccaggctgggaagcccagtccaggttgtgcaaacacagctgttgagctgaggggagagggtgttttttttttgtttttgtttttgttttttttgagatcgtctcgctctgtctcccaggctgaagtgcagtggcataatctcggctcactgcaacctccgcctcccgggttcaagcagttctcctgcttcagcctcccaagtagcctggctaattttttgcatttgtagtagagatggggtttcaccatgttggccaggctggtctcgaacttctgacctcaggtgatccacctgcctcggcctccccaagtgctgggattacaggcgtgaaccaccgcgaatggccgggagctgttatttttatcactgtggtcattgctacttgctagaggaactcagcaaggtgttctaattggaaaacaccacccatgacccatgtgctcagtgtgccttttcatgtttttatagaccgttgtataactttggttgaagtgtctgttctaatattttgcccagtttaaattttatttctcttttttattgatttgtaggagttacaattctttatataagtcctttgtcagatacatgtattgggaatattttctcttagtctgtggcttacctttgtgtctctttttagaaaaaaaaatttaaacaatagagacagaggtctccctatgttgcccaggctggtctcaaactcctggcctcaagcaatccccctgccttagcctcccaaagtgctgggattacaggcgtgagccactgcaccccgtctccttttttttttttcttaactgccttggtaaacaaaaatttttaattctgataaatccaatttgtgatttttttttttttttgagacggagctttgcttttgttgcccaggctggagtgcaatggcgcgatatcggctcgccgcaacttctgcctcctgggttcaagtgaatctcctgccccagcctcctgagcagctgggatgacaggcaagtgccaccacgcctggctaattttgtatttttagtagagatggggtttctccatgttggccaggctggtctcaaactccgtacctcaggtgatccgcccacctcggcctcccaaagtgctgggattacaggcgtgagccactgcatccggcctgaatttgtaattttttaaaagtgcttttagggatccatgaaagaaatgtttgtctaccccaatgttgtgaagatggtctctctgtgtcacccaggctggagtgcagtggcacaatcttggctcactacaacctctacctccagtttgtgttttttgtttgtttgtttttgtttttgtttttaagacggagttttgctcttgttccccaggccggactgcaggggtgcgatcttggctcacagcaacttccacctcccgggttcaagcgattctcctgcctcagcttcccaagtagctgggatgacaggtgcctgccaccatgcctggctaatttttgtatttttagtagagacagggttttgccatattggccagactggtctcaaactccccacctcaggtgatccacccgcctcagcctcccaaagtgctgggattctaggcatgagccaccacgcccgacctacttctttctttgtaatcttatggctttatgtgttttttctacctccttgcactgactcaggcctccaataaggtgacagagagaagcagtgggcagacagccctgctttttcctggtctcagagggaaagagctccgtagtggcccatgaagcaggatgttggttgcaggtctgccgggttgaagaagttctcttctgttccttgtttgctgagagtttttgttgggattaggtgttgaattttaacaaatgccttttctgcagctattgagataatagctgttatatggttttctcctttattctgttaatttggttagttatatcattttcttttttttttttttttttttgagatggagtctcactctgttgcccaggctggagtacagtggcgtgatctcggctcactgcaagctctgcctcccgggttcgtgccattctcctgcctcaacttcccgagtagctgggactgcaggctcgtgccaccacgcccggctaattttttgttttttagtagagatggggtttcaccgtgttagccaggatggagttatgtcattttcaaatgacagcaaatgttggggattaacattgtgattaaagttgatgctatgctgttgaaagagtgaaaaaaaaatatcaagttgaaaagcatattcatgaaaacatgtagcagttaatgtaaccacctgtgagtgtcagaaggagaaagggaatgtctgtgtacctgctgtgctggaggtgggagggacgaggggtcaggggtgaacgccgagggagccgccccatgcagtgagtgttgagtgcaggtggtggagggagcctcctgggcaccaactgcagttaatggggatcaaaccagctgtgtactcttagggtccatgtcacttggtcatgacagagaattctttttataaactgctggatttggcttcctaatattttttgagaatttgtgtttatgagagtttggtaggtaatttttttgtaatatctttttttttttttttttttttttcagacagcgtctcagtctaacatccaggctggagtgcactggcatgatctcagctcactgcaacctccgcctcccatattcaagcagtccccccacctcagcctcctgagtagctgggactgcatatgtgcactgccacgccccgctaattattgtattgtttatagagacaggctgggcaactgctgggctcgaacagtcctcctgcctcagcctcctagggtgttaggattacaggcgtgagccactgtgcttggccccttgtaatatctctgtcaggttttcggtttgggttttgctggcctcattaagacagactggatagcgtctgctcttcctctgttcactaaatagcttctaagatcagtactgtgcttccgtaggctttggtggagtttaccagggaatccagctgggtgtggtattttctgtgtgggaagggttccagttacattttcaattgccttatcagatggaaggcttccctttcttttgtcagtttcatgatactgtgtttttcatcgagtttgtctgtttcatctcagttgctgaacctgtttgcatgagttgctcctgacggccctttaggatacttccatgtctgtagggtctagagtgacatctcctcccctcccctgacgaggtaaccaggcatgggctatcttcctccagctggttctgtctcttctcaggggtgcctgtggggctggcctcttctgcatcttggggctctgagctttactcacgaaggaggcaggacccactgtggcaggagggcagtgggatgccagggtggttctctacagacctgggggtagaagctggatctcagcgggctggggccctaaggtttaggggatcttgtggcttgatctggagactcagtgaacattattggggtttctcggggctgcaccaggttttcacttgggggaaggctgcgaggtggcctccttgtagcgtacccgagagcatcctcctggcacagtgctgtgggaacgggctgcccgcctgtctcctgaggaggagcctccgctgcctcagttgcggttagactctccagtcatgtgtttgcagctaagctgttggctttcagccagcaatggctggcctgtcctcctctggtgacaggcctggcttgctgtctggtatttcagagttcttgtttgtggaggtggcacactgtacccagctgtcccttaaagatatgttggcccctcaccactgccaagtttccccacacctggtggctgtcagtagttacagagcagaccctgtgtgtgcatcactcatttttcctgaattccccgtgatttgctgagtgggggggctcctggggtcaggtgcggggggcattcccaggccggctatacccgcttacatttcttgtctccccagatctgccctccttggcactgtgcttccccagaggggtggcctcgctgttcccatggacatggcccaggtgagccctgctgctgccgagcgcagcctcccttctgccctgctggctgcctgagaccccagcacacacgcggggagggtctgtggcagtggcttcccaggcactgtgcccgtgtctgcctttctgccttctctcttaaggggtggggaaagaaaaagaaaattggggccaggcgcaatgcctcacgcctgtaatcctagcactttgggaggctgaggcaggtggatctcgaggtcaggagatcaagaccatcctggctaacacggtgaaaccccatctctactaaaaatacaaaaaattagctgggcacgcacctgtaggcccagctactcgggaggctgaggcaggagaattgcttgaacctgggaggcggaggttgcagtgagccaagatcgtgccaccactccagcctggtgacagagcaagactccgtctcaaaaaagaaaaaaaaaaagaaaagaaaattggattcattgacactaggagagtagtggctgttgtaggaaagtagactagattctcttagtccactagagctaccgtaaccaaacatgacacagtgggtggtttacacacatgcacttcctctgttccaaaggctgacgtccaagatcagatgctgcagatctggtttctggtgggggccactattgtgctgtgttcacgcgtgtgcggggagggagccggggggctctctggagtctcctgtgaggaccaggtccatgggtcagggcccctcccttctgacctcacttaaccttaatctcttccacagaggcccatctccagacacagccactcggggctctgggcttcagtgaatggatttaggggacacaaacaatcagtccaccgcagggccactcccattcccccttcccacccagacctgtgggctgagccttctttttcttgggaatggcctcttcgggagctgtgtgtgttgcaggagccagtgaccttcagggacgtggccatctacttctcaagggaggagtgggcgtgtctggaacccagccagagggccctctaccgggacgtgatgctggacaacttcagcagtgtggctgctctgggtgagcacgggctgagcgcagcgtgagcacagggtgagtgctgggagagctctgccgctgcctctgggcccagctcgtccaggacagtagtggggcctcccagctgagggggctcaggagctagaagttattggcttatgtagacagaggggcccactcagcgtttctctcgggctccctggaggcagcctcatcttccttcctctgaccttgccagggccttccgtgggccttggtgtccaggcccctcccttcctgtcatctctgctttggggtggcttctccagggcctcccgagggctggcctggcgtcttaggctgatgcacaactgctctgagcctcgaccctcactttgtcctcagtacaagtaaaacagaaacttttctctcctttgagaaggattttgcagccccagaccagacctcgtctctcgcctggaacagtgggaggagccgtgggttgaagaccgggagagacctgagttccaggcagtgcagaggggaccccggccaggtgagtgctgggctgtctgggctcggcgggccccgtccctgtggcccacagctcctgggtagtgctcagcacgctgcagtgaccaagggtgtgtccttcccatgggagagcagacacacagctgctctctaaattagacaggcattagagacgtaggggcagccacgctcctgccctgatggacactggccgggggtggggctcgaaaggcatagtgctgcaggatgacatacagctgcagctcggaggggcctgaggctggagtgacacttgaagcctgcacctagccacccaggtgctgtccggcggaggccattggtgtgggtgtctgacctccctgtgatggccatgtggggtcccaggcctggtactgactgcacgtgagggtctccaggtatgtggctctgggtaggagtttgctccacgtccttgtttgcaaaactgggacagtggccatgcttccctccattaggtgagggttgctcttggggcagttgtcagcagggttttgctttttacttacattttcagagtgggatggagcagctatgtgaacacgagccctgggaggtccccgggtatgtggagtccccgactgtggagtgtcaggttcctaggtgtgtggagcccccgactgtggagtgtcaggtccctgggtgtgtggagcccctgactctggagtgtcaggtccccgggtgtgtggagcccccggctggggaggtgtcggatccccgggtgtgtggagcccccggctggggaggtgtcggatccccgggtgtgtggagcccccggctggggaggtgtcggatccccgggtgtgtggagcccccggctggggaggtgttgcatccccgggtgtgtggagcccccggctggggaggtgtcggatccccgggtgtgtggagcccccggctggggaggtgtcggatccccgggtgtgtggagcccccggctggggaggtgtcgcatccccgggtgtgtggagcccccggctggggaggtgtcggatccccgggtgtgtggagcccccggctggggaggtgtcgcatccccgggtgtgtggagcccccggctggggaggtgtcgcatccccgggtgtgtggagcccccggctggggaggtgtcgcatccccgggtgtgtggagcccccggctggggaggtgtcgcatccccgggtgtgtggagcccccggctgaagggagccatggctctgaggctgagtggttgagaatcaggtggagctacccgtcttctagacgacatcctagcaccacctccacccgcatgagtggggcctgctggcgtggacagggtgaaaggacattctcttggcccagttgcttctgttggttggcaggcatgtgtcggctctccctcacgtcagcagtgccgggtggcctgcgtaccaccggggctggggaagcatctgagctcatcttggcttccgctgttgatacctgtggctcatctgtgtttctttgaacgagttttcctgatcactcgtaaccatgtggaatgagctgagtcaatggaagccagtccacgcacacagcaggagggtcctctgggctttttttttttttttgagacggagtctcgctctgtcgcccaggctggactgcggactgcagtggcgcaatctcggctcactgcaagctccgcttcccgggttcacgccattctcctgcctcagcctcccgagtagctgggaccacaggcgcccgccactgcgcccggctaattttttgtatttttttttttttagtagagacggggtttcaccttgttagccaggatggtctcgatctcctgacctcatgatccacccgcctcggcctcccaaagtgctgggattacaggcgtgagccaccgcgcccggcctcctctgggctttgctggaggcactgcctggctgtgggccactggctctgtgtaagggtgtctgttccttccacaggggcaaggaagtctgcagaccccaagagaccttgtgatcatccagcttgggctcacaagaaaacccacgtgcggcgagaaagagccagggaaggaagcagctttaggaagggcttcaggctggacacggatgacgggcagcttcccagagctgctccagaaaggacagacgccaagcccacggctttcccgtgtcaggtgctcacgcagcgttgtgggcggcggccgggccgcagagagcgccggaagcagcgcgcagtagagctgtcattcatctgcggcacgtgcgggaaggcgctcagctgccacagccggctgctcgctcaccagacggtgcacacgggaaccaaggccttcgagtgccccgagtgcggccagaccttccggtgggcttcaaacctgcagcgccaccagaagaaccacacgcgcgagaagcccttctgctgcgaggcctgcgggcaggcgttcagcctgaaggaccgcctggctcagcaccgcaaggtccacaccgagcacaggccctactcgtgtggcgactgtgggaaagccttcaagcagaagtccaaccttctcagacaccagctggtgcacaccggggagcggccgttctactgcgcggactgcggcaaagccttccggaccaaggagaacctcagccaccaccagagggtccacagcggggagaagccctacacctgtgccgagtgcggcaagtccttccggtggcccaagggcttcagcatccaccggaggctgcacctgacgaagaggttctacgagtgcggccactgtgggaaaggcttccgtcacctggggttcttcacgcggcatcagaggactcacaggcacggggaggtgtaggggcgcccgaagagtggggtgctgcgcctctgcgggagtactgggtcctgagggagagctgcagtgagaagttgctcttcagcctggaaaatcaacctgaattcagagaagccttcttagtcctcagagctccccagtcccccgagaagtttactgggaaaactgccaggtgggagaagcagagccatgggtacgccggagatggcgggggctctggagatggcgggggctgcgccccggcgccgggcatcctggggatgtgctgagagtgtgcgcgaccccggagccacgtgccaggccgggctcagaggcggagaagcctgcctggtgcccacagccgtctggctcagggactccaccctggccccgagtcgccgtctgctgggcctttccttcctggctctgcaccccatgctggctgcccggtctggcttcccttcttgtctctgtcttgggcgaggcagctgtgagcattgcacagaggcaaagaccctcctgcagcctctgcgctgggccgtagaaacaagagcctttgtaatactgaacctcattcaaggattaggagtggtggttaggtcagggccacccccagtgctgcaggaacggcctccacccagctctgttggtcagagcctgggtcatgcacctggagttgggagatcaagttgggtctcagggcagtgaggtggccatatccaccacatcgcatttcgtgggggaagaggtgacctctttgttttaaacttaaggtgtctgcttatccagccagaaataaaaatctgccagtggtgttcccaagggaagacccccgtgggaatgggtcgggacactgccgtgtttcaggttagccaatta

SEQ ID NO: 681 - DNA, 1300 bp, Homo sapiens
caggtggggacggagcagctggtgtctcggcagtagatgcggcggatcataaggacttgggttttgagcgccctgcaggaagccactggccgcgtccagggtcacctgtgcctggtcgttagtccctcacaatgctgtcactttgtgacgctcttgtgcaggattaaatgtgaacagcagagacgtgggtgatgcgctgcctcgtcagatgatggtcagttgtccaagcgggctgccttgctcttggtggcctcatcatccagggctcacacactggatggttgggccacagtcgcggtaccccccgggctgcaggctttccaccctgcttagcagggctccagggctccgggtagagcagggggtccctcccttggcacttccccagggaggagcacgaccgtgctcagctgcggtcaggctgctgctcttagttgtctttccttctaacactcaggcttcccttcctgcctcctgggtcgctgaagaaggtcaggtccacagaaaaggcctggggagagaatggtggtgaggagcccatgggggtgtgaggggccgggaggctctgcatcttgccctgttggcctcctcaccacccaggcgggggtggggtgacagaaggggctcacagcaggtgtcccgtaaggagcatcttccttcctggggccagcagccgtcactccctgtgagcctgtagagccgagttttctctgcatttatcttgggcagagaatgcatgaagctacttcgcggccagaatgggtgcacagcagggtccgttgacagccatgcctgtgacctagccttccacccctctgtctccaggggacacttgcctggcctttgtgttagcgctcagcacacatgtgtccagtgtaaagtccaccaagattagcagggcatggtagctgccgcctgtaatcccagcttctcaggagtctgaggcaggagaattgcttgaacctgggaggcggaggttgtagtgagccaagatcgtgccactgcactccagcctgggcgacagagtgagactccatctcaaaaaaaaaaaagtccgtcgagagagcaggtggcggatgcagctgagagctccaggaatgggagggccacgtggtagccactggcagccttgactgaaagatgaaggagtccatggtgctaggaggaggagttgcatcccagcaggctcagctcctggagctgcctctctgcactctgaagggaggcccagtggctgcaatattcttctttgggaagtacaatgccaagtaaataaagatatttggggtcattctagtta

SEQ ID NO: 682 - DNA, 10935 bp, Homo sapiens; identical to SEQ ID NO: 680

SEQ ID NO: 683 - DNA, 1417 bp, Homo sapiens
ttcaggctctacccggggaggcttctgccgcagcttcagcgttcacgctgtcctccgactgtggggggagaagagccggatcccgatcccgggacaggccagagagaagcttggggccagacttcgtggagcggagagtgtcctgtgaggacaccctcggtgaggaccccgaagagatcccagagccctcgagtgactgcaccagcgacagggcccgggagcctgcgcgcgaagcggtcagggatggcatccgggatcccacctttgaagtggccagcgatgggaccctggagtccatgctcgatagcaccaacgaggggacccgggaagcctcgcgcgacgggaccacggacgaggcccggggggccgcgcgcgacggtaccacagacggggtctgggaggccgcgcgcgacgggcttatgggggcggctaatgacccggggcgcgaggtgggctgggagaaggccggccgctcccagagcggcgggcctccggggcccctgcgcagccagccgtgcacacgcgccaggtcccgcgtgtcctcgtgctcgcggtgcagttgctcgcgctgttccagcagctggcgccgcgtgtggtgcagcagctgggtccggcggagcagcagcagcagctcctgccgcaggcgtccgttgtccgctttgatggcctgcgtgtgcgccacaagcgcgcgcaccgcctcccgctccgcgcgccgcgccagtgactgcacgcgctgacgcgcctcgcgctcgaaggccgccttgtcctccaggaagcgccgcttcacgcggtggagcagctgcgtgtgctccacgcgcatatgcagcagctcgcgctccagcgcccggatccgggccagctgctccagctgcagcacctgcggcgggggcgccgtcagctcacccccaccccgcccccggcccggccaccagccccgccccgcctcaccccggccgcgggcgggctcactggccttgtagggctgcagctcttgcacctgctgtgccatctgtgccgcgcgcgcctccatctccaacagctgcgcgcgcaccccgtcctcgcgcccgtggtagagcgaggccagttccgcccgctgccagtggatctgcgctaggtccacgcggttctgctcgtccagccggacgatggctttggcgcagcgctgggcgcgcgcgctcacgtagctggcgtagagccggttctcctcgcgcaggcgcagcgcctcgcggtccaggaaggcgttctctcgcagcacctggtcaacgctctcctcgcaggtgtccagctgctccgagagcagcgcgtgttcgcgttgcaggtactgcgcgcgctccgatagcggctgctcggcacccgcggccgccgcaccacctggctggctccctgcgctcggcccgcgctttttcttgggcgccat

SEQ ID NO: 684 - DNA, 10935 bp, Homo sapiens; identical to SEQ ID NO: 680

SEQ ID NO: 685 - DNA, 559074 bp, Homo sapiens
atcatattataggttttttaatttttttgaaaagtaactggcttcacaaacaccaagtacaacatgatttagacaactgagaaacaggcaagtatattttgaagtgctaaaataaaacatatttatacaagtacaaagcaaaacaatgctgataaaaatgttaaactttatgaaaaaaaatcatttgcagttcacatcaaaataatttaacattctctattattttaatagtacaagctgccacaacagagaaagaacagatacacgcacacaattttaaaaccaaatcagttataagtgcagaaaaaagtaagtacaagcacttttagcccacacaaatcttttaggattggcaccatctttctaaaacatctataatctatatagatttctaattacaacaccatcagcagctgccattgatttctagaaatacacacaatatacatagtatatttgttcacattgggaagatcagtgaaattcaaccaactattttatacatgcctcattcttcaatagacagtagagactctcccaggcctcagaccctcttcaaagtgaattctgacttgtctttatgctttcactgatctgtattttttcacagtataaaattgtaaatggtaactatagagattctgacagcttgagggttattaataagctgttgctaaatgtgaactcacataatacctttgaagtctccaaaacatgtacattttactgggagactagcataggaaatgcttttgttttttgttattcttaaaaagagcatttaattcctggcttggaagtcacagaactgcagcagagctattatacaattcatttacagtcagaaatagctcctagtcttcctgatcacttgctggtaacagcagtagtttgggaaagatagttactttcaaggattagcacgtttggggatttgctttttttccttgcttcagtcaaatctcttataatttttctttccatactccctttctgttccccatccctagcccagaaagacggttcttcccaatccagatatgttcttcttaggctgcccccactcctttcccaaaatggaaggatgagtggactgcttagattagtcagtataacttggttaaaccacgtcttcttctttccatcctgggacatatctctcatttagggtcactttgctgagccttagcatatccccttccttttagtcatgctggtcccgactgaattatcactgggcaccaggaacagattgttttgaaggaaattcaatgagaatgtacccaaatgaattgtgaagttcatatcctatagccctagaatgaatattcagttctctttgtactgtagagttattacttggaacctggtattagaattggcaaagagacagagttagcatcattccaaaataaaagatctcaagaatgcattactaataatcttatgtccaacatacaatgtattcaatggagtggcaaaagttatagaaatacagagaaaaatatatcttgtccttttctaattggataaatcatttttattattacagttgattatgatagcatgtggaagtatcagatggcaatttacttgcattaaatttaatttctgatgaagttttttataaggtagtgtgctttttaagagatatgttactaaaaaaatagaaaatgaatttgaccatgaacaaagtttaaacatgttcttcaactggtctagagtgaaacgtattgtacttgagaataaaatgaaaatcaacataaggattttataaaacaaattttaaaatgtagagcatatcaagaaaggtttttaatacctaagaagtcaagataggaatcctcaggtgaatgccatccttttgatgaggatccaaagggtattaacacctcaaaagatttccatttgtttttcagatagaggcagacatttgcttttaatgaaaccatgaaacttagctagatttcacttacattttaaaagcctcggtgtaatatttgggatcagggtgctgtgatgatgttattttcaaatctagcatgggaggttcgatttcttttaaattaatactttagtacattaatgttagcttttaatgttttgtattgggaggtttgacttaaagttgcaagtaagaacaaatagcagaaaagaaaactcaagcagaatatttattagaattttttaaagtgaagaatgataaattatgccaatggactgacttctatttctcagtttattttctgttaagtagatgtgaaataaaaaaaaatacttaccaaagtaaggatattgagctaaaagaaaaagttttatttattattctctctgccaaaatatacttctgcctcacagcacatatttttcataaggctatcttaagtataaggctgggtcaactgaactttaaatttataggacacctcctccatttattactatccttatttaaaaatcaaaacatttggtacctgaggatagctgcaatgggaggaagaaagagatgacagtggattcaggtcttgaactatgaattctacctatttgagactatcaaagcacacttgtttctgttatactctaaatctcttttctgtagttttaaaaagtgacagtatgaagtgcacaaaatcatattaatcattattttaaaaaagaaaataagaattgctttgcctctttttggaatggctaagaaagactgtgtggttaatattcattaaggttcctcttttttagtattttgtattgctttgaaaaatctacatttgtcatagttcatagctgccctgtttaagcagccaagaatagttaaaatcactgctcactggcatagctaaatctccactaagctgacttgacacagttaaaattttcagtgtattaagattgtgttaatcctttcaacaacagtctctcaaatcatgacaatgtcttcatggggtctatggaccactcttccagtggtgggactcgaaaagaacaaaggagctctttgtgcatcaggttctcaaaataaaggaatgaagaagccccaatgcatattttaatattttagttggcaatgcaaacgcaacagcattcctaaagagtggccatgtttcttgaaagagatagccaggctggagctcaagaatgatttttataaagagaatttccagctacaatgcaccccagtgagggaattacaaaacagtattccagaaaatattttttttgctactccagtattgattggcaacatggtgaaatagtcaagaaatcttccactggttttcttggttaatggaggtgaatctgaaataagtaggtggaatccccgatgcaggcttttggaagagtatttcacaacccaattggagaggaaaatctctggtagaagccctacgtagtacattagcgcagcactcactatccagtagtgtgttatgcatgggacacattcacaacgcctccgtaaatactggacccaagttactgcttttcaaggtctttacaggaaagaaaaaacaaaaagaaagaaaaaagaaagaaaaaagttgatgttttggtcccagattttgagtttgttagaaaatgtacattcatgtttggtgaatcaaagactcttctgggaaaagaattaaagtaaacaaataaaactttttacagttgcttattaactatgctcttcaccctccgttacgctgtttcacacgcactgcttccctagagcaaagcacttggtatggaactgtttgaagagacgccttgtcagccctcaaagatatcagccgtgtttcttaaaagcccatgttttctaaggccactagaagaaaatctgccaaaagatttgtcgtcggtttcttcgtcggttgtcatgagatagcactactgatctcgtgtttccattaaggggtgcccttggcatcttccccctgggccgtaaccaggcgactatgcttgccattgtgtgtgtgtgaacacggggggctccgctccgcacgcgcaggccggcgtgctttccagggacattcacaacgacgaggagctctgagtgtaatctcttatgataagagtgtcatatttgggagacgacgggatacagagggccgactcggacactggcgagttgggggttgtgctccccgagtccaccgagtctctgaagggggacggcggggtgagagccaccagctcctccaggtctggcttggcggccgcagcctcgggaccggccgcggggctctcccgggccgcgtccccagccgcctgcgcccctgccgcgggctgcgcgcctcccgtgacttcgatggccggcagaggctggatttcggcaaaggtcgtcatggtcgtgggcaactggatctctttggggatcaggtaggacgagcagagcggggcgccgacgccggggctgggggccgcggtggacagcatcatggagttgagctcgctgatgttggccgtgaagcgggtgaccacactgctgatctgctccatgagggagccctgcgaggagctgctgcgcgccacaggctccgagtgcagcgacggcacatcgtcgtccgtgcggctggccgagcccgcgcggtggctcagcgtgctgatgggcgacggtgagcgcggccgcgcgggcgccgggaagtgctcctcagcctcggccacatcatacagcgccttggggccggcgtctggggactcgggcccgcctgggccggcgcctgcgcagcccgcaccgcccgtggcccccacgcccccagcgctcccgcctgcgccagcgccagcgcccaggccacggctctccgtgctcttggggaagggcttgatgacggccgtttggttggggttttctttcttgttgatgtggatggacaggcgctgccacaggtgctgcccccggctgctcttctcattctgggcccacgtgacggattttccattggaactgaggagagaagggagaggaaaggtgactcagcgaggtgcccagggggcttggatgccgcttccccaatggtggttgctcatgggccccggactggggaggacttttctcattctttcaggaaacacagcatcaaaaggacatcatggaaagagaccttggaagtggctttcctttgcttgttttgagttaaagactgctttctatatcagggcttcagtttatcataatcgtgaaaatgtgtcaaaggggatgcttgtcaggatgaaggagtgtttattaggattctgcgggagttctgagcccacctgtgagtgcagcagcacacagatgcaagggcttgcagtgtcccggctgtgtgcacaagtgcctggtacaggacaggggcttcctagagttagtggcctctgaaggaaaacattaccactaggacccaaactcaccaacaatcatcagagaggagggaaggggtaagagagtcagggattaccaggaggtagtcagtggttccagttccgcctttattctggaagttggtatatatataactagggttttctgtctgaacccctgattttgaacatagtgttacttaggctgccttacctgctggaaaataaaaatttaatgaacacacatttctaatgagagcttctttacttcacagaaattcacctcacaaatgtattttgagttctgtacttgaataacagttcaatgagtgagagtgctgtataatgccttcggcacttagcagagtgatctcaaattaggatcctggtgaatattgagggactgacaagttttttgaaggcctttctctctctttctcctttgcacttccaccatggggtctgaaagccactctcaagatgtgattggtgcctcagcctcagcgccctagtacctctccttaccactaaaagctgacacaatagcttctgaagctgcagacgttctttcagaaactttacaaaggtcagagaatgtggcctgacactcaagattttttttttattttttgttttttagacggagttttgctcttgttgcccaggctgaagtgcagtggcgccatctcagctcactgcaccctcggcctctgggattcaagcgaatctcctgcctcagcttcctgagaagctgggattgtaggcatgcgccaccacgcccagctaattttgtatttttagtagatacggggtttcaccatgttggtaagactgttctagaactgctgacctcaagtgatcaacctgcctcagcctcctaaagtgttgggattacaggcgtgagccactgcgtctggccaggaatgttatatgaagagattctggtgtagtttcccatcacaaagtaatccaagatctctgttactagggggtctgttattttcagtcaagacagctctgttctaggggctgtgaccaacagatagccttgagcagcctgactacaaaagaagttgaagactacagttttatcatcacagcctatggttattaaactaaattctgtgtaagactcatctagggcatttgtcaaagatataagatgtgaccccaggagagtctgattgtctggattggcttccaaggatctatgcttttgacaagcattctgttcttctgctcccaaagtaaatctgaagcactttgtttctcagattctttcacaatctgagaaactctggcagaaagccatccttttcttctaaatccccatcactccccttgggcccccttgctggagggctggcttgcctttgaggggctggggcgtgtacctcatttggaatccaccagccttgaggctgcctgactggccctgcaggatccactctgtctgagaaacccactcccttggtaacagactgccatttctgcatcccctttaatgacatgctttttgcctctttccacactgcttcccatttctttatctgttcctttctacttcatggtctttctttctccgctctttcctgtgaaatttctttccatgtaatctacccaatatattgtagtctcatgtccttcagaatcctggaatatgagcttcttccaccccactctgcccttcctggaaaggatgaatgaaccattttcaggtttggaggttgctgtgcatccatagtagcagagggggcactgccaaacagttggtgttcctttctagtagtttcaggatttatttttcaattttgcattagcctgacttacgtgtattacaattctttttcccaggtgtccactagcttctggaacatggcagagaagaaatgggccagtttatttacgagatttgattgggaggatggttgccaactacaccctttctcctatcagaaggataagaaacaggtgtttcgaaaggtacaagtattatttcaggtcactaagtccccttttaatacaaagcatggacttgaaatcaggagactaattggatttattccaccaacttttaccttagggacactcttgctcctagtacagagaggttttgcaaacactagcttttaaaaagtttctctctctctctctcgaatgcctttagttgaacatgatggaacataactttggatgttagcagtaacagtctttggaatcacctgtagccatgccccaaaacatgatagcatgttgcaaaacctctaggtgagtgtgtgatgaggaaaccatcctaatcaaccaattctgtacaaagtattgacatctttttcctggctgtgcctttggttacagtgcccatggccataagggagaaagagcaccagaccatctgaataacgtgaaagtggacacaggaaacaccagacacccagagaaatggagtccaaatgtgagtacttcatttcattcttttgaacatgaaagcttttttttccctgaagtaaatgagaactcttaagaaaaaaaacaaaagaaactccctactcacgacattattctgtttattagtagaaagtacattctatgaagacacagatcttatctatctttttcagtgacactcagcatgatcttaataagcatttgatggatgaataggatttttaagttaacagggccactgtggggtgtcatggaaggtgcaatagaatagagatcctaaaatccggttcttattctggatctgccatcccagatacttggaaaagaataatctttttaagcctcggtaagaagcagacagtgtctcatttggttaaggttgttttgagattacatgagacaatgtaggtgaaaagagctggtaaagagaaggtgtctaaggatgttcagtttttatattttatgtgaatacagcatttcagaaaataaaaagtatactcaatgccattttgaaccctggtttaaggaacagagaattcagtgcaaagtaaaatatttggtaagccataaaacctttcaggttctttctcttttacctgacctggagttccatgatccgtggcctcttcacaccctaaactatctccttgggtgatcacctctaccccattaaattccaaattaacctttttcctcaaatgctttctcattgtgctacatcctctcttcctttttgcttaactgtatcctctttttttcttattttattttaccttaattgtcttgtcttaaagaaagctttcctgaccctgctaggctagattcctatggcacctgcattcaggcatatcataactctttgctatatgtctatctcacctgcttgatgggacattatgaaggcacagatggagggtttgctctttcctatatgcccagtagtacccatgcattgtttagaacatggtagtgctcagtaatatttttgggccaatgattgagtagataaaatgcagtttatttttaaaatttatactgaattgttttcctgttagaattaagtttttaaaataattcagtgttaatgaaactctattttgccttatggatctacttttacttcttatatacctccctttaatcaatagtactcaatgtctacatatttaaaaaatttcattaaatatgaaaatacaaagcttgatatctgccatgaaaatcacaaaataattccttctttataactcatatctgtcttagtaaaattgctcagtggtgaaatctcatcgaggcagtagtgatagtggaaagaaaggacccagattctcagtccaggatctgactcagaatgatgttgagcaaatcacttgccacctttgagcttctttctttattggaaaaaaagaaaagaaaagaaaagaaataaacctcccttgcccaccttgcatgatgtctgggaaaaaacaaaaggataatacatatgagggtactttatagagcatagcccttctgcaaatgcaaggggttattcattaacattaaaccttctattcagttgagctaagatgttgtatttattatttaggctgagatttttttttcagcatccatgttatatgtttgtccttgggggctgaagtaagaaaaatgaaagggaacttttctttacccatctatggcacgtcaccttccctcactgaatattttggacattagaaaaggagagggaaagaagaatgaaggagaaagggacaagatgaaatgatctgccacatctgaggagggggccaaaagtaacgtcttgctctcttccaggcaccatttaacccttttgcaaaatataatatgatgccatctaatgttctctctgttataattatttgctctttatttctgaaaaacaaaaagcagcatatcaataatgttatttgaggattaagttttttgtttatttgtttcattagtttttgtttacattttgggtctgccaaaatgacactttctatctttattctcagaggtttatttttcctgtttttcccttccatatcagaaacttagcaaatttattcattttcaagcagggtctgaatgtcatgtcaatgacctcacccagtttctctattcctctgctcaaacctgcagatattagagtattctgccatggtacaccatcattaggaagcaaacattaatagaggaaaaaaaagtttgaccatcaaaaaagtcaatggaatttataattcaatacaggaatacagtgttaaggtattcacaagtgtgacaaaaatgaggatggaaaggaatgtactgacatgaaaactactgtggaaaaaaaaagactttgggtttttcttatcaggattagaaaaattcagagaaaaagttgttcactgaggaaagaagtttcaaggaaggatttgcaaataaagtggatattaacgaggccttaaagcttggggatgttaaaatagcatggataagcaaatctcaattaatacatgtattgcatatatggaaaggaaactaattctacatgtctaatcccaactcctccaacagccctaagtgacgtggattttcacctctctcttaagtagcagtggttacatgtttccacaataattcccccagagaatctttcttaccaggcatttaatccctaataaattcctggtgggaggagaatcactcgatcctctcttaactagtctttggtttaacagcaacaggaagccttttcagaagctacatgttcattcacggtgggttattaaagtgcttaatggtactagtacagtcgctacttcccctgagtcctcataaggagcaagcaccttaacaaaggagaatatgacacgggagcatatgccaagcattggaattgtgttgagtcatcacagatatttccttctcaaatcaaactatttattttgatccacaattctgttacctggactcagcttcaaaactaaactactctaactggtattagttggtaaagtgatacaaaattacagctaggtacaaggaatgagctctggtgttctgcagcattgtagggtgaatatagttaactataatttgttgtatagtttcaagaagctagaataaaggattttgaatgttcacaacacaaagaaatgataaatgtttgtggtcatcgctatgctaattaccctgattttgtcattacacttggtatacatgtaaggaagcattccgtatcctataaatgtgtacaattattaagtgtcaactaaaaataaatttaaaaaaatctcactaaactactcttcatcctgacatttaagttctaggtcttagctgagatgttttaacagcgattagcaagaattttagatttttgtacttctttttcaaaacaggaaatgatttttaccagcaattactataaagctcaattataatttagtaaatagagaacaaagccagacatagctgttttgtgtctagaagctgctgcagtcaggaagactttgtggaggaattcagcttgatttaaaccttgaataaaacatggaattgggattggtggcaaagaagaggagaatcctggaatggtaatagtttccattttaatagaacttttcagctcacaaggtgttttcacctatggcatcatattttaccttcataacagctgtctaggataggatttatcagatagttttttaattacttatttacaagtctgttcctgcactaaacctagagcattgcaagggcagatgctacatgtatctcctgtgcttaatatggtgtctggtgcagagtagtgcagaggagtgttagtgaaataaagtgaactatatgatcttgaatgtttgatattgacaggtattattaaccttcactatagatatgagaaatgaggcttatggaacttaactaagtcgaccaagtcaaagtaaatggcaggacagtgccccaaatctgatgctaaatccagagtcattcccattgtctgtgtactgagtgccaagatacacacaggaaccaaggggctaacaagacatacccctgtggagcatccaagatggcagtgccccaggttttgcccataaaataacctgataaattctaaagctctgcatcaacattgctgagataaatcctgagggactgtaagataaaagttgtcccaggatgtttagaatggttgctgggaaaataattcctgtttaggcaaaagactcctttctgtcttacagcacctcagctgaagcttgtgacttaaatctgatgtacgaaggggatgttagttatgaggcttgaatcctgggtgcagattcaccaccaatatgtttattgtcagtgaagtctcttggtttaagaaggaagtttcttgattatcctggtttttttttttaattggataaaatgggcatatgccttatatctgtcagttctagtcccatttcctgtggaattcttgggatgctgagcactgtatctttgtactattaaaacaaatttaaatctaccatggacaccattattttgcttaatgtcaatcttgttgcttcctcaaagacaatagaaatctttcctttctctggacccttaaaaattaattgggtaggttaattaagatatttccttaatatttccagattaagatattttgttaatatttccagattaagatatttccttaatatttctagattaattgtgtacccaattaattggttacacaaacatacagctattcctgattaatgtttacttttttcttacaattgtaatatattggcttctgtacacacacacacacacacacacacacacacacacgtttctgatcccctcatttacattcttttaatctttaaaaatatctgtgcatatgtgttgtcatatgcatgctattaaattgactacaaaactgaggattagagaggttcaaagaacttgtgtgcataaaagtagaaaatacttaaggtataaacatcttggtaaagccaagatttttgataagctactgattcttggagaatggaagacagtgtgtgtaaaagcttagtgtgctttgaaggcatgtgagacacagtggcaaaaaaagttttaaaaaatgattaataataaataacatttgtgttgaagaatcagttcaaactaactcattaaacatgggattagataaaatgattgatttaaattttcagagcactcagctttgctgagtaactttcgtctacatttcaatattaccattatacataatgggaatatgccaataagattagttggacacaattcccaaattttatccatatctttaggtgagactaaaagtagaaagtattccttaaaattcacttccctctcaagagcatacaagtttggacttgatgactacatgtcaggcggttcccattttggcttggcattttccattagaaatgattttgatttcctttttccttttttacagaaaattacaagctagcaaatctattgtttcagataaaatatatgcatatatattgtatataactactgaattatctacaaaaactatacatttgtacataaatgtgtgcatatagatgtgtgtgtacatatatatgtctatttacaaaatgtttttcacaggcaagaacagcagcctcacacaaggctttgaccagctcctcctttttttcagtaaaaagagtattagataagatgagaattgagcagaaactgagatgagagagtcatagaattcaagtattcctgttacatttctgtattacattttttacaggctaagaaaagagactgttcaatttaataatataaaaaatagaatatgttcaatttaataatataaaaatagaatatactctgagtagttagtaattctttcagaaaaataagaaaagataattagaaatctggttaatatttgtggtatttaataaagctagtaaatttcaattccagtcaccaaacattagttaatctttttggtttttgctggtcttataaggacttatctggaaaaatgcttataataagatttcaaggattactataagctactcatcatacataattttgatgctatgttttttgattaattttttataaaattaattggtaaatggtatagaaagtaagaatgacaatagatggttcatgaataaatggtttcagggtcaaataaatggtttcagggtcaaataagttaaacaaattaaactaatttctgatgaatttatcaattttttatgtaactattcactgagaatttccaagaagggcatatgagcatatatgttggctccattattgttagccatactgtcatccctgcttccctccaatcctgaccaccatccaaatcttggccttattattggtatcacagatttaaaattttaatgtagactattgctcttgcaggttccatcagagcgagttttatttctttattaagattgtaatttcctttagggtggagattattttatacttccccaaacaccccatggtccctaaaacaatgctacctacatacacaaaaattatccaggcacttttattgagtggttgattgactcaatagacttctcacactgttgagtactgaagacgtaaaagtgaaccatacatttttgttttgtggccttaaaaacctcaagtttaatgagaagacacaggcaactagataatatgcaatatcggatgtaaaggtaaaatacattagaattatgaagttgggcagagtttagctagactaagacttttagacacatcaaggaggaatggacattagagttgggttttgaaacctgagtaggtttgctaggtggagcagcaatgggagttccttctccctggaagaagatggatagaaagagaaatgaaggataatccagatagaaacacagcatgtcttaagtcttaagatgtgctgttgtagaaaatagttagcatgtttggagacttgtatatctgggatgtctggaaaggagaacatatgtacagaagcagaaggaatgatggtcaaatagttaggttagggttagtttatgaagaaccttgtattctgagtgcatgagttcgtatttttttcctgggtggctgataacatagtgattatagtatgtgaattgcagaatcagactgagttgggctctaatatgggctttaccaattttttaaggaagattaagtgagcaatcatgcagataaagcatttgacacagtgtctcatgtatctaagtactcaataaatgttggctgcttttataggtaaacatgggagaacatgaattttaaaacagggaaattatatcattgaatttattcttttgttatcattagattttgttttacttacttttccagaattgatttttgagcaaacaaccatggtggcagggtagagaaagacaagacaaaacagtaaatacgtaaaaaacaacctttctaaactgggtggccttggatagtaagagcacatgctaaaatttattgaatgcctattgtgtgtcaggcaatatgctaagtgctgtacttatataattccatttatttttcacagcatcacagtaagataagtgctataatataatctgacgtttatagaaaattgatattaaagagttgaaatgacactccgtggtcacacactggctagtgccagaaccagatattgaagttcctttgattttagatttttcatgagattgctctactgtgtatgttattttatttccctgatcctcattttcctgtgtgtagcatgggaagaaaaaaaattataccttctttatatgttcttgggagaacttaatgcagaacctccatgaagggacttagtatagtgtgggatacatggtaatcatagcaatgttactaattcttcttcttcttattttttagaatatgttagaatattaatatggaattgattttggagataaataaagtgaaggttattgtagaaattctaatctattctcaaaaaccagctggcttctattgtctgtactggaaaggcagaatctttctcttatctatggagtttaaattatataactacatgccttacactttctgaatactcagtttacatctgttattatgtgttattctattacttttaattctgtttgtactggtacaaactatagcatgtggtaagaaatgggcacttaatctgaggcataaactcccctgtgttagaggagttttatattgcattgcagttatctgtttttctgcctgtttctcaatacactgcagattttcaagggcattagtcatatcttggtcatccatttatctctagagtcttttgagtccttggttcataataggtgcttaataaatgagctttacctgaaggaagaaataattgaatgaatgaaaggcaatcctaacacaagacattgtatttggggctatctgaggtcctactcatttaacaaggactattatgacatgactcttaccaaattctccaagcctttattaaacatatgtacctactaaaattagatgctgcatatcacaggagaaaatcagttactcaactaattgaaagttaatagtttgcatagcttatatcacaaaagagtaataataataattctctttttgttcaaaaataaccccatcccaccctccttccttctggcactggagggggactagagagctgtctatttcatttgactgacggagcccttcctcaaagagagactaggaggctcagaatgtctttgtttctccttcgtggcctacatcatgagcacatcagaaagcagattccagccaggagtggtggctcacgcctgtaatcccagctttttgggaggcctaggtgggtggatcacaaggtcaagagttcgagactagcctggccaacatagtgaaaccccgtctctactaaaaatacaaaaaattagccgggcgtggtggcgggcatctgtaatcccagctactcaggagtctgaggcaggagaatcgcttgaacctgggaggcagaagttgcagtgagccaagatcgcaccattgcactccagcctgggtgacattgcagactctgactgagaaaaaagcaagcaagcagattccaagtactccaatgccatgcccctgctgacacagaagataataacattcagtgttgaggtttcagtcattcagtcattcctgaggctggaccatcttgctagcaactcacatggtaacagtgtttagagaatttcagttcttagagccacctccctgtttaggactctcttttacttctcctgcaatcaggaggattctgctctgaatcacacttagactgtccactgtgaaaatatgaaaagatgacaagttatactatattcagacatgaggttaaaaaaaaagcctcttcacataaagggaaaacagcaacatatttcaggaagctagtgtgctatggggacatgttatattctcattcctttcccagcatgagggttgagggaggaaggcagaagtaaaggagcatctgtctaaggccctgctaatgttacagatcagaaaatagtgctctgctctgcttcaactgtaaacactgtgaaatgctttctttccccaccaggcaacttggctctgggataatcatcctaggcatgaattcatagagtactgtccattctacagcttcattatacaaaacaggcaaatgagatgcagagtgacactctcggttttctgtggttgtttgagctccccttaacccctccctggaactagctattcaataatggccacagaggagtcccagatgtttgcagagtaaatgtgatgcttggctttgactcctggaagcaatagggggtggagtagggatgaattacaaagaaaggccttattggttgacgctaaaagtacctataaaagtctcacatacatagagttaacctttcttcagcccttctattccattcctgagtaagcaaatttggattaactacttcaaccccttacttagaaacggcttccatcacagttatctcctctctgacagctttctcttaatgttcattttaaacttatttctcctggataaatatgtgtgtgcaggcatgtgtgtctgtatttatgtgaacaaatgtgaagttggaaaaaaagataccaagaccttgtgaattttgacctctcttttcatatgtctctaggccttttctactccctaagggaaagcttaagcatggcaggtctctcttctctctctctctctctcgctctctctctctctctgtgtgtgtgtgtgtgtgtgtgtgtgtgtgtgtgtgtgtgtcagtttttatatagtgctaaagaaatgagaaggaagagatactaggaagggaagatcatttgttcccaattaactctgcttatctgtgtggctgaggtggatgatctaacacaattgtatttatagtagtatgcattattcccctctcctccaccaggatatatcagtgtaataagcctttctattatcttggctatatccaaacaagtgaggaaacaaaaattaaatgatatcttgcggttgtagagaaactcagaccattcttgctggagatacatcaagtgaatacctttgtagatctggacctgacccaaggaagcctggtatgtttatctgggatctcctactctctgtgtactaccctctctgtccctttcccctcattctcaattaagacagccttgagcaaatttaatttctgtgatgatcagatctaaagctctaagtattgactaaacactgctaagagcatcgaattgcataattgagaccaaatgcttgccacaaacagctccatgtcatctcctacatgaatggattactctaaaatatcagttcatgcactggcttctttgagatgacctaggaaacttgttacatgacagattcctaagttgtattgcccaatattttgcctcagtctgtttgatagtcagctaagtttgccaggtttgggaactccagttttagacctcaaattagaagtcactctgggaagagcccttgagcactcatttggtgaagtcactttaaccttgtccagcttactctggtgctgtttgcctaattttcaaggatatgaattatgctactttgttatatctaagtggaaggaaaataggagccccaatagcattctgttgagtcacttccacaaaatgatcctctgagactcattttgcagatgcactgagatccaaagatagctgtataaagggattgtaggcataaggccatcagatacaccaaagtacacacatatatgcctacacatgtacacacactatcattgccttgtctctgagaaccatagacaaagttggccaagcccttggccaggactgttgtgaatgattgctcaaactgtatgctgaacagttctgggcaccattttcatagactgcaatatgaatagtccaccagcagttgtgcaatatggtgggccttggaaaaatgtagttattattttgaaaataggaaggagcccaccactgaggaagcaaacaaaatgtttgtggtgaaatttcaacaggattatcttcttgttatgcaattaggtctcaagctctgctctcagcacatggacatgcatatgcacatactctacttattgaatttttccttttctctaatccaggatgatttgcaaaagttttccttccatacctctacaccacagatggattgagaaatgtcacaacaaattagaagtgaagagttaagtcatggcaagtgactcctcaactcaaggctccttcaacattctggaactgtttaatgtcaatcttgactttgtctccagggcccttttcttttcttttttctttttctttctttctttctttctttctttttttttttttttttttttgagacagttttcactctcgttgcccaggttggagtgcaatggcatgttatcaactcactgcaacctctgcctcctgggttcaagcagtcctctggcctcagtctcctgagtagctggaattacaagcgtgtgccaccatgcccggctaatttttgtgtttttagtagagacggggtttcaccacattggctaggctgttcttgaactcctgacctcagctgatccacccgccttggcctcccaaagtgttgggattacaggcgtgagccaatgcgcccggccccagggcccttttcttaaaaccaaatcccatgcaataaagcacgtttatttcatgcaacacagcttagttaatgcttatacttccaaatactccggtttactaggtacaactcaatcaggagtgcctagtataaaagaacatgcacagcacagcgacagagaatgttcatcaccaaacacaaggaagcaaaggagatgcaaagctatggtagctagaggaggattagctttcctgatttcagtttgagaaaagccacttgtctctacagtccactagtttggcaaggcatttgcccttggctgtgagatgatgttacattcaaagtaaggtatattaatttccaggcttgtccaggatcaggggctggagtcttccttcaatagtaatcctttccttaaaaccagttctaagctttgtatttgttttattaagtgattggatagccctgaaatatgagtttcctccaatctcttccactttgcaaactccagaaccgtttgaccaataagttaaaacccagaggaggactgactgtgagctaaggcttcagacatgcaaagcgcacaaccctgggaaacagcagcatctgggacaggaggctcccattactacacatgagggtgtcataggttttgcaaatcaaacacacatagaaaaccagtagtagcctgggttggacacactgtatgagttgcacagttgagtgaggacccagaccagggagccacatgttcctctagcttgcatacatttatttcacaccacctcaggccactcatagtttgcttacctgctcattgttgctctcccaccattccccatactccctttgggggtgaaacactctatttccgacttgtgctgggccagtctcctgtctttgtacctggtgagcatgaacaaggacaggagcaaacagaaagacgtgattgtgtgcttaactgccaggctgaggaacggccgtgactgtggagatggtcactctgtgccaaaatgggggttcctgcttctcaatgcaatgaccaacctgtgatacttattagatgaatgtgatggcatatggacaacatcagggatgacgttgttactttttggttaaaccacatgtaacccattctttcacattgcctattaaactgaatatgtcacatttaatagtcaatggtaaaggtgtgcaatttctagcatcttagaaaaagatgaatatcaatcaacacattagaatctattcagtgcttaccatgtgtcagacactatgctagaactttacctaaattgtatccaggcaacagccctgggccagaggctttgttatcatttccattttactgatgaagaaacctaagattatagaggttaagcaaattaatcaaagattagttaattaaataagtggttgggctggattttgaatacagggaatctaagtttagaacccacacttcagccattataatgtgttgccttccattatcaagtttttaagctaattattatcttgagcaagccctcattgagtgataccattctggatgttgttagacattggcaataacagaggagagaagacatgttctttggatattaaaagtttctgtaaacattaagctgaagttttactgtcagtattgggatgccgccattatttttgtattataattggcagttcaccgcgctttgaagataccagatatttcatctaaaataagtgatgagattcccaatattactcttctacgtggtgcatcaagatgagttcttgtatctcaatgacagttttttgagctaacatgatttcacagaaataacctcttttactcattggttcgattctgtaaggtttttaaaaaagaactgttatttccatttgccagatgaggaagctagatttacttaactgacttcatgaaagtcacaagcctcatcagtagagaataaccacctgtagagcttgcaggggcccagagctcttaaggttttattaccttttccctaattaaactggagcctggtataacaccacttcatccaccttcctggtatccagtaggctatgataaagggagttactataataagacttgtttatctcagtacagtcacactctttttagtttattttcctgctgtttcaaaagtagtataaaataaaataaaatgcaacaaagtcaacatcattattgatcctggggcagaggccttcctcttaattttttttcccttctaaaatgtttaaagtatctagtatttgaagaaaaatggcttattacatcaagcaaaatgaatttaatggattacctatttaacggacattagttgagcatttattaaatcctaggtaatggactttgcactacagatgtaaagataagtaatctgcaggccccacctgttagaatttacctaacagtaggagaaggaaggaaataagaaatacgtacacaagtaattttagatgtaggcataaagaagagaggaaaagaacttagagactttgttaaaggaggtaaatcatcagaccaagctagattgagtagacttaattttaccaagaaaataccttagaagtaccaatggccaaatgatgctcaatgtttcaatgcaaagtattttgtgcttctttgtgaattggattgctcaagcaaaatactgctcgacagctcaaattaaaagaatattgatagaataataaattattggtggtcattcacttccttacaaagggatccttaacatatttttgaatatcttctgttaggctaattgtgaattaatcattaaatatttcatagatgagttaagaaacctacagtcttcatgcttataagctcttctctttctttctttctctcatgaccacacacactctgccaggtgacctctgtttatgaaatatggaatagatcctaagcatcttattctatcaaactctaacctctgtgaagaaaaaggaatgcttacacactgctagtgggaatggaaattagttcagccactgtggaaatcagcttggcaatttctcaaagaacttaaagcagaactaccatttgacccagaaatcccattactggtcatatacctaaaggaatataaatctctctatcataaaaacacatccatgtatatgttcactgcagcactattcactataacaaagtcatggaatcaacctaaatgcccatcaacggtaaaatggataaagaaaatgtggtacatatacatcatagaatactatgcagtcataaaaagaatgagatcatgtcctttacacatgaatagcacaggagggcattatcctaaccaaactaatggagaaacagaaaaccaagtacttcatgttttcatttatcaatgggagcttaacactgagtacgcatggacacaaagggaaaaatagacactggggcctccatgagggtggagggtgggaggagagtgaggatcaaaaaactacctaccagattctatacttattacctgggtgatgaaataatctgcatattatacccctgcaaaacacaacttacctataaaacaaacctgcacatatacccctgaacctaaaagtttagaaaaaccatagaaacaaaacaaaaaacaaaaacaaaacctaactgcttttggtaaaagctttcactgacatataaaaaacaaaataatgaaaattcaaaacaataataacaaaactcattttaaaaatgtgagcaatatcttagactttttggaactttcaagcagtttttgtattcaatgcaagctgaaaatggcattaatacagaatgggaaactcatcattgctttcagataggaccctacttgcctgtctgtacctgtaattatattcaccagatatttaaatagatcatatttttattcattcacttactcattatcccatttaccagtaatgtgctgttcaaaattactaatagatttaatagtctcaactgttgagtttaaaaactcaacatttttttccagttgagtttattttagaaatatggaattgtcaattaaaaatagtttaagcttttcagaatttacagatcatggaatatcaattttaaaatttcatttcttttacataataaatttatatatcagatactaaaacacccatacactcatacttgtaaggcactgtttcaagtgctttgcaagtattaactcacttttcaaatgaaatgtttaatttactatatttatattcaaagttataataaaaagtaataatgacaaaatattgagcatgccaggctgtttgctgtacactattgtaaattattaaaacagccatacaaagcagctgctattattctcattctgaagaggcagacactgaagatcagtgtcagtaagcccaacctcatgtggtttatgagcagggagcccaaggttaaaaatcaggtttctctgattctaaagctcatgctatttccattaatttttcctccaagtaacaatattactacgtttaaaaacaaaattacaaaagcttattatttaccttttctcttcttgaccccgttttgcaaataagtagcagagttatcaagtacaggcagtagagaatctagtgataggactttaaattttgttacttcctttaggtccctatgcctgtaccaggcaggtttagttgacatcattcaaaaccgtttactgaatagtccatgtgctgggcactgtgataaggagcatatgggtgattatgtcattgataaggtcacagtcttgaatgagaagatgaaatgtaaacagataatttccaaacaatgtaagaagttttattatagaaacaaatacaagaagggttacttaacccatactagattggcagagaacactttagtgagatatgatacgtaagacaaatctgaaaaattgagcagacatgcaccgtgaagagaaaatcaggtgcaaacatgtagagaggtttagcagcatggtgtatactgggaaacactgtttagtaatttttattgtaagaagtataaaataggaggtcaaaggggaaagcagatggagaagtatataaaaatgatgaatttgcttgttgattatgagatgtcattgtggaatccttatgctacataaaacaggatcagagttgacatttagataaaatgcaatggacttgaaggaacaaaactagagagatagagaaatactactacagttatgcatgtgagagatgataagctaatgcttagggtagcgataatacagatgaaaaatagagcacagtctcaagactatttgggaggcaaaaatgagtaggatttattggatgatgagtataataggaagaagtatagaatgataccccagttactgtgttggatggtgcagttaactgagttaagaaaattcaagagaaggagtatatttgggcaaggaagtaaaaagcttcattttggaatatttgatttgagatgctggtgggacatccaagtggacatattcagcagacacatgagtataaacatttggaggttagaggattgttatacacaggggagctctcagcataccgatggttgcaaatacaatgagaatggttgaaaatattcagaacaggaaaactatgtagacagtggaaagaagaggtgaatagccatgctcattctacctgtccaaaaacttttataacactgttagtgtaagcattcccttaaaacatttactggaaaaaaaatctgctgagtgccttgtatatgctagacatggagtttaaggctcttcaatcttgtaaacctgtaagttttcttataaactatggatttctagatttatgcctaatacagctttgacactttagtttataggccagaagcttggcatgaaaaactctcacaatagatttaataaatttcagaatgacttattctgaaataagttttgcttatcttctgtaaagatttttgttgttgttgttcttcttcttgtaccttctttgtccaggaagttctagctcttctgtactgagttctacaagagcctatactcatctggtaaatctaaaagatgtgcaggtaagaataacttaggatcagatagtaaatgtaattttccattattatttggataaaaaatttcatttcttcacctcaattcctctttcctaccaatatctactgaatattggattactgaaatttctatattggctatgtgattcagaatacataaatgagtgcagaatgaagtgaaagactagaagaaaataaacaagtttaaataataaatgtgtatattaggtgaagtagcagatagatggagaattgtgcctgaagctggcagaaaaggagagattttgatattggaaataatgatgccttatgtgaggctgatcaagtttgagtaagtgaccaggaataggaacattaaaatgtattagaactggggggaagaaagaagcttggtactcatctgtcctttatacaagcactaaattcactcagaatgatagccgggcttgggatagacagaagttctttatccagaagttggcagtaaacagtagttataaatgaagctaaaagatagagggataactagattccatgagtctaaattcagtcagagctttaattttcacatttttgtatgtaagggtgtgatatatgcctggaagcagcgttgagttgctgacctccatctctgtgtcctgtgaaacacgtgatatggaagaataagaaactttacttgagagagatatggcgtagaaatgtccttaggagggaattgggtttcaatttaagaaaacaacagtaaatggagtgtttagtgaagcggttgaataagaaggggggtttaatcattaaataggaattatagacagggactctatatggtttggaagggaaaggtcagtggatgaagcaaagagcaatatatagaagtagaatttacaaatgtgctacaacttatgagatgctaggaagattccattgatgaattctttcctcatttttctctgataccaaggagcaaatgttctccatcctgtatgagtgaggacactcaagatgcaaatgctgttgtgagtatcccatggcatacttagagacatgttttctcatagaaattgcagactctctgagaacatatttggttaaaaatgagtggagaaagagcctaagtttcctagagagttcaagaatggaggggaaaaaacacaaacacagcaaataagaaagctaaaggcaccagaggcacatttcccttactccagttttgtcataggcttatcctgctccaggttttgttctttccaatagataaaattgtcttaaaaaataattttctttcgccactttctctctcacactgacatctactatggcccgtagtcttccccttgaaggagcattgtgctaagccttgtgagcacttaaactcgttttccattcctaagctagctgtcattcagcttagtgaaaaccacagggagatattttcttatatgtgtagaaaccacagtatacctattttacttcatgctataatgctttaaactattcatagaaaaaaacagcctgatttctctaagaagtctgtgaaagcgagttggaaaatgttgcatatttcacatatgtcttatgtgtaaattttagtaactcaatatggaatggacactaatgaggcaggagggtaagtctggggagtaagtgggtaggagtgtgttcttcaaggaaacctctcatttaaaccaatatagatgcatcccatttacaaagcaaatttaaattctctctttcctcaattactttttattatttagaatagaagtatggtatgagcagagaaaaacaatatgggaggaaaagagtctttttggccaagaaagtgccaaaaatagtaaaagttattgaatgagggacatttgaactatagtcatatgacaagtcactgtgaatgttacagaaaatcctataagggattttcataccaaaattgcagtaaagatggcagagttttaggactaagcttgagcataaacatggaagtgcagagacttaaagaaaaatgaccatgtgaataaaccctaaacatagtgcctccattatgtaagccctcaaccaacattttctgagggaatacctccatgaataaatgaataaaatggaattgtaactttagggatgatcaaatctccaatgagatttgctgttgttatttgttttgtttttaataataaatacaaactgaagacattctgtacatgttggtcaagagatcaaggaagatggaaaatattaaagatgtttacagaaagtggtaactaatgtacagagttttgagataaagtaattgtagaaaaaaggaggaaagaacagacttttttgtaatcagtcagcatatactgcaggctccatctgcaaaacatacctaaaatctgaccatttctcaccagtatttattaccctggcccaagccaccaatacctgttaaaattttaacagtttctcaaactggttctgctttgtctgttactaaatttccccaacccagaccaaacccattccaacctccacccagcaagcagaatatcctgtcaaaatagaaatcttttcatatcattcatctgctcaaaacgctgttagttacccatttctctgagtaaattatgaaattttttatcatggtttacaaatccctacacttacctcccactccctgactatctctctgatcccaaaagtcactttttctcccttgctcacattgcttcatctacaatgatcttcttgttgcttgaagacaccagatatcctcccagcatagtgtctttgctttggccatttcctctgcctttaatgctttcattaaaaatatcctcaaagcttacttctttcaaatttttgcctaaatgtcactttctcaatacatcctgccagaccaccctatttaaaaaggcaactaccactctactctttctgttaccatttcctgcttttatcaggaaaacttatctaaaataatttatattttacttatttattttatttattctctgttttcccccagtggaatctgtgatagaatgcaagctctatgaaggcatgggttctgaaccgtatgcttcactgctatcttcccagtgcctatgatagtataggtaataatatttattgaatgaggtatgcatgaatgactgacaaaaaggaaaattaaattataaatttccaggaaatttgcataagtaatgaggagccaaatgttaatccccaagacaatggggaaaatgtctccagagcacgtcagaggtcttcaggcagccccttccatcacagatctggaggcttaggaggaaaaagtggtttcgtgggccaggcctcgggtccctgagctgtgtgcagccagggacttggtgccctgcatcccagccactctagttatggctgaaatgggtcaacatagaactcagactgtggcttcagaggatgcaagccccaggtcttggcagcttccatgtggtgttgagcctgtgggtactcagaagtcaggaattgaggttcaggaaccacctagatttcagaagatgtatgaaaatgtctgacgtccaggcagaagtttgttgcaggagtggggctttcatggagaacctctgctagggcagtgcagaagggaaatgtggggttggagtcctcacacagagtccttactggggcactgcctagtggagctgtaagaagagggctgctgtcctccagacgccagaatgtagatccactgacgacttgcactgtgtgcctggaaaagcggtagacactcaacaccagcctgtgaaagcagctgagagggaggctgtactcttcaaagccacacaggtggagctgcctaagaccatgggaggtcacctcttgcagtagcgtgacctggatgtgagacatgaagtcaaaggaagtttaatatttgactgccctggtggattttggacttacatgggacctgtcacccctttgttttggccaatttctcccatctggaatggctgtatttacccaattcctgtacacccgttgtatctaggaagtaactaacttgcttttgattttacaagcacataggtggaaaggagttgccttgtcttggaagagactttggactgtgcacttttgagttaatgctgaaataatttgagactttaggggactgtcaggaaggcatgattggttttgaaatgtgaagttatgagatttgggaggggctggggcagaataatatggtttggctctgtttccccacacaaatttcatcttcacttgtactcccatgattcccatgtgttgtgggagggaccttgtgggagataattgaatcatgggggcagtttcccctatactgttctcatggtagtgagtaagtctcacaagagctgatggtttgataaggggaaacttgttttgcttggctgtcattctctctttgcctgctgccatccttgtaagatgggacttgcttctccttgccttctgccatgattgtgaggcttccccagccatgtggaactgtaaatccaattaaacctctttcttttgtaaattgcacagtctcgggtatgtctttatcagcagcatgaaaacgaactaatacagttacatggaagatacttatttttttaagatatttgcctttcctttgcattgtcacattcttcttaacaagccatcccatccttaccttcacgatgtagacactgattagactaagatgataatagtaattatcagattcacttgccactttactcatcagttttagccaatgatcatgggagagagtcttctggagacttctgagaacgatttctttagtattaataaaacactggaaaacatagtctctttttctgtggacagtggtctggatgtgatacctgacaatgctccaaccatatggcaggcatgagagaagctaagccaacatttcaaaaactgtggtccagtgattcagtggtagactggaaaggtcgaaataagtaggtccttgagccattgtgtcctttgagctactgaattagcctttttagtgtcagaaattctttttatgtgagattaatttgttatcatttaagccactttgagttaggttatagactttctgaggctgaaatcctcctatctgctatacttggtttcattagtttttcttccaaaactgagtctaagaatttctgaaattgttatagcatttacttaggtttgactgtttataaatactgtgtgtgtctctctgtgtgtgtacacatgtgtgtgagtgtatatatatgatgaatctaaagaagttactactaacaaatactttagtgttacttagatgtttgtgttcttttaaataatgctcctttctgtatgtaccatttatataaaataagtgtgagagttaataagttagatttgtaaggagcaaaaaagagagagatcgattgggtaaaacaaagtattattttctcaataatccacacttagagaaagcctaaacaattggtccttataatcatggaagaaacacccttgttcatttcctgaaagctatgctagttacagtcataaccagttactgtgggtttagtgttacattcttaaactgattaggtcatgggaaatgattcagctcatagtactgaagccttataactactctgaaaacgcttttgttcacatatattgaagaattggcatgggcttatacatatttaacaaaaattgtttgcaattatcttttgtgtaatttgaataagaaggtgtcacacacacaaaaaagaaaatgaacctcagtgggcttatgtgcttattccttattagtcagtgacagatccatatacaagtaatcctggctcaactcagtgatgatttaggagttctttccagccaccatcttctttgagaccagttatagcaaattttggagccagtttttatttgttagctctctctttccctttgcctccctgccttgagacagaatttttctgactttagtttttaatcttgactttgctgtagttattgtatccactccccctttgtaccaacacaaagctttataacagctttgagcacattcaattctgttcccatgttggttccttgaacaccagccaagacctcagcttttcgacctcaggtgaaatttggatcaaacatctacctctagatgatatctttagtgatcacccagaaacacagtttataattttaaaacatcttagggaaaatatatgaggtagaatgctgcacattgcatcttattctacagatttattgccacattccttttgggaccatcctaattttggatcttggcagtcataaagtgaagagagaaactatggtgtaatatacttttgaatagcattcacattattatagaaaaactttccctatatcatttaattttcttaacaaactcaggaatataattatccccattcagcagataaggaaactggctcagaaagcttcacaatttggtcaagaccccatagcttgtaagtctcagaagtgccactagaaaccagatgttttacctccaaatctcatgctcttcattaacaacttactttttctttatttcatgcttaaaaaccccttatttaaataatctgatggcacatttgagagactgaaaaggtcgtacatgaagttaatagtgtatacttagtggagctaggctttgagcacaatatacgcttattttttaaaaggtcaaatttgactacataatggtcaagtggaataaatcaccctctgggccccttgttaacatgcaaacagattggcatttctctggctggagttttcctagacagaaatacaccaaaaatctgaaggctgtaaaagaggcatcactaagaagagctgacaatcagtttcgatgtgtgggatacagtgtgatagcagaagacagacagggacgagatggtagaatattttaacaacttcagagtgttacaaagagagctgaaggaaagcccaagtcagccttccaagtctaattgatcagaggaaaattctagatgaaggcagaagggaagtcattatggatctttaggttagagggaaacagtgaagccaaatttaaaaagatcaatattatgcagtactattgcaaggtaattcctttcttcaatatcatctctcaaccttctatctatctatatatgtaaatatattggaatgatttactagatattccatcagatcttgtggtctccgtgcgcagaaaaacatcttttgcacagacttgaaatgtcaacttgattccttcagataaatcagattaaaaacaaaaactgagcatgattaatagctccagaaactaatggcaaagtgaagataagctgcaaaatgatttgagaaattgccaggtaacatatttcactgtgttctgtgaaaataatggaaaggtaaaagctgaaaagtggggaagcaatgcaaataaggaattaaaaagtaaaaaatcagctgtattgacttagtaattctaggaatttattctaaggaaacaattcaacataagctcaaaggtttctgcacaaagattttttccttcaatgttatagaaaacagaaaaaaaaaaaaacctcaacaaaaaagaacaaaccaaccacgggagaatagtttaataaattacagcatagcaatattatggaaatgtgttaaattttgtattgagtaaagcctttcatttagcttctgaagaattcccaaaggatgtattttaatcctacttatgatgagagcttgttttcagatatgaatcatcataagtcattgccattttattgtgtactttccttcaacattactatttgttacacaatcaatagaaattcaggaagatacagatttcaaaaccaatcctaaggtgctttacaagctttatacaacatcctcaatagggaaaacttttcagggaggaacaaaatgttaactataagaagggtctccataggaaacatttcattatggcattaattaaaagttgctagtttctatcttataggactgaggaattttcagacagataaccttactatttctaaagagagataggtagttttccaacagagatttttcctcacatttttatacatgaacaattggaaatgcagtgaagtcagatgaagctagataataaatgtaataagagccatcacttactgagcacttggaatgttccagacacaattctaagtccctgaatttactgatttaatcattacaacagtcttttgagttaggtactattattattcctactttacaaatgaagaactaggacacaggagatcaagtgatttgcccaggttactagaatggtcaactgtgaggtaaattgcttctcactaaaatgctggctacaaatagtagctgtgccatttgttaaacctagttctgtctttaaatggcctaagggatacaggtaactgtactatttttcaaaccttatcattttttttccccataatctccttggcttgagacactgcctatgcttttacttgagccctttctacccttttggataggaagactgattcctctgtgatactaactttgattaaaatttgcaccagcaactaaattttctcagtctggggactgatggagcttaaacctcagtggtgctcgatggaagcagatttgctctaaagctgatggagtatcagggtccctcactcacagatgcccctggcaaggccctgtttctatttttgtattcacattttgtaatctttttcttaaataaagctccccaagtggaaggaactttaggtctcacaaagcctggatctacttgtttaccagagtttgcctttgacccataagggaatcataaactgtgtttatgttcatagggttagttatgctttctgagttacaatttctccatatatacaatggaaatattgaggatcaggtaagacaattcatgtaaaatgcttgattttatagttgtttcataatgttcctttcatatctgtcattttcttctgtactaataacttctataaccaggcaggcttctcccagatagctctgatacaaaatatttgtcctgtttcctccacacaccccctaatacttatgaaatagtgcttcctcatacgagacataaccaatataatctctattaattcttttaagttaatgcatctttgattttcttacctccatctggacctacctccatctggacctacttccatctggatctgtctgctcccacataccctaatttacgctgctgcgatttaggctggatttgaaaatgatgtagagacaaatgatgctcttctctttacttgtctcagcctgtctcccctgttaatctgtatcagggcctattctcttccttcataccaattattaacaaattataattaaatatctgcctgactactagtttagtaactgtctttctcactacaccgtaaagtttatggctacctgggcacgtctgttcttttaacaagcatctaggatagggcctagtatagagcagcaactcaacaagtgaaatggtaaaagcagggacatttatgaaatgcaaggcagtactatttatctaaatctaactacatcaaaactagcctcccccttctatcatacacagaagttcattcaccagttcttgtctcaactaattcattccgtttgccaccctcctttctttctctagccttcttccttcacctttcttgcccttttaacccctcctgtcctatctcaatgcataaaacttgtctttgttttcctcattcctttgtctttggacaacttagaaacaaaaaaagctttctacatttttgccaagaagcttagtttccatttatttcaggatgtaaaataactggattttcacaagaacaagatgagatggggtggaggaaggagattgggatgtttcttttgcctatatacatgcgaggggtgaagactgaagggaggggaatcatgcttacttttgatagatgcagctgcccacgagtgggaatgacacccagggagagagaagcagttctggaaagtcctgggcatgcaattacaggtagccagtgtaagttgtgcacttacatggccatcaaaagaatcatctccacttcatgacacggggaggagggaactcaaatcacaagtctatgactagagattacctttccactgcctctattcttcatcacattgtctttatttttatttctattttttatttttatttttttgagacagagtctcgctctgtcatccaggctggagtgcagtggcgtgatcgtgatctcagctcactgtaagctctgcctcctgggttcacgccattctcctgcctcagcctcctgagtagctgggattacaggtgcccaccaccacgcctggttaattttttttttgtatttttagtagagatggggtttcaccatgttagccaggatggtctcaatctcctgaccttgtgatccgcccgcctcggcttcccaaagtgctggaattacaggcgtgagtcaccgcgcccagccccatcacattgtcttaagattattattttaataaaggtaattatatttctcctggtattaggataacgttttatgtttaattataatcacacatgattacaacagatggatttcctaattctgtcatttccaagcagatttccacactgccgagtgtctatcacaataaaggaaagtgagattactttaatttcacaatgcaaaatatccaaagaaacgtttactgatgtttcttaagtacttagtatttgctaggtcctaagctaggagtttcattgtgatctgttatagatattaggaatttatcatgtcagagtgtgataagctaatgcatgaagttaagtagtatcatctgtatacatacaagtatataagcatatataaatatatagacacagatacatgtatatacacacatacaatcacacacttatacatatataaacatacatatagatagatataccatagctcttcagatttgtctaacttgactgggctttagtttgcctgagatgggcaatatattatggaaattaagtgtactggatttggagttaattaacatggattttattctcagcaataccacttactagctatattgttatgaataacttatataactttttctcaaattttcttttcgcataatggaagaaataccatgtaatttacaggattgatgttttatgtagattttagcatttaatttcactaagacacttatatggtttggctctctgtccccactcaaatctcatctcaaattgtaattctcacatgtcaagggagggatctgtaatccccatgtgtggaggaagggaggtgattggatcgtgagggggagtttcccccatgctcttctcatgatagtgagtgacttcttgtgagatctaaaggttttacaggggctcttcccccttagctttctcttctctctcctgctcccttgtgaagaaggtacctgcttaacatttggccatgattgtaagtttcctgaagcctccccagccatgtggaactgggagtcaattaaacctctttcctttataaattacccaatctcatgtagtacctttatagaagggtgagagcagactaatacactatgagatatgtactattattatccccctttcaccgataaaaataactgaggcacagagtggctgggtagcttgctgaaagtcacacagttagatgaggcaaagccaggactcatatttgggctgttgaacactgaggcttgtattgtagaacactagattaaagaaaataaccaaaattaccaaaggcatggctaaaaaggaaaaaacaaacaaacaaaaatcaagtagagggcaaagaataaagaagagaaagaggaagagcaagcatacgtaacaggcactatactcagagctttttaaacattgtttcaaacattgtctctttacaaccctagggaggggtattgatgatcctgtttaaaagagatctattggtcacaaagtttataaatgttgatgttggaattcaaagctaggttcttctgtttgtaaatgatatacttaaacatatattgtgtattttctagatacctggcatagtacttggttttctacttgacatccagaaaatacatttcacagcctctcaactcaaggagcttagaatccaatggggatgataaacattggctgtcatagacaaacaaatagagcacactaaactcatggtaaagataataacacctgccgggcttggtggcttatgtctgtactcgcagcactttgggaggaagaggctggtggatcacctgaggtcaggagttcgagaccagcctggccaacatggtgaaaccccgtctctactaaaaatacaaaattagctaggtatggtggcacatacctgtaatcccagctacaaaggaggctgaggcaggagaatcacctgagcccgggaagtggaggttgcagtaagctgagattgggccactgcactccagcctgggcgacagaacaagacttcatttcaaaaaaggttaataacacctaggtgtcctagaatgaaaaaataaatctcctagaactaaaatggaaaatgccgtggtgtaatttgaacttaccctggcctgagaggcacaagcttggcacactgtgcacaacaactatttgttaactgcataagcgataagagctgattaagtgaaaagacatgatattctttatctgttacctttctttctcacatggggccttgtagagctgaccgtttaagctttctccttcaagcctaggaagagggcagggtgcagaatgtgtcattggaagaaacaaatgggtgcaagctgactgccttgcttgtgactgtcacgttcaccacaaataaaatagcagaaggtttctgaaggcagggaccatgtatgtatcccagtgcccacaacagtgagtggggcctggcaagactcaataataaaaaaagtgctgaatgagagaataaataaatgagaaagaaaaatattatttcagggaagacatagagaaatcagagaagaggaaaaaaaaaacccacaaccaggacccataccatcatgttatccttttttttttttttttgaggcctttcctgtcctctctcatcattatttccctttttgtatacccacaaaggatcgagttatctatacttccttactaacattattttttatgagtctgaatttattatgaagagaaaagttatctgggggaaggatggtattgtattcatttttatatctccagtgcctaacctatcatctagcccatagcagataacatggttgctatagcttgaaaatgtcaccaaaagttcacgtgttgaaaacttaattgccgtgtaacagtattaagaggtgggacatttaggggtgattttgtgagggctctgccctcacgaatggattaatgttgttatcatgggagtgggttagttattgggagagttggctcctggtaaaaagataagtttgtctcccatttgctctcactctctctctctctcacacacacacatacacatacacatacacatgctctcttgcccttccaccatgggatgaccctccccagatgctggtgccatggtcttggatttcccagtcttcagaactgagaaataaatttcatttaaatagtgttacccagtccgtggtattctcttatagcaacacaaaacagactaggaaaatggtgaaatggtacctgtttattatgattgcttgggtcataacattcactgagcagacaagccttgctttcctgtgactgacttctggtcactcttttctttcctagcccagccttgtgtttgctgtctggttcacattttagacttttctactccttgtattacggacttccttcatttcacaaagcttaacttcattctccgtaaatgtgtgcattgcctccttgtgtctccttgagtgaaactccccactaacctctgttttgggctttctccccactcctgtgaggctctgctgccctctagggggccttgttcatcacacacttctcagggcccagttggatctgcacttggcaatacagtcctagtgtaggagtgtcatgacagtgctgcaaagcctcagtgctccttttcctgctcctacagtccccagtataaaatgtgtggctatataatgcagttgatttaggaacattaaacttgggcataagcaagcaagaagtctgtcaagaactgaaactcattacaagaggaggctggaagaggctaccacagggtctcagtgctcttggtaccaacgaaatccttggctatgagtatcacacctgcatcttgatagtttgcacattatattaaggtttgcactatagaatccggtagccaactaatgagaatgttctatttgacgaatgaacattgatttacatctttgcctgggcctttgggagacaaaaaacttcctcaaagagatgggacctgaaattgctttttgctaaaccctcaaccaacatctggtttccatacccaatgatgactcttaactctatctaacctgactcatctgcaactggaactattgactacttcttcatctttgaaacacatttttcctgtcatgctatcacttgtatctgggtctcagttcttggactttctttatttatctagtctctgggctctgttcttggttcttccaaattgtgcttacaaacaaaccccaaactctcctaattattggtccaattttcttgcagtttcctggacttgttcacttagatgtctcttagaaattttaaatttaatagttccaaaaacaaacacatatttcttcaaacctattctcttttaccttacccaccccaatccaaattatttctaatttagtcctattattatcaaatgcagttggccccccctcccccaccctttgattctctagtctgaacctttctttgagctcataggacataatataaacatgtccaaacttagttatcaattttacccttcaaacctcttctccttgaggttgaattacacaggtccaaatcctccattcacaaaggtaaaatctagcacccatctttaagtattctcttttctttatacgcaacattcaatcagttattaagtttcatcattatacattctagttgaaaccatcgtgatttctcacctatcctgttgcaatggacatctgatttccctcttctcttcttgtcactctaaattttattctatctacagaaaccagaaagatatcttgaacatattaatcttatgatgtaactcctcttctcaaagcttccgaagcttcctatcacattcaggacaatatacaaaatatatattttgtatattgtctgatccccaatcctcacctagtctgatccccaaataccagtccacatttttctgttgtcattctctccttttctcattttactttaatcacaatggagtttttgctagtctcctaaaatgaaaatctgtttcctgccttaagatctttttggttgttgctgtctttgcttgggatacatacctccacctcccagaactctgtgtgtcttattttctcgcttcattcttccttctctttaacttattcagaaggctgttcatgacactgtatctaaacatatctaaaattagtcccaaatcaatttcactgtaatacctcatcttgcttctctttttttaatgacaattaatactatgtatttgtttatgttttattggcattctctctgactatagttgaagttctttgagagctgagattttaggttgttcttcattttatcctcaaagcatagaacagtttctggcacacagcatattctcaatgaatagttactgaatgtgctaatgagtaaagtcaagatattaaattatagctaaagttccccagaattgtcctctattacaatgacttttgctttgctttatgtttaataattatatatgttaaaacttttgttgcagtttgcttggaatttggctaaatggagttttcttttaggaagatgtatacacatatatatgttcatagccatttcagtgaatggtaaagtcttaatatgggccctatgtgttcaaaacttctgtagactagatagtgaagaaagactttgtacgtggtgtaagcttgatgcgtggggataaatttcatgctaatgagattcatgtaaatgaatttctgtaaattcaatgaatttactttgtagaaacagcaatgtacaagaacaatttgagtggtgagggagcttggtttatgcagaagattaatgctgaggagaagcataaggttaaattgaaaaggtaagaagagcaagctgaagatactatgaggaattgccagtagtgtatttttcaacaaaaatggggaggtattgaatattttttagttggtcagatgtattggtttctcattcttctattaattaagatgtatagatatatgatattcaattgtatagcaattgtgaaaattaaaatgaggatacaaaatcaaaacattaaaaaacagttttacctatatctgattaaaaatgggtaaattgaggaccaggaaaaattaaacatgattgcattttcagagtgggaagtagaaaaatttgttgcatttaatagaaaactgggaagaaagaaactattacaaatggatttatttgatataaaagaaagtgagtttggatatgttaaggttgaggtgatcccaggtatgaaagtggagctatctagttgtcatttgtagactcacaaccagaactcaaggaagactaatactccagaattgaaagtgtaatgatgggatggttgaattctccaaagaagagaacaaaagtagacagaactcaaggaccacagattgaccttagggaataccctcagttaggagatgggagactgcctcaagtagccccaaaccttatctttgtgcctgccgttatctcttgctggaatgccttccctatataagcaactcaaacactcccattattcttgtactcaaggctatctcctctatgagttcctttaatagatcacttgagagttgaaattctatacctgattccatcttttcagactgacaggcaaatatttttcagctaaagaataatggaggctataataaggcatagtatgaagagcacaaggagtaggctggcagtcatgggttcacatcagctcaataacaagctgggcatacaggctcaaattatttcacctgtctgagtctcagctttcacaagtgtaaaaattagcatatttttattttacaaggctattgtacaatgaaataagatataatatgaaatagcacacagtactttgaaggaacttgataaatatgttttcttctttaaccagccaccagatatatctctatgcctaccaactaatggaaatatttgatctacaaaatgccttgtgggaggtggggaagggaaggagttgggacatagaaggtgagaccaaaaatgtgtgtccaggtgattgagaaaaggtagaaaacttattttagccaaagggctagagaaaaggatattcctatctttttcttgtttaatttctttccttgttaccaaaggaatgctgcttgggagaagagagttgttaactcacagaattatgcctgaggcatacttttctctcatattaagtgttatgttctgaaggaaatatgatttgcatgcaccagatacggtgcagcaagaccacttctaagcaggactaatgtaaataaaaggaacatttcttgagacagaattttgaaaataaaactgcttagtttaccttaccattcagagaatttataacaattaatcaaaaacatttcaatcaaatttaagtagtaacaaatgaggccactaacatcacatgcaaattaaaaaaatccactgtaatcacagcacttaaaaatatcaattcattatgcgaagggagtgttttagatgcaattcatcaaaatcatccagacatagtctttaatagctccacaaatatacttcaattattacggagccaaaccatttaattaatcactacaaagcatttcttccctcaaaataaaacactttaaaatatatcattcataacattacaacctgccagatctaaatcttcttagcatttaccttctacatctccagtgagagacattaatatatttaaaaagtatattactaggcactagtggagcacttggaaagttgacttattctcttggaaaatgaactactattgagtgttgattcacattaagggaggagctaagacttcaccagagactagagaagtgaatctttgctggtcacccagcacatatttatcagataacttgctaaaaacaagcaccaaattagttgctgagggtggaggcaaagaaagcaatgcctgcaagaaatttacagtcaagcacaggggaaaaacatgcaaatcaatggtacaatataacctgatgagttttataggagatctagagaatctaatggaaataacagttgataaaataagtgaaacacttgggttaggaattggagagtaagaaggcattttctaggtaatagaaagggagataaattcaggcattagtagaggcaggaagaataccaaagaaatggccaggaggcctggcacagttgctcatgcctgtaatcccagcaatttgggagaccagggagggtggatttcttgagctcaggggttcaagaccaagtgggggcaacatggtaatacctggtctctacaaaaaatacaaaaattagccaggtgtggtggcatgcacctgtggttccatttacttgggaggatcactttagcccaggccatggacgttgcttatgccactgcactccagcctgggtgacagagccacaccttgtctcaaagaaaaaaaaaaaaaacccaaacaaaacgaaacaaaccaaaccccaaccccccagagaacaaacaacaacaacaaaagaaatgtccaaggattgttgaaattgggaactatatgcagtttggcaccgtgttatagtatgtgtttggaggctatatagtatggtatacattttatatagccatactatatggctatatagtatgtgtttggaggtatagtatggcactggtggtgggggctctaggggcttgatgtagcagactggtggctggatccaaggttgggaaggccaagtcatcaagggccaggtcactaaggctctgtgagccatgtgaaagagttttagatttttatattctaaggcatgtatacccgctgaactcaatttgagtattgaataatgtgattacattttcactttaggaagattacgctggtagctgctgggacagggtggtggatcaacaagagagatttagaaaattatgtcagcagttcagacaataggttatgaagacctcatccatgaagatatcagtgaaaatgcaaaagataaggtaaaattagtaggagaaatgactggttggatgtgaagggtcagagcaagtaaaatgttaaggatgacacaggtttgggcaattagttgaagttacagcttttatccagagaagaaatagaagaagaagaagaaacttcaatcaaggtctggagaagtgatgataaaatcatcacttaatttcttggtcaaaatagtattttcttctaatgatctgatttaaatattaaaattatccagattgtcaagtacacttaattctaaaaattgacttaagtatttctactaggtaggtgcttaagaaatagctgatgaaattgaactgtacctgaccactttctaaaatacatgttccacaacaactttagaagtagttttcatttgaagaaaggaaataaaaataaaactgataaaatgaaaccgtgtacttcatctgaatctgtctttaggacacacatccaactccgtgtaccaatttagttcaagtcagccctgcttgcattatgcagacatttcagctaagaaacttaaatgtgcttcttgtgtacatttgctttcatgaccaaaccatattgtcttcagacgttgactggattataatacagatgagtacttcagacagtggctttatatcttctgaaagagaaactgataagggagtgggggggataaaaaaagaaaacagggaaatggacagtcatttattcagtttatcaagaggcttaaataggaagattcctaactgaaatcaagttgtaatgatgataatttcccaaatgtctttctcaatactgacatttcattgattcctacaaattctttaccagtctttcaaatacaatcttagtgtttataatttctggtagctaagctaatggactctagagacaaactgcttagatttgaatttaaagtccaatcctttccagctgtttgtccttgggcaatttatttaacctcacatgtctcaacttccttacttataaaatggggatactaatgttacctgtctcatggggttgttttaatggttcagtgaatatctatgtggtattgacagtagtacctgctactgtcagtctcaatttcacatgtctcaatttccttatttataaaatgggaatagtaatgttacctgtctcatggggttgttttagtggttcagtgaatgtctatgtggtactgacagtagtacctgctacatcataaatgctcattgaagttagttatcattagcccctatcatcccctttccacatcctacactccactttcccttctgtgggttctgcctatttagacttcagctggagtgtccaagaacttgactttaaatcctgtgatagttgcaaaaacagtctgacttcattcttggtctcttttctcatctacctcccaccagcagacctcaacctcttcatacttgcattgagcacttacttaggtataaaatgttgcagactctgacatattaattttccctgatagtaaaaggctacgtgccccttcacaattcttttttccccctccagaaatgggatgagtaagcatgtgacaaggcagattcgattcttattcacaaggtcaagctttagagaaattgatacattttagtagattttagagctaaaattcttaacctcaacagttgaattcaaaccttagtttagccgctcactgccttgggcaagcttctttccctctccacacttcagtgtcctcatcagtataggggtctaataaacttttcttacagggttattgtaagaagtgaattagattaaacagagagtacacatgggcacatggtacatcaccaatcaatggaagatcatggtagtttgactctgaagaattaacactggaagcagaactcattgaattgtaaaggtattttcactgtcaaaagtgactggtaggaagatatttaggcaagccttcttctatggtgtgtgaggtgtatgtttttaaaatctagcatcaacattctaggaaacagctacagctcattttttccaacttttaaatgtcacatctttttttttttttgagtcaggatctttgttgcccaggctggagtgcagtggcatgaccatagctcactgttgcctcaaactcctgggctcaagtgattctcccacctcagcctcctgagtaactggtatgatagctgtctgtcaccacatctagctattttgtttaatttttttgtagcgatggggtcttgctatgtcatccaggctggtcttgaactcctggcctcaagtgattctttcccactggcctcccaacattctaggattataagcataagccatcgtggctggactgttatatcatttttatggttatggaaatgtgatatcaatgataatcagcaaaccaagagatgaaatttagaaatttgtattaggaatcttcttcagctggtccatctgggaatcagcacctctactcttaccactgcttctgcaaaagtttgtctctgctgcttacattgagctctctgtgcaaacccacagtggtagtctttgattattgctacacaagctgagtgcatcttgggcagaaaggctttctcactggagttgcccaaagaacttcgcctgccacctactggccaggaaagggacctggtcgactgactgctggggaccaggttaggggttgaggggagaagaaaaggaggaggaaaaacagtccatagactgttgacacacaaggtctgattcttctctagcattactgaggatggtcagaaatgccccagagtttaaaagctgtctgctcctctcagcccataactcgtagtctgtctggcactattctccctggagatacagtcacagagcagtgtctgtacagtgaatgcaattaaacaaaagcctctaaaaatttccaaggggaaattagataacatgtgctttgatgtagggatttggagtttgaaggtgaaaaagacagccaagacatcagaagtctgcaactgcttagctccagttcatcacattagcattctgctaacatgtctttttttgttgttttttaaagtttttcactaaagtcaatttgctcagtttttctcaagtaccatcggacattttaaacattctttagattaagacaagtcctgaagttggacttctgttgtgagtgaatgatgaaatcaatttttcttgtgtttttattagttaatcaatcaaagggaaaagtgcttgctagtccatttgggctagaacatttggttctcattttgctatgctggcaggccgtagctctgtgcatggatgagaaaagtctacttttgtcctggtccattctccagcaataagccgtacactcagctgtatccagtggctagatagttcctgagagatgtgtccacagttcactcagagttcctgttccccctcattttcctctgatgttccttctgtgccttttctgcattgtcataatgtgtctgcctgagtcagagcacaatgtctggtgtgcctgactctcactaatgggccaagtgtggtcctgctctctttagcttctaatcaagactccagtgggatccagagtaaaagtgaacaggccacagcataggggaaaattaagatggatggtatagcacagcaggagcttgtttatccctgaggaatataagtagggggaattggtagaacttgctctcattttcacaccttgtattaccacgacagtgatttactgagtatctactcagagccaacctagggatgaatatattcttgtcctcaatgatctctggtagaacatgcatgttggggggaaaaatacagtgactttctgtgtgatacgtatgaccaaagtaaaaccttgtaagatgtcataaaacctcacaggagttttgggtagggaagaccaaaatctcctctccttttgcctaatccaagatagtctaccttttaaggagtgttgtggttaggaaaggatcattcatctgggatccagatcttatgaagggtgtattagttttctattgctgctttaaaagttgaccacaaatttagtggctttaaagcaaaagaaatttaatatcttacagttctggagatcagaaggctgaaatggcttccactgagttaaaatcatggtgtcagtagggctacattcctttctggaggctgtaggggacaatccatttccttgtatttttcggcttctagaggctgcttgcattccttggcttctatacccttcctccacattcaaagccagcagaatagcactttcaaatgtctctccgactctggcaccccgcttccctcttgtaatatctttgtgatcacattgggcccactggataatccaggatcatctttccttaacataattgcacctgcaagtcccttttgccatgtaagataacatagtcacaggttccagggaatagcatgtgaccatgtttgggggccatcatctggctactaaagaggacttccaggttgatattattctatcctattacttcccttgttttattcatgctattgaagatgtaataagatttttttgtttaatttagcttttgtttttacagcaattctacatgatgatgctgagatactagccaacttatatcccaagttcttttctaattccctgttaattaactatgttcctgcatctggcactgatgcagttgtttgtttggacctgaatgtaggggaagggcaaataatcttttggattggacattggctcctagtgaggtgaaaaagtgttcccctcaaccagaagtggagaaggtggatgaagacttttcacataatctctgagactgctatggaatttaccagatgggcagagtggagagtatgcttaataaccaatagcaagcctcttataatggcagtgttattatcttaccctcaggtgggccagcaatgtcctagagtttaatgaatctgcaaaacaaaagtttgaatatggagcaaacaggaaggagggaacaattacccacttgacatatcctcttgaaagcttaccagtcatggtactgtggaaagaacatgctgtttggactcagacaaccttggatgtcaggaccatttgtgtcccttaccagctatgtaatcttagatcacttaacctccctcagcttcaagtttctcacttttaaaacagagttaataatatctgactcatatcactggtgtgagcttagaatatgtaagtccattgttctcaaagtgaatctatgttgtgattcctaacccaggaatgtcatcattacttggaagttccttagcaaagcaatctctctggccctactccagacaaactgaatcagaaactctgggttgggaagtcttaccccataaaatagtagtacgcaaaacacatggaaaagagtctcacgcgactggactgggacttacttaacaaatgctgattgtaattattcttttcactgggagcctcattatattcaccatgctttttgcttttcagttactgtttgttttggaagaacatggccaatgacagatttatgtttgtttaccaagttgtggtctctcttttttctcaaactaaaaagtcacataaataaatgaaagaaacagcattattagtttgtatttctggctgtgccgttttaactcagcagagggggagtcacgcactctggcaacttctttatccagaatgtgctgtcgtgatgccacagagcaaggctaggcacaaagcttatgcacctgagagatgctgtgactattttcttcagttgcttttttaaattttttgactaaatatacatgaaaaacataagcgcacacatacctcaccaaatacagcttcatattatatgatgcataaaatttattgcagtgatttatcatttagtttctatgtaattaagtaaagatggatccacatgttctgggccaagttaaaactcatattttttatgaagaatcataaatgcactgccaaaccacaacaggaatgagggaaatggctaaaactcacaaaccgcctttaaaccctgaggaaagtttgacttctagaaaagcagttaagcagaaacttattaacttgccaccgaaggatgtaatgaaaatttggagggccatggatccccaggatagagcaatgatttcctagtagttcaggcaggattcctgaagtcaaatatttccatgtcagtagcattctaaagagtaaagtcatgtaacctactcagattgtcaccaggactgtctattaggtggggtcatgagatgaccccaggattagtgaaaagaaaactcacatttcatggatatgaactgtgggacacattcttttcttttctttttttttttttttttagatggagtcttgctctgtcacctaggctggagtgcaatggcgcaatcttggctcactgcaatctccaccttctgggtttaagcaattctcctgcctcagtctcccaagtagctgggattacaggtgcccaccatcatgccccgctaatttttatatttttggtagagacagggtttcaccatgttggtcaggctggtcttaaactcctgacctcatgatccgcctgccttagcctcccaaagttctgggattacaggcatgagccaccatgcatggccctgtgggatacatcctgtattatgttcacagtggacctttgagcacaatacagagtgaaatgaatatttttgtccttattttctagaggctctgagaatttaagtgcttagtctagggtcctggcttataaatgtcaaagtcaggattagaatgcatgtcttcgctgacaaggctcacttccctataccacactacttctgtcaaattatgacatgagagacaccgacggctaccttgttccatcagggtcacttggactgatttgcctatataccaaaaaaagaaaaaaaatgttgcatttagggttatttctctgggactaaaaatctgtgtcaaaatatgtggcagaaatacattcatcatgaccttatttatcaacagtaacaagaacaaaatgagatacatgcttgagaaaataaatccaccagtaaagcaatgttggaatgaaaaagagctttgaagatacatagacctgcgtttgaatcctaaattttggttctaccacctattagttcactaactaaaggctattaggcctctatgtgcttccgttactaatttttctttatatgtggataggcgatgatagtttctattttaaaatactatgtgaagatccaatgagataacagataaaagtacttagcacagtatctgtcataaagtagttgctcattaagtgtttactgcataaaggatgaagcaagccattattaatccttatcatcatagcacagattaatttatctcttctctagcagagaggaggggaagttttgattgcatatggtgtgtggaggcatcaggctgatgctggggaggtagccatgagtattatggaattggatgtctaaagtgggtgttaagaagggaaaagaggcaactgaaaggaaattgggaaagctggaaggtggttggctgatggctccttgaggctaagcttataaggaaacaatagaggatcctcctctgccccttccctgtcagcttcatctcctgttacctgctgacacacattttacatgcttgtgattccctgcacacaccatgttgtttcatacttctgggctgttgctcctgttgtttcccagtatggtgtattccacggttttcacgtggcttaatcatccttttttttttttttttaatactttaagttctggggtacatgtgcagaacatgtaggtttgttacataggtatacacgtgccatggtggtttgcttcacccctcaacccatcacctacattaggtatttctcctaatgctatccctttgagattcaactcaagtgtcacctttcctgaaaccttcaaattggacttagtttattcttcagtgacttctgatttctctgtgcatttttctctctcatcacttcatactctaaaacattgctttgtgtatgaattgatctcccccactactctgtgagcttttccaaagggcaggctttgtgtcttgtttatctttattctcccagaactcagcaatgtacccagtatataatgattattctaaaaactctggttgaattacactggactgaaccaaggtgggaagcataaggatcctttgcctatttcatttcacttcagattaggcactctctccaaagaaaagtaactatatcagggtttgtgactcagctcttggcgatttatggccaggtgagtttgtaaatacagccccacattcgaaacaacaatcccagcttgttgttctcactgcttttgggagctgtcattccagtcagtgtttctgcagttcctcattaattgttattatccaaagtaagcacctgttgaatgccattgtgctaagggataggtgggatttggaaaagggttgcaatttctgctgttgagatttcacaggctgcactcctgtaattttgttctaaggggagagagtgggaaagggttagatgacttgaaacattgacctgctggcaggtggatcatgaggtcaagagatcgagaccatcctggacaacatggtgaaaccccatctcttctaaaaatccaaaaattagctgggtgtggtggtgcgcgcttatagtcccacaacttgggaggctgaggcaggagaatcgcttgaaactgagaggtggaggttgcagtgagcccagatcatacctctgcactacagcctggcaacagagtgagactccatctcaaaaaaaaaaaaaaaaaaaaaaaaaatacaacaaacaacacaaacacaaaacagcataattctcaaagtatatttataaagttctatttttttaagtttgtgggacttcttggagggaaaaattagtaaatagaagcagagtaaaaatgtggtttataaagagctcataataaaagtttataataaaaactttgtaactaaaaatattataccaaaaagtagtgtaagtcttctcaattcctgtaaaaatattatacataataaaaataagtcagtcagattttattctcataaagaaaatctatacaaatatttgaaaatcaccaccaaatttcaggcagttcttaaggtttaaattttatctcagaagcttttgtgtactctattcacaatcaaatttggttcattcaggatatgatggaatcagaagtgtgcagtgcaataaagatgcagggagcagttttcaaggaaattccttggcggggagttctactcctcactcattaatctcagtttttcctcagttagggctgccatgtttgtcataagggctggaataaggaacacagcttaaaggttacctgagtgggctatgaagctagcttccttttattctaatccttcctcttctacttactatctgaatggggaagtcaattagcttctgtttgcctcagtttcctcatgtgtacaataaatgagctaataatgcctaccccatagattgttgtggatataaaaagattcattacatttaaggggtttagagcagtgcctggcccatagcaagtgctcaataactattactccctagcttcagccttttcttgttcactggcaaatgccagtgcagctcagacattagttatttatccatgtattcatttaacaaacatttttgagtattgagtatgtgattggcactgtgcacggtgcaaatgatacagaaaatgagtaagctcctctctttaataagttcatggtatagtgtgtgtctgtggcgagtctagagatgatggtgcaaaagagtctttcaattaaacagacaattctaacgtgggatgataaatgctctgtagtgagaagcacatggctcatttggatcataaggaggggaacttaatgcagtctcagagggccaggagaggctttccagcagaattggtatctaagatgagtatgagttggccaagtgagagttgagggtgagatggggtaggtgtatttcataccaaagtagctgcctctctagaggccatagagcaaggaaattgtataaggatcagtgtggaaagtcaggcagggggtggccagaagcaaggctagctaagggtgaaggagtcagattagcaagggcctttcctattatgcaaaagaactttatggctctatcctgtcctactgggcggagaagccctgaaggcttctaaacagggtttaaaacacttagatagtttttcttgtttgaatgagtatcttttaaacattatttctaatttcgggcagaatttactacttctacctttgggtccttctgtttctctataggctcctatcatggcactgtattgctttattgaacttaactgtttctaatcctgcctttcctgggagactgagggcttcccaaagattgttttttatctatctctgtatccctaggatctggaacagttactgatgctgctgagtaggcattcaatggaagcttgattttaaaaagaaaagttgattttagaaagaaagcattttttttcttatatttttaggacaaagcattatcagataaaatctggcccatcaagtcagcaaagtgagtaatcttgttcactctgaaggcagtgtgagctccatgaggtgctgcccaacagatctctaatccacctgtccttctgtgtgctctttattaatcactgcatggcaagcactgtgctaggcaccaagggagatataaatacgctgaagacagcattagatagttgtgaaaatgttacatatgtacacaaaacaaactcaatatcccgagggcctagcacagtggtggtattgctcagtcctcagtcaatgtctgtgaataaataacaagtgaagaaagggagagtgatatgtgtgaaatatatggaatacataataaatgctccaagagtccagatgtgggaaaatctgtgagatgggtaaatctgatagggtctcattgaggtgtcctagccttggaagatgagtaggatctggagagatagaaggaaaaggtggaggactctaaagaacgagaaatagcatgaacatcacttcatgcagactaataatgcctgaaggaaatataagccattggaaattatgaaagctctgacaacaattggagtatattggaattcacacaaatgaaccagttttctaggcatattgtaattcggccaatgaatgtggggagaccagcagttgctttagcagacagccaaagtgggccctcgtgacaatgctaattaaagcaaagttaattagttaattaaaacagaagtggcaaatggcagtttctaaatttcagttaaggtggaggcaacactaatgattctgccccctgactagaatcccaggggagggttttgacttctgagaaaatttataacttccagctgtaggtctctgtcatcaatttagccatgaaaggcccattgcattttagaaccccagttccatgtgcctggaaattctgaatcttgcagagctagaactttagattcatcagattcaatgctttatttaggtcagaactggccttgtgttcatttgtcaatttgcagctgaagtgaatgccttaaacggaagcctggcattatctgcttgacaatgatttgatgctgcaccatgttgtgctggaaattagtgtctagaaccaaaatgttaatcacagggacctctatacattgatggcataaatagcatgtttccatataaaaaaatctgtagtgactcatttccatttaaataaaaatctccctttgctatttcagtgaattgaatggctgattccgggcccttttctatttgtgctctaggttgagccaatttaacttcacagaaaattgttggatctgttagaattacctctgttgtctccttaggtgctcagagagctcaaagtgattctttctccatgatgagaggtggaaatttgcttcgtctagcccccttctcactaaagatatgaactactcttcaggccccataaacatgtcttctcttgggtctatgatgatgttttccaaagtaagttctttggagcatcagttcttcagaatgttaagaggtttacttggaaaaaaatggtcttgtatacatgtttgcaaaatgatagaaagagttaacaaatagatgataggtttctacagtgcaagacttctcagtgtttatctccaataagagaatagagttttttcacctttttgaccaaataatttctttttcatggagctatttaatttttcaaagaatatactaattttccaaagaaaacagtccatatatgcttagctctagtaatcatcagctaagaccttaatttaaaaactgctccattactcattagtcatgaaacaataggcaagtattctcaccgtgcaggacctcaaatttcccatctgaaaaatgggaggattgttgcttcaacttgcagtattttatgacaattagaaatgttagactagttatacatacaaaaagttctgtaaggtggcagaacatagtaggtaggtaataaatgaaccattttgggggactactctgatttgaaacttttttccagtctcctactttgtgctccacttcttcttacttctttcctcttctttgctctcttctctgttccattcctcttccttctgcgactgctaccaccgtgactactactaggtgctaacattttaggcactatgcactggattatctaacaaacacctgacacgccattttttctttccatttccatgatagagatggaagaggctaaatgtcactttcccatattctcttatattagacagtttgggccagtgagacacaagggcaattcttatgggactctgagaagacttttgttttccctaatgaaagtacacaatgtatggaaccatgacaactatattacaaccattagtaaaaggcctagagaatggtagaagtgtttgcctttgcatcactgaaccaacacccgaagaaatctccctccacaatttttataacatgaggaaaatgaactctaaagagtataagtgtttgaaaacaggctttctgctacttgcagacacaattctaaaaggttgaggtagcatttattgaatactttctacgtgctggtactaaacacttaatgcatattacctcatttactactcaaaataggaattattatctaccattttacagttgagaaaacagactaaagtgccttattcaaattcatagctgaattgaaatccaggtgtggttccaaagccagaactctaaactagtatgctgcctttgcattttccatctgtgtacatacacctttccaggagcctgtacaaacttttggagacatagttaccataatcttagatattattatagtcttcattttgaggtacacaattagtatcctctttaagatagagagcccttaccatctgccattccatgtggaagggacacacacgaccccatccagaaacagagggcatacccaatctcagattatagcagcctgtttcttcatacacctgacagaggacagcagaacagggctgggtcgagcatggtagatgcttctccaccaaagacctacatccagagactttatttacctatttaagcccacatgacatcccaagagatgggctcaatagcatattaaaattttcaagactgagaagcacaactcagggaagcaatttagaagaaaatgtaaaaatattagaaatacctgaatttatttgtttcccattagttaagctgaagtgcggtgaaccatgtgttatacactggcttttcataaaagtaattatcaaatgggagctgaatccctgcataaccagctatatcctatagtgtaataaatatgctaaacatcacagattttgtatcacagagaagaaatatttagttttggagctcatggaagccatagaggaaaggaattttagtttgcatctctttctaatgactgtgggttaaaaaggagagcagatatcagatgcatgtgatacaaaagaattatagctttccctgcccctttttcttatccatatcaaaagcaggttctagcttgaatatgccagttgatgtcaaaaaagaaatctccatataatcagactgtggcctgtgtcagctataatcacatagacagatcaagatttgccaagattgcagaaagaagaccaaacacttgccaaaggtttctctttaccctctttcagattctaacatccaaatgcacagatttcaaaaaaactacatggccctgtaggaaaaacaagttaaaatattgcaacaaaaatctttagaatttccgttttctagtggttggcactatcagtaaaatttgttgcttttgtttgtccctttgtttattaaattagaaacaaaacagttgaaaatatttattgaatgttactagagaaactttataactatagtaaagcaagggatcagtgatccgattctagagcagagactgatgaccacaggagtgagagagatatctgtaatacagggcactgttgccttaatcttataaaagttaatagtacaactagggagtaagagtgtgcacatttgaagacaagcaaaaaaagtacctaccacattaataccatcccaaattcattcaacaaacataccaaaaatcattattgagcatattctatgtgtcaagcacccttcaaggtacaggtaggtattggaggcacagtgatgagcaaggtaaagaaggcctccatccctaaggagcttgctctgcttaaattggaagacaggatgtgctatacagaatggcaaagagctggacaacatgaagatcgagatgccctgtaaaactcagattgtataatcaatgtctccataggtttgtgctgccgtttatagtgctgtctttgttattaagatcatccagattgtgtattgggtacagtaactttcatgagtaaaagaagactgacaatggttaacttagttaatcaaaatagcaaatacttaagaagggcttactatgtggcagacactatacacatgttaacttattcagtcatcacaaccagtctatgaagtatgcatttctttatctccattttttcggaggaagaaatcaaagcatagagaggttaagtgaatttgcctaaggttctgcacctgctaagtgatgctgccagtatttaatcccagtgctctccagcactatactgtgctaccttcaataaagtgcctactatgtgccagccattacacatattatctccttcattttttacaatccagtttgtcagatgatagaaataaggtgcagagagacaaagtagcactgctgttgttcaaacccaaaacaatctggctaggcagccagtgttctctgccaccactccatgctgtctccctaaggggctttctctagtgagttttttacgtgctcagacatagactcacaattcccttcctccatcaatatgcttgttttatataccaggctttcctgggagattctgtttacagataggacttgaagaaaagctgataaaacaaaagtttgaaaaataaattttcttagccaaaaggaaaggctgatcttgcagaaatttcagaaaaagaatggttcatacaggagtcaggaaggcagatggaaaataggccagcaggttagatatatgaaaggcctgctgtgtacagaccatgacattgccaggatttattgaaaaagaagacatgagttacagtttaattgaatgtcttgtacaatgtacgtagaaagagatgagaagtgtaaaacaagtagaaaagagttgaaagaggtaagagtacaagttaataatgtaaacgaattggaccttgtggataaaattcaactatcctctgatttattttcaaacttcagcagacatagtatctttaccatcataataagtcatactttgaagatttagggctgacagaaaagtaggactttcctgcaggctaagtgatagtataggagaatagttcaagagatgttatttagatatgtagcttccatttgaaatctacatatcttccatttatttatctagattttagaaatactgttaaatttcagaagagttagcagggctgatgtcttgaccagctcttttgattacacattacacttcttaaatagaggtgatacttagtcccagttatcaacaattggtgttgcctttttcatacttcaacatttttcccaagccactgataacatgatcttgtcttttgaagtgctttgggatcatttatcacataaggaagttccttatatgggggaaatcattggcttctggctttagattcttttcagattgaaatggtcgaataactactacctgtgatattgaacttggggtgggatgagactataggcaacaaagaattgggaaaatgactggttgtttttatgtgcaaagtcactttgttgttttgcccttttcagctgcttagacatctcctaaagatttcatcttgcccattaagaactaaaatataaatcctacattcttgtgcctctattggatgggcatttaagcactcttctggcttgaataaggtttaggcacgtacaagtgcagtctgatgtgtcgagttcttggcattttgctctcagtataatctttgttagtaatatatttttactctgttctggtgaactagaatttaacccacagtataactctgtcccctcagaacttgagggtccttgccttggctttgtgagctaactctgctctgtctgccctctcaacctcactccccctacgctgtaactctgctttattagagattttgacttccatgtttctagacttggcctaagtaattggacccacatcccattaaccccataaataccattttatgagaaggtccatgccgtaagtcaccctgcctcacatggtttcatttacccagatttctcccatttaaaagacccaggaaacacatgcctctgctccagttttaggggccagcatccctgtaagcccccacaacttttaccttaaggtttccccagaggagccccttctcttccacaggttgactaggctgctggatctgctggctgcggaggatgacttgccatcccctacatgcatgcgcaccacggtagatgtggtgaaggcgctgcgcacgtttctctctggtttggccaggatgatgtacaccttcggcacaaacatgcagcctagggccactgtggcactgaggctgaccgagaaacacatggtgatgattttgtagttgctgccaaagtagattggcacaaaagctagccatataatgcaggtcgtgtacattgtgaaggcgatatacttggcctcgttgaagttagctggaacatttctggtcttgaacgcatagaaggtgcagctcaaaatcaacaatccattgtatccaagtggagtgacaactcctaggttggtggtgttacagatcaggtagacttctcgaatgcttgggtagtcatgcattatgtcaggaggctccattataaagagggcaacgatgatgcccaactggatgcatatgagaatgaaagcaatcactagctgggcacaggcactcatgaatctgggctttttggtacagatcttcttcttgctgccagccaggatccttgcaatacggttggtctttgttacaagggctgagtagctcatggctggggagagaccaatgccaattctctgaaggtagcagtaaatctgtttgggcttcgcaatgaggcagaaggtacataagtagcccaggcagatgccagcaaggataatgtagcagagttccctgcttgaggacttgactactggtgtatcacggtaaatgatgaagactacagtaacaaacagggtggccaggaggccaaggcaggcaaacaccacagctgcaatgggttcagggtcaccccatcgaagatactgtactgggatcaagtcacaacctgcagagacacaaacacatattgtaaaggagggagagatgttgacttgggtcacatatccctaagttacaagcagctgtttatgaccatttcagtttgttccccatctacctttctaatttcagaatctcctgctacttattgtttcatgtattcattcagaaaacgttaatgatgatattactgaacatgtacatggtctgtgataggaactattctaggttctgaaacaaaataatgcagaacatgtttcctgctctcataaaaaaaaatcagtggccttttaaacaactgtaactgtgataagggtcatgaagaggtataacatgggttctaagcagtctcttgaagcagcaaaggcctcctacaataggaatgagcaaataaatgtgttggtttgatggagttggggatttcatgggcttggcaaacttacagttaaagtacattaactgtaaggaagagaggcatgaagggaagccactgtatgacagtgtaacaagtggcctaagatgaggctgggaggtagggaggaaggggatcttgcaggttagagaatcctagatcagtaggaagttattctaaggatctttgtagagcaatgacaagctcagatttgtgtgtgcgtgtgtgttttaaacatttctttggtttctgtgtgggttttggatgagataaaggtgtgcacacatttaagacttattttagagccatatagagtgtttgaatggatgtgggagtgtgtgaaaagtgaaaaagatatgaaatatgaccaacactagtaaagaagagttggaattttcagagaatcttgtggtctagatgttttagaagattctgttaaaaaaaggaggaagttcatttttataagaaaactgaccccaaaggcaaacaattggcaggcaagggaagtgcaccactctcaaaatcgttccttattctttatttatgatatggagtttttaaattattccttgattatatagcagaaaaatagtgacagaatatagcatcatttggattatctgtcttttacaattttttaggacagtggttctcaaagttggctacacactagaatcaccaagactatatatatacatatttacacacatatataaaatcctgagacctgggtgtcccattggttgagcttctgacttaatttgtctgagtgtgacatgggcatcaggattttttaacaatactgcaagtgcttctaatgtgcaaccaaagttgagaaccattgttctaggaggatcattcctgtcagttagacttgaaagaaaatggacttgagatagcttcactgagtaagtaggaaaggaggcaagtaatctggagcattgggcatttgaggaatgtagcagaaatgactaattgcatgtcaatatctattctccccttcattctcagcaatagacctctaatttcatttgggatggtaaaggcattagttacaatactacatttttcatcaaccattgctgtgaaatgtggcataggaataggtttcagccaataacatgtacacagaggattcctgaaaggaaaatgactcatggtagaaagtaacctttttcccttctttactttcttcttctgctgcctggcacataaacatgatggctacagctccagcagttgttttggacttcaaggtaacttgaaggacagaaaatgtgttctgggtttggaagagaaaaatagagggggctccactccctgagaaccatggaccccccactacctgtggactatgcatatccacatcttctttgtttaagctcctttcatttatttattttcttgatatatgcagggaaaacaaatcctcattgataaggagtaaagttttcctattaacttgtcctatcccatgatcaagggtgttgcagtcagtggctttgaatatcaatggttactgggaggtaggggaggcaacaacaagtaatgacagcaaggaagcatgtagttctttcaaaatatgcctaagggtagcttcgttgtagaaagggaagggaagaagggaagggaagaaacaaaggaaagagaaggggaaggggaaagggaagggaagggaattattcttccccttatttctgccctgctgctgttttgctttaagatctcacatttcagatagtactattagtactataattaaagtcataatggatttaataggagttatgagctagcctgggattctcagcacactttgtaaaatgtttctatgggaaaatgtattcttactctaaataattgtgcatttaatattgaaacaaagggctttaaattttaaaaaattgtggatagctcagactaaatataactaaatacaaaacagttgtgttatatgacctcattaagtataaaaatacatatctcattgctaattaatatacctatatctgtatttctagtcatctacgttcccatgtgcttcctatatagttggaattcaacctctgatactttagtatgccatagagtttaggcttatatttacaaatttgctccttggagaggctgttttaccaaaaaaagtattaataatatatatatatatatatatattttttttttttttttttttttttttgagacatagtcgccctttgtcacccaggctagagtgcagtggtgtgatcttggctcactgcaacctctgcctcccgagttcaagcgattcttgtgcctcagccgcctgagctgggattacaggcactcccggctaatttttttgtatatttagtagagacgggatttcaccatgttggccaggctggtcgaactccttgccctgagtgatccaccttcctcggcctctcaaagtgctgggattacaggcatgagccactgtacctatcccattcctatatttattattttatattagttcatttatagcaatgatttgacaataaaatttattaaatatatagaggtctgtttctactgctaggtcatgtgctgctaacgtccatagcaatttacttatataggaaacgttatgtttgtatatagggcaggaatcttttcattacctaaaagaatgagctggaaaaagtaattaaacacttaattttaccccagtttttcctactgttctgctaaatcttaattgttttcatcttaatgtaattaagtttaatttctaaatactttgcatagaataacatttactactatttttatcagatatatttttgaactcttcatgttcagcttattaacatctgtgtgaaactaaagaaaactcattagatatatgtgttaaaaatgtacatgaggcttgtctctaatgtgatgtaattattttcccaaatctttcaggatttatatattaaatgaatgcttcttttatttaatgtaaaccatttagaaagtcttacatttagtttgatgccttcattgcaaaaaatactgttgtaactattctctaagaatagcaaactggactctgattaaagggttataatcactgaatcttataattgaataagatcttagagtttccaaaaaatggatgcgtatcacaatcacttgggaagcctacaaaactgtaactcaggagtctaaactcagaagattttgagtcagtacattgtggtggggcaaaggaatctttattttgaataagcaacttcagttatgctatattagtctttggtgcaatttaaccttagagattatcaagccaaattcttacccatcgtgcaaatgccttatatgataactccaagatgtaatcatcctaaccttacttaaggctttttataaaatatatcatctcaagggcaggactggtggtggtgtggggagatagattgaaaaggcaggaggctgtgatggcaagtgaagactggaaatgaagaaaccagtcagaagactatcacaaggagacagggatgataaagacaaaaactaagtaactgtactagagaaaacaattagttggtaaagacatttcagaactggaattgaaagaaattatgaagaagatagaagaatcaagaagaaaggctttgtagctgatagcaatactgttaactaagatgagggcttaggaagcaaagggtcacatttcatgggaatgatatctagctccagtttgagcatgctgtttgtactgggtctgacctagtgagctttgaaaagctatcagtgtggaagttacagctttaggaatcatctttttatagaagctgaaaataagagacatggaaataaacacaaccaatgaggaaattcttagatgtggatgagagcagagcctagcagtctggtgtaacaccaatactaatgaatgagagagggagagaatatgtcagagaagatgtaacatcagacagaaggaaggaagtgtatcagaagccaaaggaaagtattaattggatggcccaccacagtctcctctaacaatatcagttctgttttactttttaaaattcttacccaaatagcttgcacaaagcttcaagcttcaggttcacagatatctcttctgacattagataattatatgtttttttcccttcactagtattagatttatttcttttgaataagggatattatactttctaacatgaaacaaggtctaccaaatctcagaatcttgaaataatgctaacctcattatgatataaatttaaattctcagtgataactacccttactatgtacacagttgtacaaatatctgtgtagttattgttcctaacttccttattttcttctaatcactgggcattttttccatcaatggttgtattttttatccctgtttcatccttactgtaatggtaagttactggaagtgtatgtagaggttacctaagagtctaaagcgcatataatgtatagttttattatgaatttaatcaatttagcatatgttattatattttaaattaaataatcttgatcatgtcagtgaaattccttcctaacaagcatattgccatttctctggttctcagaaaatgcacagtattatattattttctagaaatgcagatgaaacatggattagaaaactgcggtccattttctaataacatctatttaggtatctattcacttttaatttttcttcccttttatacttgattcgtaagtctgtggttctcttgtataatccatcttttcaaaacttgaactgacatatattgaaaagacaagtttttctttttttaaagagggaaagtgagctgccaaaactatattgtccactttcattctattacttcactaatgtgttccccataagtctaatagcagaatggatgatctactgattttctggacccctaaaaatgatgtgactcctcattcacagctggtactcatgcttagattgttagttttgcagtattaatattcctgtagttactagtttctagactgctgcatttttcaaaccctgttccaagtgtctcttcagggagagatgcctgatgttctgtaaattgggctgaacaagagctccttaccaagctcctacattcctgtatattttggataaaggaagttgctgtttagaatctctgagaataagatgtatgtgctctcagctgctggttaggtcatttcaggtatacaatgagaaggaagatataagatagattataaaaaactgatctattaaaactaatatggggatacagaactgacaaggggctgttgtgggtttcctctttgatatttgagcaacagatctgtccagagcacaaggtgttgactggtgactaacaacatcatgcttgctttccatctatttaactaataagccatctttctgcctttccttctttctttacctctctggatttggatctcatggatgttgaactgggatcacagggtgatacagaatcagaattctgtgtctagtgttcatatccctgatcctttaatattttttctttacttagcctgagctaaagtttttcatcacttccataattcagagaatttgaaatggtgggtgtctgtgtgtgctgtgagacattgaggaaactcatttctctctgtagcacttactgtatttataatctattttgtggtagggggagtttgattgactgtatcattaaggtctgtcttctctacttgactagaagcaccctgatgatagggagtttgtctcttttgcacacaaacgggtcctcagtactgagcacagtgcctcactcatatggttaatatagcattttacaaattaatatattttgtatacaattaaatatagaattctaattctagtgcatggataagtcattctcaaaaaacttttgcgttgcctttagaagtcccaagttacagaactattatgtagtgttttaggcagaagtctaaaatcaattcactacacctgaatttgagtctagtttctggaacccaaagagggcaaaactagataagcagctcaaaaacttacttctgcctagggacgtgacatgtttcatattagaaatattcctcgtgggcaggtgcagtggctcatgcctgtaatcccagcactttgggaggccgaggtgggtggatcacaaggtcaggagttcaagacaagcctggccaatatggtgaaactccatctctactaaaaatacagaaattagccaggcatggtggcaggcacctgtagtcccagctactcaggaggctgaggcaggagaatcgcttgaacccaggagatggaggttgcagtgagccaagattgcaccactgcactccagcctgggtgacagagtgagactccatctcaaagaaaaagaaatattcctcatgctgactagtcatttgggacattttttatgactgattaatctaattttgagtaattcattggatctgggaagtatgtatagaggaaagaatgagacagtaaccagtaaagtcattctttagaaagtgccatccaactatgaaggtcagatagatgtacttttcttaaggaggctgttaattgtaacttttcttttcttttttttttttttttactttagcatagaaaaaaaaaatagaaaagttcccaagttttcttcaaggaaggcatattctacagttgattgatttttaccttagcacgaaacaaaacatggcatgattgctttctccaataaaaagagagtctttatccaaggtgttaagcaagttttattggtaactgcctcaacaggaagctgccatattcctctttatgtcagtatcaaaagaaaaaagagactaacatttattgaatgcctactatatatcatgtgttattccagaaattttatgtaatcatcataataaaaaatgaggtaaatatcattatctctatttttcagagggggcagtatgaagcttaattagatatgttaactttctgggactgagattaaaactctgtggttatctactaacttatttatttattttatctttgctacatcaggggaggcaacttggccagttactcctctgaaagaagtcctgagtctatttagtaggaaacagaatcatgattaattaacaatgtctgcatgggcaaggtggggctagtggtggcataaatatttgatagctttatcttgatataaatccatgcttcctcttgagaaatctcattggttcaaacccttcagcaagattttcgttctgggctatatgtccttagagttgctgccagagacactgattgatcagttgtttttcttgggttcctaaagttttctagcatagaaaatgttctgaatgatcattcatgggacattcccaactttgctacagagtagactcacagccatccatttgtcattggacctagcctattccccatccttcaaggtttattacacatctcgttttagattccttaatagaattccttcacagagctgaaaattcacagctatagtttttatttttgttttttttaattggttatattttataggggaatttgaaattgtgtgcaaagatttattttataattaagacataaagaatgatttaatagtactgcagagtactaaagggaaatgtgatcacagatgcacatttgtaggaaatagctttgaaaaatatgacttccggtcatactgcacatggataagagtggaaaaacacagcatgtgaatttaaataataaagcgtgctgactggaataattccctccctttctacttttctccagtccctttttactagctaacttctccttattcttctactttccagattctccttgatgagtatgacttttctgattccctgaagctgactgacaggttcctctcatgtggtcaaatggctccctgggcctgtacccgtcatagcacttgcattcttactaattgtgtattagtattgtctctttgaaatggtagatttagcaatttgagaggaggagactgtttctttgcttgttgtatttctagtgctagtcatagtacctggcacacaataggcagttaaataagtttaatgaatgaatgaatgattaacaaagaagagggcaagtaaggaataaggaggcatgcccttcattttcagcttgcacacaaatatttcctattaatatgagccttttactctatgtctcaattttttcatatataaaatgaaaataatacagacttatcttatctataattagggttttaatctggagaaacccttgcagaagaattcacagatgagaaattaaagaccaatgacctgaaaaaggtcagtgaagcaatttctcagaaataaatttataaaatgcttaaagttgtttttgtattttattgaaataaaacattaaactcatcattttaaaaccgatagggtatcagtggaattttgcacacataataggagctataatttggattttacgattcatttctatttatccttgctagcttgccagacccttgtcaagatccctttcctgcagttttagtcagactcataaaattgcttattttgcaaataagctgcatactaaaaagcactttcctactgtagctggtcatccatccaaatgttcaataactttctgattttgtgactcagaattttgcaaccactctccaggccccactatattccttctgtgttcccatatacccttgattttttttttcctttgaggcataccaggactattctaagacctgaaattacattacctttcctaaggaaggttgcaaaattgtatgcatattctgccacagattttacctcctttttctctttccaagcctatttgttcctaaattttaagtatcgttaagtattctccagttgagctatgggcatacatttaactattcaaatgctcatgtttattacagaaagaaaatatggggacaaagtgcacacatgtaagaaaaatgtacaaggggaaagattaatgcctcatcccacccattaaagagattgaacattgttcacacagcacagctacagcatttcactcttgagcacctacaccattcataccacttggtccacactatggtgatagaaaggtaattgtttgttcctttaaaataatgtattgaccaaatgctcaggctctgtgactttactctgctagtcattgtattgaacactttattcttattaccttctttaatacctacaaggtcctcatgcgatagggaccattatttcatctattttcagttaaggaaactattttctgttggaactaaagagcatttgaaaggaaccatagaaagagaaacacagacatagagaaaagcagaagaaatgtaaaggaaacagccaaaatgcaaaagtcagatatgcagaggaaaaaactctacagcatagtaatgtatcaagagaattacaatgtctttgggaattattgctgatagttcagatggggaattagcaaaagctttaggagggaaggtgataatacctatctgcctacatctcaaggattagtgtgaggaccatataaaataaattggacagtggcataataattatgaagtgagagaaagtggaaatggggaagtgtatatacaaaacggtgtgactcaacatctgctaaagtgcctgttttattagattatcctttattattctggggaaaagccaggctactttctctctctagcttgtttaggtatgtgttgccccaagtaaatggtattatgttgtcttaaattgtctgtaagtacaagacagcccataatgctttgaatttttcatcacctcaattaatgtgattttttaagaggtgtcaagataggaggaatttatctgcttcatattactcatataatatatcaatgctttgtgaagcattttccaagtaggttagataatgcaatagttagcactgtatcataatgtttcttgttctaaggggaaaatgtgataatttattttgggtaagctacattgaccaaaaactgaaatcaatgaaatcacattattgtcttcagtctggccatgtcagagtggtttttgaccacaatgccattgttttggtcagaccacaaatttatcattgtgaagaagaacatggtgaacatttttcatcgagtggtttctggcaagatgaaaactggtttatgttcttttcagggacctgttttgataagttccactaagagaggggctttcagccctttttttcttctttagtcagtggcgtttacaagtttaaatatactgactttttgactcatcttgtaggaagaaaattattaaaagttaatgaacgttgagaaattggaagagtaagaaggcattttagaatttatcaatgtgtaagccctggaatctcattttaaaagaaccagaacacaacattgttgtttttagtgctaactgaaacaactttatcaagctaactgtttgaaaaaaaaaagacagtgcacaaaatttttcattgcattttagagatcctgttagaaagaatccattgattcacaatcacttccatatttcctgcagcatcatgtcaaggaaaaagcactagttttacagaaagatgaaacagggtctgagccttactctcctgcttactgtgtgatcatgagcatggatattttcaattttcaaactcaattttctgtaaaatggaaatcatgattccaaccttttttaaagtttatttttataattttaatttttatgggtacctagtagggattccaacctttttgagctgtcaggaggattaggtgatagaacacaaacttcctattctgataggtgacaggtactcaatacatggggatttcttacctttcttccatcctgtattcacttctttagtgaatattcattgaatatctactgtgttctagcagcctggtattctcaaatgaggaaaatatacaaaagttactgtattttggcttatatcctagctgaaggatcaacagtatatgatcagtgaaaatacattaacacataaacaatataaaatagtatgaggtgatataagaggtagagaaaagaagaggtagaactggatatgaggggggttagtttgtagtattaaacgggttgctcagggtagacatttgagcaaggacttgaggaaggaaagaatagtggtcatgtggttatctgcagtaaagccttccaggcagataactgctagggaaattaccctgggataagagcctttctgaccttttaatggaagaacaaaaagaccaatgtattgggaggaagaaccagatgaagtgaagggaaaagtaggtcagacacatgacagaagaccaggtcatacaaaacaggaatttgtaagtactttggcttttactttgaatgaaatgggaaatcattgtagatccttatacaatggagtaacatgacctggcttattttgtaaaaagatatctctgcctggaatgttgaggagagactgtaagtaggggcaagggtagaatcaaggagaaaagttaggaggttattttcagaagaaagatgattaatgatgattgttagacacttttactggaggtagtgagaagtggtggaatttgggatatgaaggattagccaatgggatttctttactgactaaaggatgtgcaagacgtcagtagattgactccaaagttattggtcttacctaatgaaagaacgggtttattatcagatgaaatgtaatagtaaggataaagcagcctgggagattaagaaggtaaagacctggatttcagtgatggaagtgtagaatttaagatatctattagatattcaaataaatatgtcaagtaggcaatggaatatttaagtctggagattaggtgagagatctggacaagatactttacatcaaaatgtttattgtgtagatgatatttaatgacatgaatgaaactgggtatgatcaccagtgaagcaagtgtagacagaaaagaggatcaacactgagctctggagcacttcagcacaatagccttcattttatttgaaattcataaatgtaaaaatatcagtggcaatagatgctagatcctttttgggaaggttatttttttatttttattttgccagtgaggaaaatatcaaaagtgtataatgaagtgatcagtgaaactagaaaccttttttatcagggacaatgataagatagaaaaacaaatggcaggtgctgtgtagtattgtcacggcttacggctttctgggatttccaagtcaccattaaacttctgcaatttattcatttagaatcagaagggctatgaagctaatctaaacgaagttaaaagagatgtttataacagtaagcttagttcaacaaataaaaattgtctactctctgccattgattgtgctagacagtcattgacttaaagggatcttactttcaaatgtagaagacatttaataaacacctgttaggccaggcacagtggctcacgcctgtaatcccagcactttgggaggctgaggcggcctgactaacaaggtgaaaccctgtttctactaaaaatacaaaaaattagctggcatggtggcatgcgcctgtagtcacagctactcaggaggctgaggcaggagaattgcttgaacccgggaggcggaggttgcagtgagctgagacagtgatgtgccactgcactccaacctgggcgacagagcaagattccatctcaataaataaataaatttaaataaataaataaataaacacaggttaaaactttccccaaattttcttcttcattcattcttaaatcaatccatctatctctctattcatttttcatcactatattttaaaaactttattaacagtagagtgataatagtattcttgaacagttaatgcatacgaaactttttgtatgctataaaatagctctaataatcttatgaactagttactactgttatctcaattttatggaagagaaagctgacactcacagataaaaatttccgtgctttaagtcgcacaatgagtcactggtggagtgtgaatttgaacatgggcatgtttgactccaaaaccttttgatttaaaccactacactcttagaagaaaataaagatgaattgttgcagattggtattttatgcagcacaaattctcagctgtactttgttacactacatttgccataaattcaacttccttagattgtactggtgagtgtgtaatgtagtgaacttatctagagaaacctaaaaagtgcttagagacctgggaattctattgttaaacaaaagtcactttcttttacagctgatcaccattatgatgtttggtatttaggaaaggatagttcccataatagaggctttgatgaaaaagcgaccgtgaaatggtggtgtacttgctctgaatgttatattggaaaaaatattttgagacacacatacattccttagatatgacatgtatcattccttatggtctttttttctgcctgaaaattcatttctgctttacctggttagcatcttattttcacatacatgaattccctttccacccagaagctacctctgaacttccaagacctggttaatttcctctcatcaacgtttactcccatcctagcactttctttccttccttcattcatttcttcatttcctctcctctcttttattccttcattatacaaacattaaattggttcctacactatggcagggatacttaatgtattgaaattgcctctttatttgcatatgtctctgcctaggctctgcgatacttgggagtaggaagtggggctcgatcaccattgtgtgcccaatactggatctagtgctatgtttggcactagttggaactcaaatatgtgctaatgaataatttcatcctttgtgccaccactgcatttggtgtgtggtttaactattgtatgcattatatgtataatttaatgcaattatttaagtaaggttaggtaccttccatttatatttgtatcatcagaacttagcacagtgttaaaaaaagagtaggaatgtgataaaatcttttgctgaatgaattaatgaatgatagatagccagctgtatagcatatgctcctgttcagattactatctaacctagaaaccaagaagctagatagcagaattctgaaagctattccagtttcaatattaacaagaaatatttattaaaattgtaataataaactaaacttatttctcatcaaaactcatcagaaatttcctctaaagaatcataaacaaataatatttaatagatgccaagaattttccctcctttcctcatctaagtttaattataatagtcaaataacacattttaagcacatttggaataaaaaatatcagagcagcctggagataattaacatgtgaccagcttgaagccgattttttttccttctataatttcctgaaaatatggggctctaaaatgtgattgtggagagagacaggtagtatagcataaaaaccccagaatcatagcacctgggatttcttttccaccagttttgtggtcttgtccatgtatagaatgttcctgagttttgtttcattcaactgtagaataataatctcaaccttaaaggattaaaaaaggtaatgcttaagatagttataataattggaaatgaaaagaaatcttccccatgtttttatttaatgtgcttatttattaaaaggcaaaaaaaaaaaaagtcccaagaaaagtaggacaagctgaggaacacaaattaaatgcacatttgtaaaaagagagcaattccaatgcgggagttataaaacctgccagtggttacacctcttggagctcatcctctgctccctccttgattcttaccaacatctctttgtttaactctgcggcttttttcctcttaagtgaagagacaaatgttccaacctccaaagcaattaggtaactcagggaaccaaaggaacttcctagagaacgtccctattgacattaagctgttgatacatattgccttggatggaataaaatggaagcgttttacagctttggacttacgtaagatacatttcttttatgattgaaaagcaggagataatgctaacttcctgtcataggacttcccacctggttacttcttgaaagacaggctatttttgctctttccttttacttagtttattggaaggttggcagcatctggtaagccccacctgtaagtgtttctgtggctttggactggggacctaaagatctttagagctcttactacttatatctcctcctaaattctttgatacaaaacaaataaaaaattctttctaggacagtttttgcagatatgtggcagggaatggtgtcccagaaaaagtgtcttggcaaatgcttttcagataattctctgaacgtctagctcaaattgttgccttttattactttttctcctttctctctcaaaccagactacatttttctgagaactaattaccttgttctattgattttaattcctaatcaaatctttgttgcttttgattcacattacattatccttacccaaaccactggtagattcacatggatttttgcaaaattttcttacccttatcctctctttataattcccaacttagtcttatattttaaaatcttatcttttagtgttaaatatttaaatagcgcaaatagtatggaatcatttaaattataaaatttttaaatatgcagagaaaagtatatggtatggaacaaataaaatctatattaaaaaatgttaatattttgtcatatgtttcaaattacacacacacacacacacacacacacacacacatgctaaagctataactaaaacctattttgtaactcccatctaactccctttcttctcttactagatgatactgctattctgaaatctgtatccttccttttcatgtttttatacaatatctactcttcacattgtgactatgtaaataatatttataaagcagcccatcatgattgcattttctttcttttcttttcttttctttttgtttttgagatggagtcttgctctgtcacccgagctggagtgcagtggcatgatctccactcactgcaacctctgcctcctaagtttcccaggttcaagcgattctcctgcctcagactcctgagtagctgggattacaggcatgcaccaccgtggctggctaattttttgtatgtttagtagagacaaggttttgccatgttggccaagctggtctcaaactcctgacctcaggtaatccacccaatgtagcctcccaaagtgttgagattacaggcatgagccactgcacctggcacattttctttcatattcaatttttgaatattcctggagataatcaccttgcttaaaactattctctccactagaatgtaaacattataagaacagataattttactggttttgttcatagaaatattttcagcatttagaacattgcctgagatggggttcacaacactctactccaaaatatggcactttggcatattgaattttttaagctgaaggaatttgagaaacagcaagtgcagaaagactttatgtccttctcccacccttcacccctgaagcaggtcataagaccctcatgtgagaggtgcccttcttagacctggagggaaggagcatccctatctcagaggagtctgaaggaacaggccttgctaagtttacctgagtttacttatgccctttgtcctatcttctttctctacaactcttcattttacatcaaacctagcatacgaacagccaggtttaactgcttcttcaggtccttaggaaggttccagtgttacataaaacttatattaaataaatgtgtatgcttttcttttgttaatctatttttagttacaggggccccagccaatgaacctaagatggatagagggaaaatatatatttcctcccctgcaattggaacagtgaaagtgctagatacacatttattgaatgaatgactagatgactgaatgaataaatctttttaaatttcccttaagataaactttaaaatatttaccatagtttaccaggctccccaaaaggtggcctttgctttcttgtctcatttctcccttatactctcagttccatttcagttcctgtgttctgtgtccacaacactcttctctttcattttagtttggccagctcccatcattactccaatttttgcatgcccacaattcattgaagaggcaattttaaatatcacctaagttagcttttactgttatgggctctcacaccattctggccttctctgttgtcaatattcagtatcttattattactttcaatatttggaaaaattatctccatgagggcagggatcctctttatcctatttactgctagcataggtacctgttaattataagacaaaggaataactgcttgctgtcctcaatgaaaataagttgaattgaggacatgggctatgttctgacctcatcctccatttatttctcatttctttcatgtcttcttggttttcataccagattctttatttgtctacctaattctggtgttcctaagaatttatgactgctattgagaatatggctggcttaaacatcattttaatgatttttattgatgaagatacattctcataatatcattcaatcctctgcatacatgtttacacacacacacacacacacatattcacatgtatttatgtgtaaaaaaaggaacctgtaatcctaccacctgtaaacaccttaacgttaggtagccttcatttaggatatttctatgaaaaaaatatatacacatacaaaaagtatatggctaaatatataggtagacattaatgtcagttgattgctactttaagttgttttctgaacaattgtttaattccaggtgggctgagatctcttagccatgctgataatcttataggattgtgttgacataaaatgaaataacatttccaagatgctgcaaacagttcctgtcacatagaaagcattatatatgtactggttgttattatcacaatgaaggcactgacccaaaggtaacttgagctgtcacattataggctgaagtaaggtaactataagccaagtgcatataagaaaggcttgcaatatttcctaaaactggccccaagcctttctgtggcaggctttggaatagctgaagccatcaggatgttcttctagctagcaattccgagtgatgtgttactttgaatcagagtcactgaggtgggcttgcacacagctataggctctttggaaaagtgctgtagattccagttaaaggttaaacttcacataatatcaatgcaaaggcatttctaggtttggcatttttcccctacccagaccacccacacacatacacacactcacatgtatgcacctagccagagacaaatcattttattcttctgtctgaaaacctccactggccccacactgtctatataggataaattccaaactcgttaaaggctttactcacaggctggccttaatacctactttaatcttcatttgtaacactctccatcattttactggaggttgacacgtatttaccgaaagcttactctatgtcaggcattgtattaggtgctgagattacaaatatgtttaagggacagctatgtccatgagagactaacatttcagtaggagtggcagatatgtatacagatcattaaaatttagtttgcaaagtgatttaaaggggaaagcagaatttgttttagaaatacagaaggggaaacttagcagtctaagtatatcaaagaaagcttcatagagaaagtaacacctgaacagagtaagggagggtaagtgggagttactcaagtaaagaaagaggggtaagcacattccaggtggagaagacaatatgtacacagacagggaggaataaaatagcattctgtgtggatgagaattatcagcagtctttgacaacagaatgtaaaatgaaagatggaaagcagtggtgattgaaactagaaagatcataggagggtgggaaagaggacattttgtatgtcatattgaaagcttggaatatatcatacagagttataaaaccagtggtaagttttgagtgatgggattcaggacacactaccctgaagtgtggcaccttggcatttgagaaaacagcagaagcaggaaggtaactctcaccttccccccagcattctcccctgaagcaggtcataaaactctcatttgacaggttctctctctgtacccagaggaagtgaacatctgtatatctctaaaaatgcaaggtcactgacagcaatctgaacaaacacgaatagctgagttctccccagctaactatcattagatcatgcttttttaatccaatcatactcctcaatgacttaccacttctctatcaaacctagcataaaaatacacaagttttcctgtttctttgtgttttcctttccctatgtaaaacttatctttaataaatgtacatgcttttctcttgttagtttgtgttttgttccaaggatttaatccacaaacctaggctgggaagaaacgataattactttctcctacatgagcaaggaaataaaaaagacagatctgtattttggatacattattcagtagcaagatcatcttctcccatcagcaccttcttcaagtaatgtgatgacaccatttcttgtgtgcttggaaaaagtttcagcttgctgtctcctttgttgttttaaagaagtgttagacaaagcattgtttgcaaaatctagggagataatggagtacactttgatttgttattctgtgtgagctatgatctaagttattggctctttccaactttaaaaatttttgttgttaaaagcaccttgcttaggaaattttaaatatttatgtctgcaacaattgtctcaaaataataaactgtgccattcctgtcattaaaaaaagacctgaattcttcctgaaaaaatagcaagatcaaaagtggattaagaggcatgtggcataaatctaggggcaagggaataaattggaaagttactgcaatatttaaatatgagatgatgagaacacctcttctgacactgttctcctacctgcttacccatatacagacattcacatgtgctgttaccccagactgaaatttcttcttagttattatttgctaaatatttatatttataatttaggtcgcagttaatttttacttcttcagagagaaattatatgaccacaaatttaaattacgacctctcggatatttccatgtttttattcctgttctttgacttcatatataatttgtcagtgaggcacacaaatagcccattagcaaacaaagagctgactagccatgtgcatgtgttgttttatgtctctttccccacaagatggtaagatgtatgaggaccaggatataggcaacaagtgacacaggaagcattgctgtttttccacctcaatttctcaagtacctaatattataatggaaatagtaataataaaatatttatctgttgaaataatgaaagtgtgtgttcattctcaatatcatagtcttacagaacatgagacaaaaagttacatctgtatattcattcacaaggtgcttagccatgcaagttagttgacgatgcaagacagttttttattttcacaataatccagtttaaaattagaaaaacatgtaaataaatagtataaagaaaagataggaatactgctcctcacccttcttcaagaaaaccaatcatagtatttttttctttttggcatttttactgtgtgtgtgcacacaggtacactatagatcatctattcaacaaaatttatttaaggctttgtgtttagaactggggaaaacaggatgaataagagcatcagaaagctcacagtctaatggcaaaaataagattcaaatgcgatcaaaaggcacttggatgttttattaaatcagattttttttttaagaaaaggaaaagtctcctgtatacataccaatcaccaaagaaaggtgagctgtcttgaaagacccaggatcatggaatttttaataaccagactttttaaataagtgaatacaactactatgagtaaaatcattcatcctgggagggatggagtctaatactgatgactttatgatcttctagcctctagaagttttgtgctaaatccatctgaattctaaaaccactagacaacctgacataccacatggagggctctctgcctgcaaggcttttttcctctttttcttgcatactcagttcatgggtgccctcctcatgctcctatgtctataaatctatgtcctcttattatattgtaatcatatttttacttttttgcctcctttattaatctgtgaacttcattaagatagaggtagtacttttatttctatatttttattttagtggtaggaaaataagcacatgagtgcatttaataaatgtttattgaagaaaaattggaagacagtatgaaaggaatcatattctgtttatatattgtaaaaattagaaaagactatgaaatatagactggagaacatgatgacatattctttaacatctgttggcacaaagaagcaaaagctaaaacaaaacaaaaaagaaaaaaaataaacaagtaaaatcaagtctttccctgtgccaacaatacttaaaagcatattagttggagactcctgatttcaattaataaaaacaattaacagaagaaaagaactttagatgacattctgcccaattcggtgatatctttttgttcttggatatgtcatgacatatttttctcactggctaaaacttctttctcttcacctaaaatgacacacataactgggaccctatttaggaacttctgggaatgtcctgggcatgagggaagaatgcccagtagacaagctaggaatactgatctaattttggagtgaagacagacatataggcagatctctcccagaggtctgaagatttgaataagtagctcagactttgggaagcttgtgttcccaaggaaattatttgttccataaataagactacccaagatgagtaacgcttggggatgtgacccccctctcccacgtctgcaccatttttcagttaatttatatgtggtgagattgtgatagattacctgtgagatcatcagtgggccaagaccccagttggcatgccttgcatgtgtactcatcaaagacatactcattctccttacaaggtgtacaggtccaacaacagctgacttctccctttcggatcacctaaggcaaatatttgaaatttagatttttttttgcatagataaaaatccaacaattctatattccaatgtgctgttttgcaaagcagaaaggcctttcacatacattattttaaatgttttcagataagcagtacaatttttaatattaatttataattaaagaaaataaggctgagtttaaacaagtccagcgtcataaagttagcttgtggcaggataaagaattaaattaaatgaaagtctttggataattagccttggaaacctgtatttaattaagtacctgtgcttgtgctcatatgtagatacacataactgaattcaccccaggatctgctctgcttctcctttccttaagttaagaacttctgctccctggatttaccttagcttccttccctccattagttgaataattgtgagcaaaaaacattgtatatttcctaatcttctaaaatctgtccatattgataaaaataattaggaatttgtattgggtagaacatagcaaaagattaagattttcctggagatgatctcttgatctctttctacgaaaaatctgattcaacaattcaacccattctttcctattttggtagccttgttttgtttgaaggtagatgaggtcactgagactattatatacctcttaatctatctgacttttttaaggtaatggaaaataattgaaataatttaacagttgaaagagtcacagatgttattctttcgaaatagatgtaccttttcttccccaccattggtgcatgaaaagcctctccggaatagacagcattcattaaatgttcttttaaataattaaaactgtgattaatattcagcaatgaccagagacagtaatgattacactttatatttctagtcttagatgctaactctagtaatgacctttgataataacatcagctagatacctatagccaaatataattgtaagctgacaactgtttgttacatttttgtagtatttcttgtgttgactcttaaaactacaaaaatacaagcagggaataatggcaaaagggcctgaaatagcttttccctaaagtaactaaataagtgaggcaaaattgctccttagacctgattaaagtattcttcataataatatcgactatttccaggctctttagtacttgtcacatactgttatcccattaaaacattagaacagctctgtatgaagtagctggtttatttttttcattttcttaggggagaaaactaaggtaaagttagctcacatagcatgttagggtaaataagggatcaaacaatgtatgttggacttcaaatgctcatgcttataaacattgagtcttactggaagatagactgcgtgatattttgaaagacgcaggggaaagagcactggcttgggaatcaagtagcaccagggttctagtcttatttatagccactaagtagttgtgcagccttgagtagtcctccagctaatgctcagtttcttttaactggacctgttgcttttaagataataatatctaccttataggatttccttaggattaaataaaacaacacagtgatttgtaaagtgtagaacactctaataatgttacctatttcattaataatatgcacataaatgtccatatacagaaatgaagaatttcattttcaaggtataccacacttggcaaaactatccttgaacaattattagattttgtaatgcaaacaggcatattgcaaagctgaaggagtgtctttcagaacttagcagggattagcaaataaaagcagttgcatttccccccactagaaataccttgatttcttatggttcagttttcattggtttgtgaatttcaggtgtttattaaaataaattcatgcccttttccaagaagaattccaacattacaatctctttttgaatcaatagtgataacttaatatgttttcctctgataatttagaaattgttttatgttttcatattttatgttctgtttcacatctattttgaacacgaggtagtgacaattctctttcatggcaatttaacattctggaagtagtggtgctttcttttttatttattttattttttgagacagagtcttgcattgttgcttaggctgggagtgcagtggcgccatcttggctcacggcagccttgacctccccagcccaagagagcctcccacctcagcttcctgaataactgggactacagatgtgtgccaccatgcccaattatttttgttccttattttttttgaagagatggggtctcactaaattgcctaggctgatcttgaactcctgagctcaagggattctcccacctcggcctcccaaaatgttgaaattatactcatgagccactgcacccacccagcggtgctttctttatgaataacaatatataacatatctgaaactttactagactaaatcctttcatggaaactaagtttacaaactctggaaaatgccatgagatgttgatatcatgaatgaaatcgctgttaaaccatattaagaaaatcttctaaattgtacatttaatagagtaaaaatgacatctggttaggaaaatggagtttgggatttttaaaaaaggactaagcaaatattattacaaaatgaccagtattaaaaatatgataataggctgggtgcagtggctcatgcctgtaatcccagcactttggaaggctgaggtgggcggatcacgaggtcagcagatcgagaccatcctggccaacatggtgaaaccccgcctctactaaaaatacaaaaacattagccaggtgtggtggcaggtgcctgtaatcccagctactctggaggccgagacaggagaatcacctgaacccgggaggcggaggttgcagtgagccgagatcgcgccactgcactccagcctggagacagagcaagactccgtctcaaaaaaaaaaacaaaaaattctgcatgtggaagttacattttccctttcttccttccctccctccctccttcgctccctccctccttctctctctctctctctctctctttctctctttttctctttctttctttttgacgtagtctcactctgtcgcccaggctggagtgcagtggcgccatctcggctcactgcaagctcctcctcccgggttcacgccattctccagcctcagcctcccaagtagctgggactacaggcgcctgccaacttgcctggctaatttttttgtatttttagtagagacggggttttaccatgttagccagatggtctcgatctcctgaccttgtgatccgcccgcctaggcctctcaaagtgctgggattacaggcgtgagccaccccgcccggccctagaagttacgttttcaaaatgtattgctgtgaagggtcaaaaataaacaaaaattatgtggtaatttacactgtgtaatctttctacaggaagcactggaaattatgaatatggatattcttggtgtaataattcatgtaaataattgtacatgaatttaaacccctcacaatgaagagtttaactgcaagataattggccaagatgaaaacctcttttgtcttgatataacaagtgttagcaaacttttttttgtacaaaggaccaaattgtaaatatttaggctttgggccatacagtctctattgcaactcagcaactcagctatccaactctgccactgtagcaggaaagtagccatggagactatataaacaaatgagcgtggctgtattttaataaaactttatttacaaagacaggtagtaggtcagatttagtctgtgggccatagtttaccagctgttgctgtataccataataagacatacagaaaatttcagatatctaatattttgagccatttagcagacattaattaatttatttttatcttcatttaccttatctttcttctttctggtcttatgctttccaaatcttcagacctaccctttgagggccttactatcagtattaaaatatttcagtttcagtcttaatcacagatgaaaaaacacatgaaatgccttctaaacagagtgaaggtaaggttgattgaaaacaccaagtccaatggctctaggaatacactgcctgaaatgtggtgtggtagtgcttcaagaactgtttgattagcaaataaattattttgatatcatttttccttacggcattgcataccaatagctgccctaactccctttttattatatctttgtcttctcttccttcattgaattttcatttcctgtaagtgtggccacatcttctttagcctaagagtaattttttaatgtcctcaaattaccaaattatccattacatgcttttttatcacatacttctttttcttatactctttatttttttcaattgacacataataattgtacatatttatgggttacatagtgatgttttgatacacatataacgatcagatcagggtaattagcatagccatcatctcaaatatttattatttcttcatgttaggaatgttcagtatcctccttctagctatttgaaactatagattacttttaactgtattcatcctacagtgctaaagaacactagaatttattcctcctatctagctgtgattttgcttcctttaacaaagctcttcctatccctctcttcctccttcccttcctaccctctagtatgctctgttctaatttttacttctgtgagatcaacattttttatcttgcacatataagtgagaacacgtgatgtttaattttctgtccttggcttatttcacttcacattctgttctccagttctgtctacgttgctgtgaatgacaggatttcattctttgttatggtttaatagtattctattatgtagataaactacattttccttatccattcatcttgatactcaattgccattacattctattcaatctggcaggcccagatgaagggtgaaccctcaattttcatgcctttccctcattgttcctcttctttgacctttctcttccactgactaccatcttatgtgacagtgtgctctctagttgtctatctctctgtacctgttgctgctcagcctctaccttttcttccttttttgtactttgaaagcagaaattctccaaggtatattcttggtccgtatttattttttatttacacttttaggttctgcaattttatttattttaatagcttcaactttaactctattcaatcaattcctaaatctgtattcttagctttatttttcattgctctagactaagctttaatcactggatggctattttaaaaccaacatgcccacaaactaaccaatcgctttttctctaaagccatccccatttttctattcctggaaatgcaaccttttagttactaacacttagaatttcagttgattgtgttgacttctttatcttccacaactcggcatcaaattggttgtcagcctgattgaatctacaaacgttttctccaaatgtgtcttctggccccttttcattctgtttcttccctaattcaaggccttgttaccactatcacagcatccttctaacttgtctcttctttcttgtttcataaatttgtttattcatcttccttaccacagctcaacttatgccagcatcttggtcaaaattattctctgactccagtttaataaaaattaagttcaatgtatttagtatgatgttcaaaactctccacaaatctgggttcaacttatttcaactttctcttttataataaccatttagagcattgcactctagattattcacttgtttctggacagtcttcaattgaccacttttgtcccttttcttttactgttctttctatatgaatgttctctccctgaaatcatattcattttctatggtccattgtttgacattttattcagtagaaatatctctatcccttttgtacaaacttatatagtcctcttcttttctttcttaacaaaatcatcacattttacatgatattgcttatctgtgtccatgatattttctcacatagactgtaagtcttctgacaataaagcgtgtctcatttatttttgcctaatcaatattaactattatattaataaacatttgatgaatatttattaaataaattagaattagtgtcttttctaactgtaaactttattcccaggaagtcatgtctttaaaggcttgtatgagcagaaacggtgtgggcaaacatgactcatcaactggttcaatcaaaccaactaataagactattgtgagttgcacatgggatttcacaaggaatgagtgagaatttctgacattagaagcttacaatataaaaagtaaaataagtgtctaaaatttttaaaaatagccaatgatagttaacactgttgaatttacaacaaaaatgaaagaaacatagattccattttaccttgatctggcctttctcacatggttcactgcacacagatctgatgatgttgcttttcttggaccatacttcatcatcatccatttttaattctccattgtcccaacttccaacgttgatataatcaaagtaatcttttcccatttccttgaaattcattatttcataccttaggaataagaatatgataattatgcagcttaagatgtaaatactcagctttgaaaaggcaatatattttattcccaaaaatgtgtctattgtcatataagtagcactggaattttccatgacagtacacttagaataacaaaaaaaatctgtctattttactttctctgcagagaccatttttgtactttcaagcttacacctgaaatagaaagtaatcccatgtgagaaggtgacttgaccccagcaggatgaaagacagtttcgaaataacttcaagaagtttaaacgagtactgttaggcttctacaaaagatagaaaggtttttgtctgtattcaagtaaaatgataaaacttacatttactaaccaagtgagaaatttggtaaatctttcatcttattttcagctttaggggatatagggataatttacagagggcctcattttacctttcttactttgcccattatcaatggctaaattcattgtacaaagatagttttgagagtgatgtttaaaaaagtttgaaaatagcttctaaagcacctcatgcaatgtaaacatcctggaagagagtagttccttgtgagttctcagcctttgctagctattgttttttgagtatgtggatagaaatgtaaaaagagaaaatcaatgtgctaacttacaagccttttcttataagtaagctcatttctagagaagaatctctgaaataattttccaatttgaggatattggataagcaatatcaccattatctcagtttctacaggtatgtctcaggtacacactgtgttcacataatattttatactgtttaccccctcaggacttatagtactgacagatagacatataaatgcctcctccaacttccaatgctcagcatgtgtagctatctggaaactgatatgaatggaaaatgttctcgcttttggattcaagtgatgagattactatacacaaaccaatgttctgtacagaaatactgagaacaaaactggcatcaatctattgaaacttatgttataaaatgatgccattctgttttcactcccagtcacattttttactgtagtttttttttttcttcagaatattacctcattcttgttttgttggttgttcagtaacttgataattttcctgcagtcagtaacaatttggtgtaactgtctaaattctacttctaaatcaaaaataccaatttataggatactttccttccctctcggtcacaattatcctttggcctctgtgcatgcaatgagttgagatattagagcacagagcactgaggtaaaaagaactcacgtattatgtcattggctacttcaaatatatgagctttaagtattcaaagggtgactttctatgagcaaataacctttgaagattctaggatgggagaaagagaaatgtcagtgtcagacttgtttctttgctgctgataatttgaagaaatatgtgggtgtcattccttactcaaaaatgagctgtcaactctgtttctagcaattcttaagtctgaaaagtttagttcacactgttaattttacagataatggactgaagctcagtgaggttaattagtacagattacagagtatgtaagcatcagagctaggacctaaaccaagcctttagatttcaagtctgcagttccttcttccttattagactgctccaaatcctgggtactgctccaaatcctgggtagagctaagagatcatattttccttgcttaaatattgtaaaaatttgaaccaatttatattgtaaggcttttatctctatatccatgcctctttgttttatgtatgacaaatagtaaaaagtaaagagatccagtttttgaaaaataaacatgaaaactctatagattggaaaatcacatttgacagggaacttgttttaaggaaagttaaaccttaatttcagttgaactcaataaacttgttataattacattagagacaatgaatcctctctttggaattaggctttagatttctagtcattgtttcttaatacaaggcaaacacaaagatattatcactcacagcttaagctgtgaaaatagaacattgctttaaaaatcttgttttagtacactaaaaaagagaaatagataatatgtctccacaaaagaatattctcccgttgacttgtgaattggtatgagcccttttaattttcagagatagaatatagcttttattctccaacaaaaggaaaataaagtgagtgtttaaaacatactcttacgtaacttttagttaagaatcaaaagacataatggcttcttgcaatctttagccatgattcaatctagaagactgtattttgttttccaataaaataacagaaggtcaggcacggtggctcacacctgtaatcccagcactttgggaggctgaggcgggcagatcatgaggtcaggagatcgagaccatcctggctaacatggtgaaaccccgtctctactaaaaataaaaaaaattagccgggcgtggtggcaggcgcctgtagtcccagctacttgggaggctgaggcaggagaatggcgtgaacccgggagacggagcttgcagtgagcctagatcgcgccactgcactccagcctgggtgacagagtgagactgtctcaaaacaaaacaaaacaagaaaacagtaattcagtgtgctctttgtttttgatggctttagtaaagatccaacttgcacatattcagtgtcagaagcaaagattagtgtgtcattccaatcacaagacactttaatataaatctccagcccagtttcttttttctccttcccatctccttcctcccatttatctcctcctccttctcttcttcctcaatcctcctcctccttcctcctcctcctcttcctccttcttcctcctgctccttctccctctcccccaccccttccccctctccctccccttccctcaccctcccctggcctttctttttcattgcacctcttggtttctatatttctctgcttctgaaatgtttttctcagcacagtgtgtttgtatatgtaatttatcttctttaatacctgtcccttccttccccttactctctaactcctcatgtctgctcttccttaaccagccaaaatttaaacctagaatattctaaataattttaaaaataaattttatatattgctcaaaatcaaaataaacaaaatatgttacaataacaacaacaaaaagttctattaaagcatttaaggtaaactagagaaagtcaggtttcaattgtacagaaataaggaactttctaaatggctagaactctgaaaattagagaagattgtcttcagatgataatgagggatttattcaaggggctgaaacagggttgttgttagagaaagtgaaaaatcatttggagaagactgaagagtattacttttatgtgggtcctaaggctctttcaatctataattccgatgctaaggtgcttttgttaaaaattcttaaatgtgtgctaaattatctgtgggttggcataataagccctggtccatacaacaaagcaattacaatgatctgtgcctttggggttggacaatcacagagtaatgagagatcacagagttagttagaccaaaaatgtgaatggcacctaataatgcaacacttttatactatatgttaatacattgaaccatttcaaatgtaatataagaaaaaaaaagaaggtaaatttttacttgatgattgtgcctgagatttgcgtatgtccttgccctgttatttaattgactatgcaaccttggacatgtctctttctttctatgacacagattttttaccaggacaatctggacattgaagcagaacatctgtttctatgagcagagacatatatcaagaatccgcatgcacacaaagtcgttatctgccatttctactattctagcctcgtattttctatttaccgcatctgtttgtgctcctctgttctttctttcctgccctattttgggccttttcttttctttctttctctctttctctcattctctttctctctcttttgttctttcttatctctctattggcttttaaatgctcctctttgtattaaaatttttgtggttgctcaagagattacaatatgcatttttattctacttaatattgagtcacttaatgtaaaatataagaaatttggctttgtgcaatttcaaattctttttcatttttgccgttgttttcaaatacttcgcacccatgtacttacaaaccccacaatataatgttttagttttttgctttaattagttagttgtactcagtctaacattgggtgtccacgtttcctctgcctattatggtcaattccgggtggcagccacgcatcttaaactttaattctcaatggagtccctaaacccgagattagcaaacttttgctgtgaggggatgtatggtaaatattttaggctttgagatggtttctattcacctctgccattgtggtgtacaagcagctatagcacctaaataaatcaatgtgactgggttccaaaaaacctttcttataaaaacaagcagcagactccatgtggtctgcagatcatagtttgatgactgatgactggtgatctagtctgttaatggtaaaatagtaaaggtccatatttcttatcggtaattgtgaaatctttagagctctgaaatttttttttcttttttttgtaactcacttggcagcaaaacatgacattacctgaactttatctagggatgaaatgtgactggaactaaatgaggctatttatagtcttgtttatcacaatgtgaatattcgtatgttttgctgcagaaatattaatgtgtttattagggagtgctattacatattatgttaggggcattatatgattgtttaggcttttgtaaattcaaaaattctgggttctgtaacacctggcaccatggttttcattagagcattgggtactgatagtagactaatcagatgagagatttaaaaacaatgattaaaacgtgctaacagtctgcaagtgtgtgccagagtgagttgccatctctctcagcttcctctgtttaggatcctccacttttaactctggaattgtagaggattccttaatcaccccaggatcctttgctttctcactcagctgggaatgcctttgatctggcagaatgcttttgctccacaaaaataacaacctaatgtctacaaataagttttctcagaatatagtgtctttaaaattttgatcctggttgattaattgtcaggctgttgtataatgttagaagttgaagcccaggagacagagttaaaattttgactctatcatttactagactgtgtttttgggcaagtcattgaacttttgtaagctttggttttctttagctggaaaaaagaatggtaacattacttacctcataggattaaaaagtagaacacttggcttagtctttggctcagaacacacactcaatatatgctagttataattttttttgtaaaagtaactggattatttggagaaacaaaaggtggtaaatcaccttttcctgagtctgcttcatgcccttagaggccaactctgataatttattcatgggttaatgttatactcaaacctagtagtgcaaggatagactcaaagcaatcctgaattcccagaagttgtttgcaagattttaagtatgttgttcttgaaagaatagctatacattttgtctgagtcttgaagggatgattgttccaaaaaaagattaagaaacccttacaacatatttggatgattatgaataaggtagcgatgttctgccagatccatcaaggtttcccattggaatagagctggaccttctgaggcatctcctccctccctggtttgcggaatggtttgggtacctgatataaaaactcttgaattggtggagctacagtcatcagattctatcagcaagtcctaagctgatgtcagaactctagagatgcacatgggaataataaattcctgtgcaggtatctgagcccaggccttgacctgagcctaaagactgagctcattggtcagcctgcccttaaaagatttacaactgtgaagttttgtttggccctgagaaaatgcttgtatttttttccttcatggatatacgtaagagccaaaaagtagaaaacaacatgtgaaaattcagcttattttggcaaacagcctagttatagcaatattcttcaagtctctggaatagaagaaaaaaaacctgggttttcacttggctgtatgacctgaaactagctatcacttataagtctggcatgtgaaatagtaacagctgcatttgggataagctccagctcatcttagaatgtagaagtgtgataaaccaaggttgctgacagaatgtgtgggcacatgtggtgtgaattgttggggattcatgaaaccttttggcagggtcaactacaaacagagtgtatagacagttttccaagcacagttgttaagtatgagctattgctagaagggcactgagagaccaaaggaccctattgttttgatacaaggctgagtgaagactcagccctgctacaactcaaaatatcatttcaatggcattattccttatagattaaaagtgtctataagtcttaaatgactatgtagagtcatttaagaatttggagtagaagacaaatgtgaattatggtaagttctgggtacttagtgatttctctggggactgacctatacttatgagtttatgttcctcaagttcctctacaaataataaaaggtaaaatttcagagaaaaaaaacaatttagtccttaacaaggaagaaagtgatccagctggagaataataaaataaaatgtgacttataattcacttgctgtacgtacagcaaacaacagaacagaacctcagccctatttctggattaccagaaatcaaattgttcctatttcagaatagttctattatgcaagaaaatatctgaatatggggaataacatgacaagcatgtacagagaaaccacagagatggtttttatttatctatgatcatgtgagtttcctgcctcttagtttaggtctctgaaatgtgatgattcgcaaagcacattttggacatcagcacaaatgcttttttcctggccacaggaaatggggcttcttctctctatctttgctcatttgggatgtcagggaaggggaaacattaccaggaaacctagattaaccacaaaggagagaaagagacatttcaggatcaagagttggctgttattcagtctctactctgcagaggagaattgtaacacaataccttcctggagagtctccattctcatcgaataggatcgtatctccagaaaccccagtaaaattggttttcatcagggactccaaaagtttccgtccatcaattggcttcatggcatcacagagtcctgcatagcctgggcagagggacatctgcatgttgtggagcccataggccatcgaatagatggcgttgatcacaaatcccattttggaatcctgaacatgatgtgttttcagagtcagagaacctgttgggaaacaaattaagcatagctttgaggtacaaatctactctcgcgacattcctgggtactgaataatgggttacctgtaattagagaatgcactggagcaattttatcagagttagaaccatgggtaacactgagaaacagtaccaacataatgggcctgatagttatcttctgtattcaggtttttcttccaaaactctgaaaaaagttctgaatcaccaacagtagcaagatccactttcttccaaaaccaaactctaagtatgaatgcaggatagaactgtatttctgtaccataaaatgtatcttaaggacagattcatttcattagtatgagctgtgataatatacctttttggttcagaaatcctcaacaaacctccagtttctaaactattatgttctcttacctggcgatactagatattccaccatctgatataaatttacctatttagatttatcacccagtacgtctaatctcaaagcatatgctctctataaactggcctatttgaaagttataaaatataacatttaaactcctttaattcattaattaattcagtaaacatttattagagtcagaatatacacaaagctgtgtaatttatcatctagagaaaaaaagatgatttgaacatggagcttgtacataagaaacttgtccaataacagagataaattatgtaaatacagtgaaaggtagaatataataaatctgtaaaacatgtggaggtaaaatctatagaggcccaaaggagtgagaaatatcccttccaatagaaggttcttgggaactaaggaactaaaggaactaaaatttgttattgatgattgatttgacaagtatggacttagtgcctgttatttctaactgctcagaacttgctccgagtgagggacatcatgctgaacaagaaagaagtgattcttgctctcatttacttagagtctaagggcagatgagcatctatctaagcaggcaattataatgtgttttgataagtactgagacaggactgaatagtgaatcagacctggaagctctctgaagctgagcattaagctaagtatcaatcagatgaagggagagaaagagtggtccaagcatttttgaagaataacagataagatagagcatgctatgtttgggagactttaaggaaatcaatgaccagcacagagagtaggaggtaggagaaaagagagagctgaaatggtagaggaaggcagagatgcttaagccatgttaagattgctgccttttggctaggagcggtggctcacgcctgtaatcccaacactttaggaggctgaggcgagtggatcacctgaggtcaagagtttaagaacagcctggccaacaaggtgaaaccctgtctctactaaaaacgcaaaattagctgggtgtggtggcaggtgcctctaatcccagctactcaggaggctgaggcaggagaatccctttaacctgggaggttgcagtgagccaagatggcgccattgcactccagcctgggcaacaagagggaaagtcagtcagcctcaaaacaaacaaaacaaacaaccaaaaaagattactgcattttatgataagagctttgggatccattgaagtgttgaggctagggagggacatgatcagatttctgttttagaaaagaccaatctggctacattgtggagaaaggtttaaagggctgtaggagtaggactgtcagggaaactcattaagagggaatgcagtgatcccaatgacagaagaaaatgttcctgcctgtggtagaggccatgattatggcaaaggtgtctaggaagtgaaatctatttccaggcctggtgattatagaatgaatagggttaagacatataggaagagtgtggttaaaaaaaaaataggtgaaagaaagagctgaggtaaagccagagcttatcattttggaagaaatgttttctttaagaaaggtgtttttttttttttttttcaacaacaacaaacaacaacaactctccaaaggtagtatgttgttttatggcttcccaaattgtagaggcttatcatctccatcttgattgctggcccaaatactgacacctttaatttccccagtagagagtctccctagagaaactggcgtagtgcattgtgacataatataagatgggaaatcctgcttccatctcaggactagacagtggtcccaggctacactctaggcaaatcttacaatttccttccccacacagactggattcatatttccacattttacctcacactgctggaaattccattattctagttgccaagtcaaacacttttgaatcacttttgactcctctttttccttcataccttcacaactcttatttgatttatcttcaaaatttatctggaattagactacttagcactaatctacttctaccagactcagtatatatcctctcctgtctagattacagcaatagtcttctaactggttgcctgctttctccttttgcccatcttccctgcactccagcctgtttttagcacaatagccttaactagaagtcagatcatgacaatcctctgatcaaacttcccagtgacttttttctcattactaaaagtaaaagccaaagtccttgcaatggccttcaaagacatacaggagcgtgcctcatggtatttcaccccttattcctttgactcaatctcttaatactcttctcgtaaattattccgccctagacacactgactttctcccacatcttcaaacatgctaggcatgcccctgcctctgagcccttgtaattgctgtgtcttctgcctagaatgttctgcccacaagatttgtgcaggacaattctccagatggccttggactgaccaggtttttctccctttcttgcttgtagttctcaacagtaactgtatgatggtctgataatgtaacttactgagatagagactggctagaagagcctaggctctgtttcagtctcaccagaacagcatgtccttcaatgatttagcacagtaagtcatgtgaccccaggatataacacccagggcaggctgctttccagggtcccttatctgctatgcaagtgggttacatgcaattgagactccatccaccctaggcagatttctgagccttgggggagcagctcacaatgagtcctaggcttctgatgttttttgctgcctatctgtaagtaataaacccatttcccataacttgcatatgagtatgttctgtcacacaagttggtaaccagtgcatggtgagcttgcttcacaagttgcagggcatgtttccttcccaatttatgactttactcaggcataatcctctctgtgagaccttctctggatatcctgtctaaattgcatctctacctccccccaccaacactccctatcttcttttgtgacattattttcactttaccaacacctaacatattttataaatttatcttattatcttgcttattggctgtctcaaacaccactcactaaaatataagctctatgaaaacagggattttttttttttttttttttttgagacagagtctcactctgtggtccaggctggagtgcagtggcgcgatattggctcactgcaagctccatctcctgggttcacactgttctcctgtctcagcctcccgagtagctgggactacaggaacctgccaccatgcccgggtacatttttttgtatttttagtagagacggggtttcaccatgttagccaggatggtctcgatctcctgacctcgtgattggcccccacttggcctcccaaagtgctgggattacaggcgtgagccaccgtgccgagcccggatattttcttttttgttttctactcagtgcctagaacaatttctggcacacagttggccaccaataaatatttggtgaatgaattaaattaacaaactgtcttctctagactacccttctattttactttttctccctaatcctacactaatactagtcctaaccattttcttcctcttacttttatttaggctcaggggtatatgtgcaggtttgttacatgggtaaattgtgttgctgaggattggtgtataaatgatcctgtcaccaagatagtgaccatagttcctgataggtagccttccaaaccatagctccctaccacccttcctcttcaagcaatctccagtgtctgttatttccatatttatgtccatgtgtattcaatgtttagcgcccacttataaatgagaacatgtagtttttggttttctattcctgcattagttcactcaggataatggttttgggcttgatctatgttgcagcaaaggacatgattttgtttggctgtttagtatttcatggtgtatatgtaccatggtgcatggtaccatgcatgcatatgtaccatgtctttaaccagtccaccactgatgggcatcttggttgattacatgtatttgctattgtgaacagcactgtgatgaacatataaagggatgtgtctttttcgtagaatgagtgcttttctcttgggtatacactcagtagtgggattcatgtctgttcatattatttgcccattttaaatggggttgttttttgcctgctgatttggttaagttctttacacattctggatattagacatttgttggatacatagtttagaaatattttccccaattctgtaggttgtctgtttactctgctgatagtttcccttgctgtgcagaagccctttgcttaattaggttctatgcgtcaatttttgtttttgttgcaattgctttggggaatttagtcataaattctttgctaaggctaatgttcagaatggtatttcttaggatttcttctagggtttttatagttttagctcttacatttaagtctttaatccattttgagttaatttttgcatatagtgaatggtaggagtccaatttcaatcttctgcatacagctagccagtgatcccagcaccatttattggataggaagtcctttccccactgtttgttattactgactttgttgaagatcagttgagtgtaaatgtgtggctttgtttctgggttctatattctgtttcactggcctatgtgtttgtttttctaccagtaccatgctgtttgggttgctgtagcctggtagtatagtttgaagttgggtagtgtgatgcctctggctttgttctttttgcttgatttgagatctttttgattctgtataaattttaggatgcacatttctaattctgtgaaaaatgaaattggtagtttggtagaaatagcaatgtatctgtaaattactttgagtgatatggccattttaacaatattgattcttcctgaccatgggcatagaatgttcttccaattgtttgtgtcatctctgatttctttcagcagtgttctgtaattcttacagagatttttcacttccttggtaaactgtattcctagttattccttattattatttttggctattgtaaatgagattgtgttcttgattttgctctgagcttggacattattggtttataaaaatgctactgatatttgtacattgattttgtatcctgaaactttaccgaagttgtttatcagttctagaagccttctggtgcaatctatggggttttcttggtatagattcatatcgtctgcaaaaagaagtagcttgacttcctctcttcctatttgggtgccctttatttctgtctcttgcctgattgctctggctaggacttccagcactacattgaatacaaatgaagatagtggatattcttgtcttgttccaattctcagaaggaatgcttccagcttttgcctgttcagtatgatgttggctgtggatttgtcatagatggctcttattattttgatgtatgttcctttgttgcctaacttgttcagagtttttaacatgaagggatattgaattttatggaaggctttttctgcatctattgagatgatcacttggtttttgttacttctgttgatgtggtaaatcacatttattgatttgcgtatgttaaaccaaccatgaatcccaggaataaggcctacttgatggtggttaattaacattttcatgtgcttctgaattctgtttgctagtattttttgaggatttttgcatctatgttcatcagggatatgagcctgttgttttcttttattgttgtgtctctgccaggctttgatatcaggatgatgctggctttgtagaatgagttagggaggagtaccttctccttgtatttttggaataattttaataggactgatactagctcttctttgaacatctggtagaatttggctttgattctattgggcccaggacattttttggctggtaggctttttatttctgattcaatttcacaatttgttatttatctgttcagaatttttatttcttcctggttcaattttgagaggctgggtgttttcagaaatttacctatttctcctaggttttcttgtttgtgtgcacagtgatgctgacaatagtctctgaggatattttgtatgtccgtggggtcagttgtaatgtccctttgtcatttctaattgtgtttatttggatcttctctttctttctttattaacctagctagcagcctatcaatattgtttaatctttcaaaaaaccaacttttgttttcattgatgttttgtatggattttcacatctcaatttcaatcatttcagttctgattttgattatttcttatcttctgctagctttgatgttgtttggcttttgtttttctagttcttcttcctttcctgggtgtgatgttaggttgttaatttgagatgattccaactttttgatgtaggcatttagtgctataaactttcctcctaatactgctttagctatgtcccacagattttggtatgttatgcctttgttttcattagtttcaaagaatttatttatttatttatttattatttttttttattatactttaagttttagggtacatgtgcacattgtgcaggttagttacatatgtatacatgtgccatgctggtgcactgcacccactaactcgtcatctagcattaggtatatctcccgatgctatccctcccccctccccccatcccaccacagtccccagagtgtgatattccccttcctgtgtccatgtgatctctttgttcaattcccacctatgagtgagaatatgtggtgtttggttttttgttcctgcgatagtttactgagaatgatgatttccaatttcatccatgtccctacaaaggacatgaacccatcattttttatggctgcatagtattccatggtgtatatgtgccacattttcttaatccagtctatcattgttggacatttgggttggttccaagtctttgctattgtgaataatgccgcaataaacatacatgtgcatgtgtctttatagcagcatgatttatagccctttgggtatatacccagtaatgggatggctgggtcaaatggtatttctagttctagatccctgaggagtagccacactgacttccacaatggttgaactagtttacactcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcatttcttcatgtgttttttggctgcataaatgtcttcttttgagaagtgtctgttcatgtccttcgcccacttttaaaaatatggaacgcttcacaaatttgcgtgtcatccttgcgcaggggccatgctaatcttctctgtatcgttccaattttagtatatgtgctgccaaagcaagcactcaaagaattttttgatttctgctttaatttcatttttttatcccaaagtcattcaggagcacattgtttaatttccatgtaactgtacggttttgatagattttcttagtaatgatttttaatttgtattgtgctgtggtctgagggtgtgttgggtatgatgtcaatttctttgaatttgcttggacttgctttattcctgagcacgtgctcatcttagaattatgtgccatgtgcagacgagaagaatgtatattctgttgtttttggatggattgttctgtagatgtgtaattagctccaattggtcaagtcttgagtttaagtccagaatatcttcattagttttatgccctgatgatacgtctgacattgtcagtcaggtgttgaagttccccaagattattgtgtagcttcctaaatctcttcatagatctctagaaacctgttttatgaatctgggtgctccaatgttggatacatatacatttaggatagttgagtcttcttgtttgtattgtaacttttaccattatacaatgctcttctttgtcttttaaaaaattatcgttggtttataagaaaagctacccctgcagttttttgttttccatttgcctgatagatctttctccatgtctttagttttagactgtgggtgctgttacttgtgagataggtctcctgaagttagcagacagttgggtcttgcttctttatccaacttgccattttatgccttttaagtggggacattagcccatttacactcaggatataaattgatatgtgagaatttgatcctgttattgtgctattagctgctaaccatttttaaaggatccaagaacacttccttcatgaagaccaccatgattgcagatattaaaattaagttgcactttgaactctggatcattttctctagacctctctctgacactctatataccttattatagaattgtgggaatacttcaggggagcagagtttgaaacatccatttcccaggtcagtcttataacctacctttccctatttaacatgctaagtaaagaagaggttactcacacgatccagaagattgggtattcagtgacaatctctgaggccacacttatgtgctttaccttgaccctaagccatgttctgcaactctgcctcccaaccactatcagagttcagcagtacatgtttttctggctgttataaaaggtgggtttgagtctcattcttttatttttctctcttttgaacagggtatggagatctatgtttgaatcctgttatgtgtcttcctggctctgtggcttggacaggttacttcaattacttaacattcagtttaatcatctgctaaatgatgacccttcttttacaaggataatatgagaattaaatgttatagaaaagtcataggtacatcacacagagcctggcacaagatgcttcctaagtagtaactgtgtcaaaatgtaaatcataataacctttagtcactatatatttctggtcaagactttagagtataaaagtaagtgaaaggtctcacctgatgggatgcccattagactctcaggcagtcactatttagcttttttttctgattttgatttatgcctggtccacaatagacagcaactggtgcaaaggcaattttgagcctttttaatttgtaaattaaatcacagtgtgtagggcatgcttactacactgtttattgcattgaatggggacaatattgacaatttgcatttgcttggcacttttcaacataattttgcatgtatctgatatgtgcctaagcactacaagatagacctgcacagcagaaactatccacactgtatatataaagaaactaagctgtagacaagtgaagtcgattttccgtggtcactcaggcggtaaaaatcaaaagtagacagaaacttgtaatgtcatgactagttttcttgttacactatattgctattcattggaaagaagaaatccctgtatcacctttttaaaaattattctaaataagagataaacttagggaaaacaaatggcaacgatattgaatttttcctacacagttccatgtgtctgttctcttagataatgcctgctagcactgcccaagacctgggcccaggtatgtacagaaggggccgatcaaaacaagatcttaaaagctgacggatgtacatgtttgttcacagttcattaaatcttttgttattattgagcatctgggaacaactggcctatttgagcagcattaggatcttgtagaagtgcctggtgactatttttcctaatcacccagagacccaagtgattgcaaactcctccccctcaaaatgataataataaaaataataataattggaaaaccaacaaaataccagaagagaacaaatagaagtttaacttttgtaatttcttattaagtcattttgatgcttatgtattttacagaaagacatcatgatttgtttcagcattcatgaggcatcaggacttcaagtcatagaaatccaagtttaaattctgcctgtgccatttcacctactttccagccttcttcctccaccagagaaggaagcacatggctgacctttcaccttcttcaggtagctgagacagctccattgaaatgtgtgctaacaaaatcaggactttacaaaatgctttaatctcataaaacccaatcagctaggggctatttccactatagattaagaaactaaaaaaaaaaaaaaaaaaatcaaagttactgtgaatagctggcaagcttagctttttttttaaattggggccagatgtggttggtatccacatttataagagacatttgttaatacgttagtctcaatattatagatgtggtgaatatattggtaaattggggaattttcttgcctcttatctctccaggtttaggtccccatctatcttcactccctccataactccacacatggctgaagggggtgaatatgcaagatgacatcgcactttgtgtagagaatgcctctcaactattaagagcagcagagcagagcatataagagcacagattctggaagtagacagaaggttataatcacagttctgccattttcttgctgttcattgttactagcaagttagttaacctttctgtgcctgaaaaaaaatggttttaaaaatagtatctagcagactgagatgatacttaaacaagttaatactaacaaagcatttgataaaataaattgatttatggtacctggtccctgacccaagttttgttaataataatatgatttcttcacattcaaaatataaagatctgggagaagtttgttgccagaggcattagcaagtgcaaatatgcctaatatgttctttgaggaataaaagaaatgctgaaacataacaaggggaagagaaataggatatgaggcaagagagatgggggttggataagatagggctttggagtgtttttttttttttttttttttttttaccagagaaacattacaatctgattttcattaaaaattttttactttgctgcatggaaaatagaacaacagtggaaaaagggggaaacacaggaaatactgtgacagaatgctgagagattatggtagcttagtccggggtaggattctgaatatattttgaaagcatagagaatagaatgtactaatggataggatgtggagtgttaggaaaaatgaagaatgaaggatgagtccaagtattcagttaagtaagtagacggattagagtgtcattaattgagaagtgagaaatcactaatacataattatgtttctgttctgttttcctataatactagtactgatttttatcatatattaaacattcaatacaaaaattgcctgtttacataactatctctaacctggatctaaggctcagttttgctgtcttgtaacattggcggtgatctgtcactgatttccaggacactgtgggctccctagagacaaggattctgtgttcctcacagatgtagcccttgtatctagcatagcacctgacacacaattggctctattaatatatgttaagcacatgaatgaggccaaaggtatgacagggtgcctcaaggagtgtgatcaaataacaggtctcattctcagattgtcaagtcagtttaccagacagaaagcattcctttgtagaacagcacttgtttaaacaaaactaaacatagcaatgccaatttacagcaggatctgttaggtgggccagacaaccccattaagcaatcttgtgtatttttaccatctaataaaactacatgggaaaaattttggtccaatcaagatggagtaagcacactctgattctcccactgaatacagctaaaaatcctggacagagctggagaagctagttgagaactctgaaaaataagtagtaataagtgaattggggaaaaataacagaactcaaaacatcactgaatcatgcatgagtttcttggacctttttccccaatatcttcagatttagactcaaaagcagccaaatcgtggaactgtgcaccagatgtaagcagaaaaagctccaacagaagtttatttccagtctgaggaaaagaaaatgacaccctacaaatcagagagcatggagaaaattctatttttgtttttccttttcttctagctaagcccccaggtaaccctggcaaggtgatgatagtaagcggtgggtgcaaaggcaacagtgtctgggtggatgcttataactctaaggatggaaacccttctctgtgaccaaaggaactgtatcccaacagtgtgcgggggaaaattctctgttggtttgttcctttctctagcctttccccacttggttcccatggcagggtgatctcagggacagaaagtgagaggcagaggtgaaaactaaagtctcagatttctagccagaagaccaggaggtgggtgggagaggctggaacctggagtgggacagggagacagtagggcagtgaggtggggagtgctaagaaagtagtcctatagcattgagtatgaactcttagtttccccctaagttgtacaggcattgatttgactctggtcagcataccaacttttgagaactcaactatgggatggaacaatgcccagggctaaagactgaccactcaatgaggcatatgtttgataaactttgatagcactgcaaaggctttgaaaactgacagttggaggcgcagcctaagaaggtaagtgggaacttacagactaaactaaccaggttgtttgcctatacttaaaaaaaaatcagtattctccattagatttaaacagcacccaagattgcataacattatatttgaaacgtccagaatatggcaactgtatacaattatttggaagtgatgtaaagagcccagacacttttactaatcttcttgcttcatttttaaactcagactgttgataccatctttctttaaatgatttagtagaattcactgagttatattcaattcttttttcttgctgctttggccctagagagaaactctggctcattaaataatttattagttgactcattcagagattaagtcattgattaaaaagacatttattgagtacttactgcatgtcagacactgtgctggatgctgctgacagaaacataagtaagatgaatctgtgtcctcaaaaaaaaaaaaacgattcaacatataagtatgggctcagtggtagaagcttgtggggaccaaaggagtttcatcttcttaggcaaactttaaagtcttaagtgcgcataataaaatggttcgttttattcaaagttcttttcttatccagtaaatggtaggcatgttaattagttggcatgatagtgcaccaaagaacaggacttcattcagtagtatttactttgttcaacgattattttttagggtctgctatgagccaggattaacctagccatgaggttctgtactaagccgacttgacttgccaggtgctctctggctggatctgcctcacagcagcatgtagagaggaaatggaagcaggaaagggctgcttttccttctttttttctttattcaaaactacatccttgagttagaccacttaacattcactcctaattttcatattgtttaaacaaatcagaagcctccaaaaggattagcagaaactacaactctccaatctgtgattataatttaactttacagccgctcaaaacatgttctttaattcatcagggaaactggaactttgaagtagctgttaaacaaaggaaaatcagactgtcttaacagtgcagaatcaaagaatgtctgagatgcaagagatttcagagagcatctactttacaagctgaagaaaggaagcccttgggctgaatttggcctttagatatgttttatttggcctaaatgccattttatggaaatctcacattaatatcaagctttgtggattctcttgataattcagaagatgtgacaacactggctccatattctcacatggcaaatgctctggaccctgtctcatccaagattgtgaccttctaattttgtccaataaactaattttaaagataaggaaaataagaccaagaggacttccctaaagtcatacctctagttagtagcagctagcctcagaatacttgcctcctaatttcttgggtagtgttattttcattatgtgaggctaaggaaccactgtttaagaatgatttggcaaattaactcatgaccatacaataataaaacaagcagcagtttatttttaaaaaatctggagttaaatctttgtgttagttcttattctaggtactaaaatactttcagattgtcctcactgtttcttctgtacccattagtaaggaaaggatagtaaaaggaaggaagatataagggaagggatccaagtattttcttggaagatgattatacatctggaaaacaccactggataacatactataacattgcaatgaaaaaaaaaactgcagtgaatcaaattctccctactgtcatttattttgtgaatctactcattctttatgcatatggcaaatggatttcagttatgcacagtggatgataccatattttttctgctgtgacagaagggcagaacatccctccctccaagccagaattaatcttttgccattatatgctcccacagaaatgtgtttatatctctattacaacacacaatactttctgtcatgcattagaattatctatgtgcttgtctatgcccaccacagagtaggaactccctgaaggctaacatttgtcatgtttatcttggatcttccatagtttctaacaccatggcttagactaggcaatccatttcttcattttgcatttgctaaatgcctattctgtgcaaaagcctctaaacatatcatgggattcagagattacttcagagtagaaaatcagcactatgtggatcagacacacattgatcttgtttatcattgtatttccagcacccagaacactgctcgacattgtcaggaatataccagtggatcatacttatgatggttgaaggtggaatagacttactgtatggaatctaacataaagtgggcccaacagagaaatgaatgttgtaatgaaggtgcaggtagctttttgggaacatagatcaagtttaataaaacaaatgactagctattgatttagggcttgggcggtgactggtgttgtagggaagaaaacaaatagtctatgaaaagggtggagtaactgatgacatcacataaatcattcatcctatgcctaacactatactgcctattctttgtcaggcagcatggcaatactggaaacccagagctgtatccacatgcctgtagagacaccagttcataatatttgcagtgtctccagtttattttgtgcctgaaatacaggcagttgacctctgaatgctcatattgaaatgcaaatgaacacagcagctgcagaaagaagaggcttcttcagggagcttcaaaaattcaacagggattgcacacttctccgtgcagaacatcaaattttaaatttaaatgattcaccatgaacagccagttggcagccctctgatggatatattattttagataccatatctctcattcacattacagtattttgcagaacttccatatggtgtgtaaatgaaagaattccacagggacatgagggctaatggttatgatattatttaaaagattgtgtggcaaaaaccatagcattagagtcttcttactatactaagatcaaactcctagaccagacttttcccacttggccctgtctgtttatcttcatcgccaccattcttttcaatgagttatattttaactgtgttttataatgtttcctgaagatgtggctttctcatttttgtccaattagcttcttatcatacgttaaaacacaatctagtggtcactctacgatgaatccttgatagcctttcccaggtagaattgaaaatgattcttttttcagggctccctcactttgaaaaggagaaaaataatactttcttttagagttgtgagaattagagataatacatatggaagttatgaccccacaacaggtaccaaataattagaaacttgctaattgttattgtacatctagtacaatttacatacacaagatcactattagtatatttacataattaacactttccatctttgaaaatttgagaattactgtgcttatttattcacacagtgttctagagtttatgcttctgacaataagagatgcaaaaaatttaagttcgttcaagattttatttctaattaaaaataatgagcatgctaaatgaagattccatctcttataataagcactgtaattgaaatgaagtagaaaattgcaaaaacgaattacattgcagtatgtaaacctacaaagaattgaaccagaaaatgcagagttcacatattgcacacatgagagattaatcatcatctctaatacaagagatttgattagggtagaaagtagatctatataaaatgattaatattgaatcatttttatcaaaaagtatttatgaagctccctcttctgagtgtagtggctattgtaccaatggtgcaaattttgtaggacatagatattcctttaaaatcacaacactattttcaaccatggcaataattattttctataagccattttattctgaaatatttcaaaggtagccattaaagaagagataggagaggaaagtagcaccacaggtgctacattctagatgctttacacacttatgacctcatgtagccctcacagcaaacacataagctaagcatcattttctgcccttgcttagatgagatccaagagttagaataaaatgctaaatgacataaagctaaaacatacttggggagaatttcaaacccagttcaatctgactctttcaactatgctatctgcagtatacctaaaacgaacattttctaaattattatcatgtttagaaagaagtaacaaagataagaaactgcttaaatacactatccaccttaccactatgaatacacatttatttcattataacccagacttcaattcctttgatttatgggatcacccagctcagcacatagctcaggagctgcatgctggagggagctacgaggaaggggtgggggcggcagacacctgccttctgacatctgatcttttaatcaaaacatgatatatatgcatgtatttatacaacgagtatgtattgagcagcaactgtgtgccagggtgttctagttaacagagatttcagtaaatatttgttaagaatctagtgtgtcctaaaatccgtaaaattgcagtagaggaattagtctcatgcgtatgcatatggtttagcttatttggagtcatataacctaggtttgaaactattttgccacttactagttgtgtaatcccgggcaagttatttactctgtctaaacattattggatttttgttaaaaggacactaatagtaattatgtcataaaatttgatgggagcataaaatgagattgtatagggaaagtgtgggtaagaatagagcctagcaagcaactgcttgttaagtgttaattatgataatgatgatggtaataagatcacttattttttattttttatttttttgagacagagtttcactcttgtcgcccagtatggagtgcaatggcacaatctcagcttactgcaacctctgcctcccaggttcaagcgattctcctgcctcagccttccgagtagctgggattatagctgcccaccaccatgcccggctaattttttgtatttttagtatttttttgtatttttgtattttgtaattttttgtattttttgtatatttagtagagactatgttggacagtctggtcttgaactcctgacctcaggtgacccgcccgcctcagcctcccaaagtgctggcattacaggtgtgagccaccgtgcccggccagagaccacttatattgtcctcaattatcaaattaagctatagaaatcttcatgattgggctgcatagaatacaaattgcttttctaattttgatggaccccttattttacctagattatggaaaactattattctttcatttgggaaattgaagtagcttttattctcctgtattccttttacttgactgccaagcaatgggaatgtaacccaggctcagtaaattggcagctgtattccaggaatctggagaaagctaagtacagcaaaagaatgatcagtatttatttgcaatcaagttcacgatagggtgcaaatgtagtcatactctggccaaattgctaaaagcagagtttcctgctgcctggaatcctttggacctgggccaactttccaaacttggtcttctagctactagtacatccaggtggtgggggtgggcaatattctttaaattaatactatttacttcatttatttatcctaaaaaagtcaaactaaaattggtttttagtgattgcaacaaaatctctgtcatgagtcaaaatgttgtttggaaaagcaacctacagtcaactggatacatatttactaattatttaagttccaattcaactattgattttcataataattagtggcttggctctattcagtgtttgatgggcttgtatgaaggcctatagtccaagagaattacattattcaactttatatcaaagtagaaccatggaccaaaagttttcctgagccaaattattaaagaaaatgcaaacatcaaattcagttcactactggcttctcctgatctggaatagcataggccttgcaccctggaacctgatttcacaagggagaataccttcccattatctgtgactatttgaatctagtaattctgtgtagagaaagaatcaccagatgaattttcttccttttcttgtctgctgaataaacttaattaaatattgcctgagaggataagagaaaacccggggccatgccttatggacgtactcatgtatgtactccaaagagaatgataaatatgggaggaaggaacaatgacaagagggaaactgaaacaagaaactaaaaatttcaggctgggtatggttgcttatgcctctaatcccagtgctttgggggaccaagacgggaggatctcttgagcccagcagtttgaggttgcagtgagctatgatggcaccactgcactccagcctgggcgacagagcaagaccctgtctgtaaagaataaaaatttaaaaattcaggcatcaagggaacccttattgcagaaaatttgctatgtgcttcttagacaatcaattaaaacatatgttttgctttctaaatttttccatgtgatgttcaataatacctattcaggatttttaaaaaatccccctttgaagttatttactatgtttcagacttaattttcctctgtgctagagacagaggtaagattttgatacaactaagatggtgttattgctaggggatctaggaatacagaattctataaaactatagccactgttctgcatgaggtttacttatgtgatacagtcttaccaaacaatgactgtacctcatatgtgaaattaaaatgccttattattcaaaacatggtcatttggaatgaaataaacctaaattttacatcaaggggacctattcctcagcctcagatgcacatcttacaatagtaagatttggcagctctacagggaacaggttaaagaactcaagggtgccgaagttccagagagccaggatttctacctcactcagagaacagggaacaaaatggccaggcttgcctccagataagaatgtgccccacttcaacttatttccatagcaagagtgtatgaggaaagagagaaaaggctatacccgtgtccctgactttgaatccatagtacctctgcactctatcacaggtggcccagtaagtatcctggaatctagccaaattattatacaaagagtaattttttctaaggaaaaatccttagaaaagaagtatttggtggattttcttctccaggggtcacaatttgaccttcatatttaaaaattattaagcactagcatcgtaccggcattatcctatagaattgtgggcgtgaataggccatgcaacttactcttaagatgttgtaacctagagggaatgtttaattggagagaaagggaggggggcaagggctgaagaactacctgttggctactgtgctcactacctgggtgatgggtctaaccataccccaaaccacaacatcatgtaataaacctttgtaacaaatgtgtgcatatagccccaattctaaaataagagttgaaaaagaaatgaaaataaaagcaacaaaaaaatcagacaaacagcaacaacacaaatccaaactcttcctagaaaagaagagataatttgtagctttggtcaaaggagaaagctataatgatttctcccgtgccacagtctaggcaaaacacaaaaattccaggtagaattcagcggcaacaggcagtgagctctaagaaatgtcacacatatagagcaggtcttaagtgactagcttattttttttttaccagattacctcacactaaactttcacagacatacttcttggccagtatttccaaaaattttgtaaattgagagcagcctttacaatttacaccaaatatagagagatttaacaacttgcccaaggttacagagatagaaaatggcagagaagcactactgctacacacagctttgtataatgccatggattacatagctatagtatagataagaggttttagaccataaaacattcttaaacgttgcttttatattttgctagaatttcacagatgtaaaacgtgacaattaaagcagaatatataaaacagtctaatcggaaaccttctggcaataagagtttgcacttagtttataaatgcacaaacctctccactgtgactcatagagatttctgacttgtgtttatttgagtttcatttctccatacaatgtaatttttggttgaattctttcttagatttacattcttttatgtgttcggaagtgttgtgattcttggctctgtgaaattgctaggaaaaaagtgcagaagaaatattcctaatattgttgtaatttattgagttttattaaatgccagagactgtgtgttatggactaaattacgtcccctcaaataccctcaatatgttgaagaaactctaattcctagtgtgatggtatttggagatgaagttttgggaagtaattaggtttagatgagctaatgagggtagcctgttcatgatagggttaatgtccttaagagaagagataccagtgacttgataaagaagatacaaaaaaaatttgattcatgccctgaatttctctccctttctgccaagtgtggacatagcaagaaggaggctgtctgtaggctggaaaatgaggcttcaccagaacccaactatgttcacatcctgatctccggcttccagcctccagcgctgtgaaaaaaaaaatttgtttaagccactgtgtcaatgttattttcttatggcagcccaagctgacttaacactatgttaaatgcttcataggtactattccatgttcttctcataatatctctatctgctaggcatttaatattatcccaaatttacaactgaagaaagtgaagaaagagagtttaagcaatttgtccagtgtcatagagctattaagtggcagagccaggatataaatctagcctgtcaaatgccaaagcttgtacaaaaccactttactgtgatgtcttcagtgtgcataacttttcatttccataaacccaccactcacaaatcaatcaatttaatcacattatcacatttattaatatgagatacatgagtttaccctataatttctttgtggcacatattttaggtctgatggacccagcttttcctgcagttactatctgaaagatgcacattagggatagtttctagccttctattcactcttagtaattttgcaccagggattcttcattaccactgcatgtcattaagatgtcagatatactcctcctaattggctgtacaacagccacatgtgcatatttcaaatttgaaatattttaagcagaactcatcttctgtacctcaatctcacccctttccctatttctctacttgcaaaattttctcaatcacctaaaattgaatcttttaagtcacccttgtcttctccctttccttcagccctgcagaggatcaccaagtttacctcattcttctgtcacctaacaataacttctgtgacaccctcaaattcccagcagcttaataaaataaaggtaatctctccctcacccaacaaattctgaattatactgtcagattaatatttttaaatatggtttttgattacctcgttttcttcaaaattcttcaacaattaagatatagaagaaaattccccaaatcatggtttggcatgcatggttaaaaacatcttttcaaacttgcattcccagccttatttgttacaatctatgacactgagtaggacatgtattttctcaactccattattcagtttgccaaactgtttaagcttgaaatactctgcctccaactccctgtctcacagcccaactaaacttcaggattcaactcaaagactagctatgtcattaatccctaatttccccagatgcatgcattctctacttctctaatgcctagagcccttaagtcacatttcaactattttctacttatcatgtgtaaccttgtattgaaggtattcccagataaattataaaatacctgatggaagagattaaccgctaactattcttggcctcctctcttgtaactcttaaaaccagttcagaatcttgcttaatggatgtaagaagtgataatttgataaagaagatatgaaagaaatttaactcatgccttgaatttgtatcaatacttcattggaaagaaatcatgtgccatttaggttatatttaatatctgctctgatagtcatgaacccttgagctgatcagtaaaatgttttccaagcaacagctcaaatatcctggatctattccaaaataaattgaattggcagggtcagtgggaatcactatggtaacagatggatcctttaactcttgtagtcactttggtgtagattggcatttacatatcatgacaaagccctgctgctgtccatcaggagcaggagaaaggtatatcaagtcagggtaattaacagtagctgctatgacaacagactcaaataaccagtagcttaatacaataaaagtttatttcttgcttatatcacaatctaatgtagattgtgaagtgctcctgagtcttttaagtgactcagagagccaagctctttctaacacatgattttgccatctttggatccctttttttctagtcacatgaatgtaggagggagattgagaccaggatcttttgtgaatttttagaacgcaggcctctaagtagcacacatcactttagctcatattctatcaactaattctagtcaggtactgcaaagtaggtttgtaaatggtgctttcctatgtgctcaggaaaaggaaatggatttgctgaacatctagcctatctttgccataccaaagcttcagcacctgaaggaatttgatatctggatctgatggttattattctggaagaaggaccctgaaaaggcatttgccctgggtctattggtagcggcaaaattcttttaacataaaattccttcaaataaccagaccttctttagtagaattccatggcagggctatgctcagtaatacccaacaactttgcattggtattcattctctagctcaaatatgtcagctatgcgccgtacatatctatagtcagctgcaccttacctatcccactttatttctacctatgtatagtgtcttctctccttgttttaatcttcctaatccatttctgtctgtgaacatggcaggcaaattctgagaccccctccagaggtagagggttttgggaattagaatgccttctttattgatcacggacaaatagaaaacctcttcatgatggactcttctactccagctccacttccctatttcctcaggctattctctctacttggccacttacccataccacactcgcttacccacaggatacccatgctgtctcctccaattgcccttggatactctgacctgaactgatttctcctgtccacagacttccatgacttactctttgactcacacattccagtgatgtttgataatcagacaatctgcttacagctccatggcagtcaatgttatctgctacaaaaaaggccagttcaagtcctgtctttgtctaagtcctctagtggcttcatgtctcaattgagtaaaagccaaagtcagcacagtggcccacacagctttccaagatctcaccttctgtgacctctttgacattatcttctacttgtttccccaacttactttgctccagccactttggtctcccatctgtttccttacctatgacagttcccacacctctccaggctttattcctgtgatttccttctcctgaaatcatcttctcccttaacgacttgggtcacaccttcctcactttctgggctttatacaaagtttctctcttcagtaaggtcaccctccccaacattctaaatcctatctccctgatttatttttcttccagtaattatcaccatctaatatagtatatatttcacttatctattttgttttactctgtctcccctaacaggaatgtatgttccacgaaggcaagaatttttgtctgttttgtttacttctgtaactccagtatctaaaatgcctactgatacatagtagttattcaataagtatttgctgaagggataaatgactcttctagttttaatcttttagtatatcttttattccttagcagaatgtagagaccctgaagttaagtactagatcatatatttgccttgtattccactccagggttgcccaatgttgcaaagggcttaataataatttactaatgtaatacacacacacacacacacacacacacacacacacaaacacacacacacacacatattatgatggagtttcattcttgttgcccaggctggagtgcaatggtgcgatcttggctcactgcaacctctgcctcgcgggtttaagccattctcctgcctcagcctcccaagtgtctagtgttacaggcatgcaccaccatgactggctaattttgtatttttagtagagacggggtttctccatgttggtcaggctggtctcgaactcgtgacctcaggtgatttgcccacctcggcctcccaaagtgctgggattacaggcatgagccactgtgcccagccatttattatattttataagtcaagatctttcacatcatttcttagtgaccatatctttgatagaaggctctcctgtcttcagtaccatgtcacagctgtggggacagcggtttctttatttagtagccatctggactaggtgtcagttctctgtaatttttaaaggtagtgacactggcaattactgaaatgtcaaaacactaggccaaccatgagggctgtggcaaaaaccttcccacatagttgtcatggtgatgtgggcaaactcatatatagcatctgacactcagccataaaattgaaattaaagttagctttttataatatcttagagaatggcacctgttataaaacaggtataccgtaccaaaacacctacatgcatatgaagaataaggttatgaataggcagaggaaacatctgttttttgtttttatattaaatgttatattctagtaatatgctgtaaatcatcattcctagcctagatattattgggatatatatttactaataccacatattgtatttcttttccacaacaacctaaatgcaaatattttctaaagcacaatcgattgtaagtgtaaagttttaatataacatttcttgagatcctttcataggatctttacctatatcatgccattttatccccatcatgactctaaaatataattattgtctgagttgtataaatgaagaaggcagggctaagtaactggcccccggttacagagtgagtgaatggtggagctgaatttaacataagtgatcactccaaagctctcactcctgttcatttcacagcatggcttacctgagtcatctgagagactgggagagaatgaatcactgagcagctcaaaagggataagcttagggattaaaagcaggaggagaagaacatccctttgtaaagtaaatttccatttggttacagacatcaaaatcacaaaagatatgagagataagggacttggttatttgctagaattctttgaagcctgagaaataagtctgaaagaggattattttatgttttatagatatatatgtataaaaggacaaatagatatttgtccttatacatttctgaacaggtttattaaagtactattgacatagaataaactgcacatattgaaactgaacactttgataagttttcacacatgtatactctcatgaaaccacacaaaagtcaagatacttaacatatccatcacctccacgacgttcctcccgcacctttgtaatccatcactccccattcccatccccaggcaaccactgatttgctttctgtcactctagattactttgcattttctaaagtttcatagagattgaatcacacagtatgtactttttttttttttttttttggcaggatctaactccttcatcctggctggagtgcagtggtgcaatcctagctcactgcaggcttaagcgatcctcctgcctcagacccccaagcacctaggactataggtatgcgctgtcacacctggccaatgtttctatttttttgtagagtcggggtctccctatgttacccaggttgatctcgagctcctggcctcaagtgatcctcctgccttggcttttctggctacttagactcataattattttgatttttgctgtgttgttgggtgtattaattggtcattcctttatgtagatgagtaatattccattacatgaatatatcacagtttgtgtattctttcacctgttggtgaatatttaggttttttggcgtttgagctattacaaataacatcattttgaacattattccttaaatacttaggagtagaatggctgcaccacatggtgggtatatgtttaactttttaagaaactatcaaactattttccaaaatggttatagcattttatattctcatcaacagtacgtgagaatatttgttcctcaacattcttcccaacatttgatatgaccaggctttataattttatccatactaataagtgcatagtgttatcttattgtggtataaatttttgttttcctaatgattaatcatattgagcatcttctcctgtacttatctgcaatccttatatcttctttgatgaaatgagtgttcatcaatattttgaacaagcatgttttgaatagtcattttatcaaagaagatgtatggttggcagataggtataggagatgctcaatatcagtaatcattaggaaagtgaacatttataccacaataagataccactatgcacttattgggtcatgtatcctgtaaacacataaaccacaaaaattaaaaatgactaaaagaaatggcttttcattttgctcattttaaaaactgcattgttattattttttaagaatttctcatctaccccaattataggtaaattatatagaaattcttccaatctgtgccttttcttttccattctcattacagagcaagtgtttttaattttgatgaagtccaacacagtcattttttcttctactgatcgtgttttgctgtcgcgtataagaaaccttttctaacataaggtcatgaatgggttttcatgttttcttatagatattttatagttttaggtttcacatttatatctataattttcattttttgagatggattcttgctttgtaactcaggatggagtgcagtggtgcaatcatagcttactacagtgctgaactcttgggctcaagcaatccttctgccttggcctctcgagtagctgggactataggcaggcactactgtgcccaattacctgactaaatttttttattattagtttttgtaaagaggcagggggtagtttcactttgttgcttagactggtcttgaactcctggcctataatgattctcttgacttggccttccaaagtgctgagattataaacacgagccaccgtaactagctaaaattaatttttagttaatttttatatacattcatacatcacttaatgacaaggatatgttctgagaaaggtgctgttaggcaatttcatcactgtttgaacatcttagagggtggttatgcacaacctactaaatacataagctatatgatatagctggtttctcctaagctacaaacctgtacagcatgttactgtactaaatactgtgggcaattatacaaaggtgtaagtatttgtatatctaaatgtagacaaagtacagcagaagtgtgacataaaaggttttaaaatggtatacttctataggatatttacaatgaatagagcttgcaggactggaagttgttctgggcaagtcagtgagtgagggtgagggaatgtgatggcctaggacattactgtatgccactatgactttataaacaatacacccttaggctacactaaatttataaaaaatattatttttctttcttcaaattcaccatagtttactgtaacatttactttataaacttttaatttatttttaactattcaactcttttgtaataacacatagcttaaaacacaagcacattgtatagctgcacaaaatattttcttctttatattcttattccataatcttttcctattttttattttttaaatgtttttgttaaaaaccaagatacctacacacattagcctaggcatgcacagggtgaggatcatcaatatcactgtctcccacctccacatctcatcctaccagaaggtcttcaggggcaataacacacggagctgttatctcctatgataacaatactttctggaacacctcctgaaggacttgcctgaggatgttttacagttgactttttatttcttataagtagaaggagtacactcccaagtaatgataaaaatatataatagtaaatacataaacgttattattttcaaaattatgttgtatacataattgtatgtgccatactttcatgcaattggcagtgcacagggtttatttacatcagcatcaccacacatatgagtaatgtgttgcaccatgacatcactaggcaacaataatttttcagcgccattataatgtgatgagaccattgttgtatatgtggaccatcgtttactgaatcgttatgtagcacatgactctacgttgcaaggtgtagactgaattttggtggggaggaagggcacgtggatataaaaatttttcagtagcatttgttaaaaagcttatcctttggcatttagattatttccacctcttggctattgcagctaatgctgtgatgagcattgggtacagatacctctttgatatactggtttcatttcctttggatatatatccagaaataggattgctgtatcataaggtagttttatttttaatatttttaggaaactccatcctattttccataatggttgtaacaatttacatttctaccaacagtatacagggttcccttttctctacacccttgccaacacgtcatctctttcatctttttgatagtagccattctaacaggtgtgagatgatatctcattgtggttttgatttacatttctctaatggttagcagtgttaagcacttttcatatatctgttggacatttgtatatcttcttttgagaaatgtgtattcaaatccttagtccaggttttagatatgttattatttgtgtttatgtgtgtatgttttaattttgctattgagttgtttgcatttgttttatgttttgaattttatcagatatatggttgcaaatattctcttccattccttaggttgtcttttcactctgttgattgtttcctttgctgtgcatgagctttctagtttgattaaattccttgtctatttttgttttcattgctatgcatttggggtcataccccccaaaaaatcatcgtccaggccactatcaggaagattttccatatgttttcttccagtagttttatgtttctaggtcttatgtttaagcctttaattcacgttgagttgattctcgtctatggtgtgaagtaagggtccaattttatttttccacatgtggatatccagtaaatgatactaatgtattaaaattttagtttctaattatttactgctattatatagaaatacaattcatttttctataattcatatcttctattacaaaaatgtaataaactcactagaacttagtttgtaaacaccactgcttttctagaaagacaattataccatctgttaatagagttttactccattctttaaaatctggacatcacttatttttttcttgacttatttcactgactagaacctatagaattgaaagccaacctcctttcctgaccacagggaaaaatatttttagtagattgaaaaagattctgccaggcacggtggctcacgcttgtaatcccagcactttgggaggccaaggtgggtggatcacttgaggtcaggagtttgagaacagcctggccaacatggtgaaacactgtccctactagaaataccaaaattatctgggcttggtggtatgctcctgtaatcccagatactcaggaggctgaggcaggataattgattgaacctgagaggcttgaacacaggaggggaggttgcagagagctgagattgtgccactgcactacagcctgggtgacagagcgagactgtctcaaaaaaaaaaagagtttctgtctatttttagtttgtgagtcatttcatcaaaaattattataataggttttctcattaaaaaatattatatgttaatacaattccatgaatcaatttttgaatattaagccaaccttacatttcaagataaacaccacttggtaataatgtattataatttttaaatgtgttattagtttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatatctctattttggtaccagtaccgtgctgttttggttaccgtagccttgtaggatagtttgaagtcaggtagcgtgatgcctccagccttgttcttttggcttaggattgacttggcaatgcgggctcttttttggttccatatgaactttaaagtagttttttccaattctgtgaagaaagtcattggtagcttgatggggatggcattgaatctataaattaccttgggcagtatggccattttcatgatataaagacttaaacgttagacctaaaaccataaaaaccctagaagaaaacctaggcattaccattcaggacaaaggcatgggcaatgaattcatgtccaaaacaccaaaagcaatggcaacaaaagacaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacagtgaactcaaacaaatttacaaggaaaaaacaaacaaccccatcaaaaagtgggtgaaggacatcaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaacaggaacacttttacactgttggtgggagtgtaaactagttcaaccattgtggaagtcagtgtggtgattcctcagggatctagaactagaaataccatttgacccagccatcccattactgggtatatacccaaaggactataaatcatgctgctataaagacacatgcacatgtatgtttattgcggcattattcacaatagcaaagacttggaaccaacccaaatgtccaacaatgatagactggattaagaaaatgtggcacatatacaccatggaatcctacgcagccataaaaaatgattagttcatgtcctttttagggacatggatgaaattggaaatcatcattctcagtaaactatcgcaagaacaaaaaaccaaacactgcgtattctcactcttaggtgggaattgaacaatgagaacacatggacacaggaaggggaacatcacactctggggactgtggtggggtggggggaggggggagggatagctttaggagatatacctaatgctagatgacgagttaatgggtgcagcacaccagcatggcacatgtatacatatgtaactaacctgtacattgtgcacatgtaccctaaaacttgaagtataataataataaaatttaaaaaaaggtattattagatttgatttaaaaaattttgtttaatatatttacatcagtgttcatgaggtctatatgaggtatattggggtataattgttttgtttgtttgtttgtttgtttgttttgttttccatgagatattttcgtctggttttggtacctgtaattctgtcttcattgattgaattaggaagtatttctacttctttacttttctggtagagtttacatagaattgatgtctgtttttccttaaatgtttggcagcagttcaccagtgaaaccaatctgggcctggagttttctttgtgggaaaatttttaactataaattcagtttaacaaatataggaccattcatattttctctttatcctccagtgaacattggtagaatgttaatttcaatgaatttttttcattttatctaaattaagtcataaagttgctcatagtatttattttctttttcatatctataaaacctgtagtgatgttgcctcacccattcctgatattagtaatttgtattgtttctcttttcttttttttctgatcaatttgatttttcaattttattgatcatttaaaagaaacaggctttaattttattgaattttctctattgtgtttctgtcttctgtatcactgattttcactctggtctattatttactttttctacttactttgtggttaatttgcttttcttttacaaatttcttgaggtggaagctgtggccattggtttgtggtttttttccctaatatttaatgctagaatatgtccttaaaatattgtttgaggtatctgaactacgtgttttttccattctgactccgttaccatatgattgctgggaacagtgttctgttttaagtggttctgtcccgggtcatgcgtgtttgatgaatactccgctgaatgctcaggagggagcctctacacatctccagcattctctcttcacgcagttctctcctctctgattctgtgctctacaaactctagctttgttgacctctctaaactcaattccattttctcactttagaagggtcacatcttttatttcttgtctcttgagaataatgtcttcattgtttgaggtccagtgtcttgcaaacttgttttctgaattttgtctggttttgctgctgttgttatttcaagcaggagagtaaattccatttttattacttcatcttcaaaagaagcagccattttcccatacatcatcatatgtaagcctcatgataatctgcaagttcattttttttttttttgagatggagtctcgcactgtcacccaggctggagtgcagtggcacaatctctcctcactgcaagctccacctcccaggttcatgccattctcctgcctcagcctcccgagtagctgggactacaggtgcctgccaccacgcccagctaattttttgtattcttcaacaagcttatcaggtctcaatttggtgaattttaagtatctttaacataccttgggttcaaattctagtgccttaggagtttgtagaaaattggtctttttaaattaagggctttcttctgggatctcactgagtattttttgacagtggatattcatcattgaaaactgcctgcactaaacacttacttgagtggataattacaatcatttcttaaactctggaatttaaataagaaatgtgtaaaattatttctctcaaaacttccatagctggggctttgatatagctttatgttctatttccttaatgctgactccaacgtggacaaactttcattcctttggcaatgaaacatatcaaaatacaaataattcaagaatgggtattaagccaatagtgtcacatgaaattctaattaattttgtctgatatgaagacacaaatgggcttctgatcgggatattttactacatgcactagtatcatgtgatcaaaatttttcttcaatgtctgttattattgttctagtatagtctttcctaaagtatggtgctaatcagtgttaaataataatgtgagttcagagttctgagagtaaaaacttgaactctactttttctattctctcactcaacaacaatcatcacagaagacttctgtgaccacatgtgtggggttttctccatgaataagcaagcaatcagttctgcagcaaacaccagctgagtgtcctccaattaaattctgatactatctacttggagatggcatcagatcccacaggttaatggagtcctcacaagactaccctccctcttcccaccagtaataagtctgggcctccagaaattgtgaccaaccggcttgaaggtgacattcacatgacctctggttgggttcagttgatttgttacagtggctcacaaaactcatagaaacttacatttaccagttcattataaaagatattacaaagatacacatgaagagatgtatacagtgaggtatagggggaggggtgtggagcttccacgctctccctgggtgcatcatcctcaggaacctccattagttcagctattgggaggctatctgaaccctctctctttgtaatttatagagatgccattaattagacatgactgacaatactgtaaaaatatgattggacaaaaagtgtagattcttcttggcttctgtgttgggggttcttgaattgctataaagaaatacttgagactgggaacttaataagaaaagaagtttaattggctcaccgttctgcaggctgtacaggaagtatagtacaaacatgtgcttctggggaggcctcaggaagcttttactcatggtggaaggtgaagcaggatcacacacatcacatgccagagcaggaccaagagagagagtggaggctgggacaagtgccacactttacaatagctagatcctgtaagaactcactcactgtcatgagaacagcacaaaggggatgctgctaaaccattcattagaaaacttccaccatgatccgatcacctaccaccaagacccacctccaacactggggattacaatttgacatgagatttagagaggacacattaccaaaatatattatgctgcccctggcccctcaaatctcatattctcacattgcaaaacacaatcacttctcaacagtcccccaaagtcttaactcattcctgcatcaacccaatcagcagtcccaagtccaatacctcatctcagacaaggcaagtcacttacacctatgaacctgtaaaatcacataagttatttactcccaagatacaatgggggtttaggcattgggtaaacattcccattccaaaagggagaaatttgccaaaagaaaggggctacaggacccattcaagtttgaaacccagtaggggagttatccagtcttaaagctccaaaataatctctcttgcctccatgtcccacttctagggcatgtgggtgcaaggggtgggctcccacggccttgggcagctctgctcctgtggctttgcaaggttcaacccatatggctactctcacgggttgaagttgagtgcctgtgacttttccaaatgaagggtgaaagttgccagtggatctaccattctggggtctggatgatggtggcccccttctcacagttgcactaggcagttccctggtggggactgtttgtgggggctccaagcccacatttcctatccactcttccctggtagtggttctctgttggggctccaaccctgcaccaggcttctgcttgggcacccagtttgtctcatatagcttctgaaatcgaggtagaggctgtcaggcattcttcactcttgcagtctgcatgcccacaggcttaacaccatgtggaagccaccaaagcttatgacttccattctccaaagtggcagtgcaagatgtatgtgttctcctttgagccacagctagagcttgagtggcctggatgtgggtaacaacattctgaggctgcaaagggcagcagggtcctggaccaggcccacaaaagcattcttccctcctagacctctggacctgtgatggaagcagctgccacaagggtctctgaaatgcctaagcggcctttccctcattatcttggatagcacttggttcccttttagttgggcaaatatctctagcaagtggttgctccacagcctgcttcaatttatcacctgaaaaagatctctttctctgccacacagtcaggctgtaaatttttccaacttttatgttcttcttctcttttaaatataagttccaattttaggtcatttatttgctcccacatctgagcacagacagatagaagcagtgaggctacatcttgaacactttgctgcttagaaatttccttagcaagatactgtaaatcatcactctttagttcaaacttgcacacatctctagggaatgaacaaaatgagccaagctctttgctaagacatgacaaggatgaccttttcactagttcccaataacttcttaatttctatctgagactttatccgcctgaatttcactgtccgtatcactatcatcattttggtcactaacatttaactagtctctaagaagttctaaactttcccttatcttcctgtcttttcctgagctcccccaaatcttttgacctctgcttgttacctggttccaaatgtgcttccacattttcaattatctttatagcaatgtcccactccttgataccaatttcctgtgttaggtcatttttacattgttattaaaaaatacctaagactgggtactttataagaaaaaaatgtttaattggctcgtggttctgcaggctgtgcaggaagcatagcgctggcacctgctgctggggaggtctcaggaagcttttactcattgcagaaggcagagcgagagcaggcacatcatatggccagagcaggagcaaaagacagagtagggtagaggtatggtgccatgctttacaactagatctggtgagaactcattcactattgcaagaacagtctcaaggggatggtgctaaactgttcattagaacatatcccccatgatctaatcacctctcaccagactccacatccaacactggggattccaattcaacatgaggtttgagcagaaacaaatatccaaactatatcagcctttctgtgcagcattccttcctctagaatatggaacaggatcccttctgaaggaagatcttatgatctacaataagattagggaataatccccaaaaatgtaaccatggaatccttttctcacactagattactgttctctccaaatacaatcttgaaaatgttaatgtggtgcaaggatgaggaatctcaaatctgggtgttagctgtagcagttatttaatttaattttatttggctcttaaagtactattccggtattctagctactctctcccaagcaattcttttctttcagtagatttttttttattttccccagtcatattttcagtttgagagatactcaagtgttctgagctatggctaagccattaatgaacatttcaaagggcataaaagatggcagaagacaacattctgatgcataaggaagtatcctctaacaacccacttcaaatactagtgagacatattcatcagagagattgtagacaactctagattgaaacttactttaagagaagaagaaacacttctaagctagtgagactaacctttttgaatataaactctttgaatgtgaaaaacttgcacacattctacaaatattatttgtacttttagtatttttgatttagtaagcacataatggccgtaaacaactatgatttcaataattcttaatttatgattttgtaacggcaacagtttgtacatacacacaagaatatgcaaggcacacttcagtccatgaacaatggtcagttatatgaggattttagacccaggcaaagtatctacagtgacccagagtccctgcatcccacaaattggggactgcggtcctaggtcctctagctttttaacactatgagaaataaagcagcatttatctaacaacatttataaaatgcttgccttatattcaaggcattgggatagggatttggaaaacagagatgataaagatagcgcctctccttgagacatttataatttaatggagaaagatgaatataaaatgtttgcatgctggtctaacaatttgaaaaattctacttatttgttgatgtaatacagcaagaaaaaattctattgactgtagttacttcagcatctgtggatggtatcatttttctttctgcagtaaactactttctgtgtggcaaagtaactttatcccaaagcagttttgggttcaaaaggtgagcatctctgtccaagggtagaatttttgaagaatacaaggaaacaaagaaacagctaaatagctctacacatgaagtggagagaaacttgtgttagtgtgtagaaatactgagaagagaggagggaaagattacagagaaagaaagggagagaattaagcaccacagtggcaaaaagcttgtagaggagtgggagtgtgtacaggagagcactgtggggaaatgctacagggaaagaaatttattttggtcactatattagtgaccaaagggtcacttttataggggagtggttgttaaggtaaacacttagacagtaaagcattaatgtaaagaagttcaaaaaccacaatggtacatgaattgttaagataaacacaccctgataaccaccactgaatcaataaatgacattgctacaacccagagaaatctcattgccaatgtacttttacattgctctgaacccgttcatttaatcttcattttattaacagtagtttggtacacatagagatggttgtgtgagtagttccttgggggaacaaaaaatggggaagtatatctgtgctcagtgtctggattcccttgtagcaaaaagaagacaaaaggtaaatgaggtgaaaagtgagaaaattaaagtcaaagtaagaacagaaaactggagcgattagaaaccatgagagtgtgaattcattggaactgatacatgtcttgaagtggacttttcactgagcaagatttagcatgtacagaaacacaggagcttaactgggcatgcaattttaaaatgaaagatcacaattcatgaaatggtgggaacacagatttcatgggtttaagaaataggagatgaggcataaagaatataaatgaccaatttgaagagttttgactgaggcagagtttggcttccttttgtagacattgtagaaccaaggatgatctttaagaatgggagtaacattgatgagatttgctctttaggtgaagacctttgaaactaatttttagtatcaaatggggaaggaaaaagctgttatcaaaaacattagatagggggattttaatatttaaggtgagggacaataaaaattatactgaaaacagtagaacagagatgtgaattcaggtaacaatgaaaaggagggaacagaagtataaaatggtgtaacaatagaatgaacactattttgtcaccagttggctatgcggatggaagaggtggggactactcactcctacaccttgagatacagcatggatgagtgtatcatttacttcaactggggatataaaaaggaggaacctaaagtttgaggtggtggttatagaagttataatgaagttaattttagatgtttaagtttgagatgcttttaggaaatttaggtgaaaatgtctgtttgttgtcttaagtgacactcctggaaactactggagatgacagggagaaattatagaaaagatacaataaatgaatgtcagcaagtgacagtatggctgtaaaggaaaccatccttaaaaaatagaatagcatagttattaggaaacagttttaacttaattatttgtagcttactttattactgttaaatatactattagagaaaaattatactcttaatacttcttattacttttaatttattattaaattcgacttataatttaagttttccataactgtgccatttaagtaaaacatactgaagtcaggctcactgttaatagtatatatttctggactcaaataataccaagtagttaaaacatttaagggccatagtaatatttagatttaagtttttaaatgcttagaaggaaaacaaaaattaacaaggctacaaacactttagacattgtaagtgacaagctttatttatacaacagcattaggatttcagaagtagcaacaactaagaataaagagtagaggaagaactggtgttaggtaggatggagaaggaagcaaatgaaaattcctttactgcatacttgaaaaggtgaaagaaatgggaaagtcaaaaatcttaaaggcagtgaagatatatagaagcaacaaagacaaaatgaactaacacaaagagaagagcagcaaagaaggagggtgtcatcagcttcttttgttgcctaggatacttgcaggttctgactgcaaaattcagtttgaggatctctcttggttaaaatgaaggaatgttaattttctaaggttgccattacaaaaaaaaaacaccacaaattggttggcttaacacagtagaaatttattttctcccagttctggaggctagaagtctgaaatcaggtgtcagcaatgtcatactccctctgagactctgggtagaattcttcctaacttctggtgatgaccgtcaatccttgatattccctggcttgctcctgcatcaatccaatcactgcctgtgtcatcccatggtgtcctccttgtctccctttctgtctgtatgtctcttcccctctttttataaagacatctatcataccgaattaggggcctaccctactacagtatgacttcatccttattagttatacttgcaatgagcctatttctaaagaagatcatactttgaggttctggcaacagacatgaattgaggaaaaggtagcaagtggtaattcaacccagtataaggcactccttaaaaaaagtataagacactccttagaaaaagaaccagtaatccttttggttattaagatgacgctttataaattccaggagccccaaaagtatggtaaccattttctcccatgattcacttgctgattctgggggctacaagagaggctcaagaatcaattcacgatgcattaaagacttaaacgttagacctaaaaccataaaaaccctagaagaaaacctaggcatcaccattcaggacataggcatgggcaaggacttcatgtccaaaacaccaaaagcaatggcaacaaaagacaaaattgacaaatgggatctaattaaactcaagagcttctgcacagcaaaagaaactaccatcaaagtgaacaggcaacctacaaaatgggagaaaatttttgcaacctattgatctgacaaagggctaatatccagaatctacaatgaactcaaacaaatttacaaggaaaaaacaaacaaccccatcaaaaagtgggtgaaggacatcaacagacacttctcaaaagaagacatttatgcagccaaaaaacacatgaaaaaatgctcatcatcactggccatcagagaaatgcaaatcaaaaccacaatgagatgccatctcacaccagttagaatggcaatcattaaaaagtcaggaaacaacaggtgctggagaggatgtggagaaacaggaacacttttacactgttggtgggactgtaaactagttcaaccattgtggaagtcagtgtggcgattcctcagggatctagaactagaaatacaatttgacccaccatcccattactgggtatatacccaaaggactataaatcttgctgctataaagacacatgcacacgtatgtttattgcggcattattcacaatagcaaagacttggaaccaatccaaatgtccaacaatgatagactggattaagaaaatgtggcacatatacaccatggaatactctgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgtggtggggtggggggaggggggagggatagcactgggagatatacctaatgctagatgacgagttagtgggtgcagtgcaccagcatggcacatgtatacatatgtaactaacctgcacaatgtgcacatgtaccctaaaacttaaagtataataaaaaaaaaaaaagattttcaagagagagattcaaatctctcattgttttgtaatatttgtaagaaaagctcacttgaggaatgtagactcctcacactttagttggccttttcctgaagatataggccaaattttctttctgaatcatagaaaaaagaaaagactacacagagaataagtcatatgtgtgacatggtaaaatggcttaacagcggtgtaattggatagtaggagtggagagagaaatgcagcagaaggaatgtttaagaggaaatttttaaactgatgcaattctttattctacaggcttaaggagctctggaaaccctaagaaagtaatatacaaaggaaataacaccaaagttcattatggtcattaaaacttaatatacataatatataatatatatattataatatataatacatatattaaaatatataatatatattaaatatatatgtaatatttttatatgtgtaatatatgtttattacatatatacatacatgtgtatgtatatattatatatgttatatataatatctatacacatatacacatatatgtatatatagtatatatatcacacacatatgtattacatatatattatatattatatatatgtaatacatatatattatacattacatattacatatatatgtaatacatatattacatattacatatacataatatattaaatattacatatattatgtattatatattatatattgcatatattatgcattatatattatatatgacatttattatgtattatatattatatattacatatatactatatataatttatatattacatatatattatatatatgtaattttaaaattcttgaaattttatttgctaattttatttgctatattgacaccggggaaacacattaagaatgatggctaacttctcaatgaaatcacaaaatctggaagaaaatgaaatgacattttttaagaaaaaaataagaatgaagcaagcaaacaaaagaaaacctgccaatatcaaatgctatactcagtgaaaatatcttttaaaaataaaaggtgaaatgaaaatgttctaagaaaaatatacactaatacaacttcctggcagtatatctgcgtatacaagaaatactaaagaaatttcctcgggctgaaagaattatagatgggagcatggaagtacaagaaggaatgaagaacaatagcctcaataaatataaaactattgatcacctatgataatcataacacagtcctgtggtatacagagtacatataaaagtaaactatatggcaattgcaaaaaaaattctgaaggggtatatagatttaaatatttgcaagcttcttgaatgtgataagaaccaacttaaaatattctatattaaactaaggactcagttggtaatttctgttgaaaactccaaataaattatacaaagagatgaaacaaaaatgttaagagaaaaggaataataaaaattattgattaatacaaaacagcagaaaagacagaggaataaatagctaaataacaaattggacaaaaagaaaacaagtagtaaatgagagatacagtaaggtaataaaaaagccaaacttctgttttgtcaattttacaatttatatagctgacaaaggactcatgtccatactatatgaggaatttttccaatagatattaaaaagataataaactcaaagaaatgttcaaaagtcttgaacagacacaaaagaggataccagctttccaaaaacatgaaaaggagcttaactttgaaatacatcatgaaaaagccaattgaaatcaccgtatgatagaactacacactcacagattgtcaaatacagaagaaaaaaccaggtattaacaagggtgtggaaaaacttaaactctcatacatgatagggaagaaatgttcaattgatattggattacataagaaactagggtcaaaagtagtgggtagtgaatatttgagtaccttttattgcacttcatagtaagacataaatctaataattattttccttgtatctttgaactatatattgactattatataatgcagatttgatggtgatttttaatctgttatatttaatttatttagcatgttggctaaactctagacaaatctgagttcaattttaagttccaatgtttaatagttatatgactggaggaacttattttgtctctctaaatcatgcttttgttatatttaaaatgaggataatattatacatctctcattaagaagaataacagaggcagtacatataaagtgtccatgccaatgtaccaaatgacatctgttgtcagacgagattccaaggggggggatggactaagtggtgctttccatgactgcagtaaagaacagattctgagcagagatcacaccaaggtgctcacatgagagatagagagctacagcagcaaggtcaagggaggattttacagaacggtttccatagaaataatattttcatggaaatcaagtaaagttttcaaggctgtatttaagcaggacttccaggaaataaagagtcagagaaacaaataactattttcaagaggaggcatttcagaccaaaaaacagtgggaaaagaagaaattaataaagaaagagggtgcaggccaactggaaaaattcccttaaatataccggttagtgttgtcactaattcctcataaagaggaactaaagatgaaatcagagctactgcttacctttcagaactccttcaatgaagctacacatagtaataattatacaaacatagaatagaccacagaaggacatatgatccccaaatctcaagagagaaaagaaatctgttgtcttcagaaactagatagaactgttaaaatatgacattagctacaaatttgaaattgtgagccataagtgacagtgctattgtttctcacgtattttgccataaaaaatgaaagcaaaggaaatgcgtaagcatttgaggatttggtcagagttacaaggatctgaagtgggagagaagcaaacatactctcacactatgttgcaatgatttctggatttcattgatgggtgtattatcccacactccagcattcctcccttccccttctacccaaataggaactgatatgagattgctgggttcttgttttatgaagcaattacatttaaaaacaatcacaaaccaccattgactatctccatcatttcccaaaagaacaaactgataccagaaacacaggatgaacatgacctcagagggggaaatctttatgaatagctcactaaattgtttctgtttttatcattttattgctggtatgtgacaacctctttgtggactagaattgggtaatggaccaggatttcaagcccactgccccactgaattctggtgttccagcaccatgggtaaaggcatctataccaccaactaacaaaaacttatcagagcaagtatttactctagtaagattttagataatttattactatttatatcattcaaaaatttgaacaatgtttcatgttcaatttgcattttcctgcaatgcaaatgcatatgggtttcttataacacaatgtaggataagtcagttccaaaaaaaaatcctttgtcaatttttacaaactttaacctttgcaggcacagatatttgatagacagatgatatagatagataaagtatatgctggctctacctggttattagaatcaagattctttttggacatgttacaaataatattaacccaagctcttattttaaacacttagttatcatatcacttataattttcaattgcaatttttgttggcattactatctcccttccaagatagtaaacctttgagggcaggaactagctttctccatcttggtatccttacaactaaagcaaaatttggtacattcttagcatcttataagtatttgttgaatgcttgaatgaatggctctacataggttacgtttcctgaaacatcacaattttatatagcaaatccctggtactattttatggtttattgatggaagtagcaactcgatctgtccttcaacactcatgtattcattctttgtacatatatgaaaccgttactatgtgcttccactgtgctaactactctggataatagaaatgagcagaatgcagtcactgcattcaaggatgtcagaaatagttccattctggagctcatgtgatgtttttagcacaatgccttatggaaatacattcaattttttgaatgatacaaatagaaatgatctaatcacataaaatatcactaaatacttgctctgatatgtttttcctaatgagactaaaacctgtttatcaccataagtggcaatatccactctacttatgtaagagtcctcccttgtaacatattacagccactatccccatgacatggtttacttaaattggaaccttagccttatgcattttaaatgaaataataaatctgcttactattgcaagtcttgttgtatttgctgttctcctgtggaaacccttccagtcggcactgaaaacgatgctgccaaaattcttgaaaccaagggtttcggtggtttgtttctggccggagcttcagataataatcatcaaaccacttgacatcgggagattggagcttgattgtgatgccaccaacagcttctcgctgatatccatctgtcacatcatacctgtcagcccagccatcactgtggggaaataaaaaaaccctcagcttagaacagatatctcctaagcaaatgagtccatttgctttccttttgacaagattagtcattaaatggctacctcaggccccatgatggtcctatattacaccgacatgattattgatatagaagcttgttagaataaaaagtgcaataacaccatggaaattttgggcctaagagtgctaaaaggcactaacctcacttaccttaaactgcagaaaataacctggagattctggcacaattttactggctgcaaaatatagtatatacatggaagctgcataatatcatcattcacatttttaatggacatttaatagccaggtaaagttaactttaaatacattattttctttggctttataataataattataatgatcataaaataagaattaaaaatattctccaacatacctaatattaatttaatcatcctgtgacacaacatttttgatcaaattttacaaatgaataataggtttaaaaaaccgtttgccgattatggttactctattcaatgttgatttcccaagcctcgaactgaaatctttgtagtccatagtccatacactattttctatcccatggaatctctaaaatacattaaaaatgtacatctgaaatcacattttatattagagtgcccaaaagaacttctgaacaatgtgccatcaaaagtggtgaagggatcatactcctcaacataactatcattctatgcactgctcactcaaagttatttaggaattttaagataaaagtttttgaaatcagagggctcataatataatgctagaggagagtataacagaataagaaaaagtaaagtcttctacaatgatttggaaaatacatgaaacattgtattggaaataaaaataaaaggcatgaaaagatgtttgtatacaatttgggtacaccctagggcatctaaggaagaaggaaagtgacttgtccctcttcactgccattggtatatacacagtttgtgctgtatatctgctggaacccagtggtactgtctttccctggaagaagtgcaagtgcttgtaaaggaagtatggggaaagggaaaatttgactaaattacaagtaacctcaaagagagaagagaaggaatatagagagatttaaggggaagaacagactagagcctcctaaatgcaaagcaggaaaaagtgttaggaggtgagctgggagtaggggcagtgggtagtggggagaggacgtgggaagagatttacactaccaatcactgcttacctcggtgatattcaaatatttccatttaacagaatgttaatttatttttactttcctttcaatgcatttttgcccttaacatttttttttctatgcagaaagcatggtccaatattttgcataaaaaatcagtgccgagaaagtattatgtaagtaattaatttaaattatacagaaagcatgcacttttttcagtatgcagtgctgtgccaactttgatataaatattgataattgggagttattccaaatgtcatatattacttattaagatatcataagggcttgagatgacttgagatattagctagggcatcagtgggtggagagaagggaaaaaataaacagaaagaacactgtttttctctaagtcctccatgacaaaaagatattaaaaattacctatagtgaaatttcaaaaacttttgtggcagatcaagacaaaaatatagtaatgtagtatgttttgtcccaatgttgaatttggttacttcacacattatcttccctcaagtttcccattttcagctccagaagattttatttaaagctgacaagttgaaatgaagtgggcttgtttgcctcattttctcctctgttttggagggtttattatatcactgagatgagagtgtgggtctcattggcactcgaggagcagcatgggcgtgttgcaaatgggacaggaagctctgtttgttcaagcagagacccattctccaaggaagtgggaatttaaattgctccttttgttaacattagctcgctcttatgtaacactatgattatgaatattacataagaaatgtaagattataatggctccaatttacccttcacagttcattcattgaatttaacagggattgtaaaaagtttgtcttgataaacttttttgcaggtgatatttccataaaagaaaactgtcaggatgagagtgataatttactgatctctcatcatgtactttctctgttttttttttttttgaggtatatatcttttctgtaagtttaataacttagaaaactatgatgttttattattagccttataagttagagttgtgagtttaaaataatttttgtttcagatgtttccaattaacagcacaatataaatcataaaggagatagtgtgtaaacagaaaatcccaatatctatgtgacaaaacagggtcattctatttaaatttttggataatatctgctatgttaatcccaaaaaagacaacactggctaaattagagggtgctgtattgactttagcttattaaacattaacatttttatataaatatgcttttaagatttgcattaagatgatagggcatctttaagtatgatgcaataaattcagcagtaaaatgaaatgctaagaaaaaacctttctgccacctaatgctttctattactttgatagagtggaccttcaatttaattttttgggtgacacgtattttaccaaagcaagagaaaacaaacggataaagatggggaaggaaactaacatttgctaaaagtctaccacatttaaggcactttactagatttattatttatccatccatccaatttctccctcttctcactggtgggcattttgcccaactcctcataatccattttattcttttccgttgtttggatttacagttgatcatcattatttacagattctgcatttacaaatttagctacttgctgaagtttatttgcaataccagaatcaatattggtggcatttttgcagtcattcatgggcatgcagagagtggtacacatttgagactactgaagttcatgtccccatctgaggttgaaaaaggtgactctgctttcttgtttcagttttcatactacaaacttacagtatctatttagcgccatcttttgcatgttcgtgttttttattggtgatttcagtgtttaacttggcctccaagaataaagctgatgtgttatctagtgtttctaagcacaagatggctgtaatatacatagaaaatacagtcagcccttcataactgtgggttccatattcacagatttcatcaataattaattgaaaatatttggaaaaataataatacaaataaaaaacaagacagtataatgactatttatataacatgtatgttatattagggataataatctagagatggtttaaagtataatggaggatgtgtacaggttacatgtgaaaactaagctacctggtataagagacctgagcatctttagattttggtattggtgggatgagaggaggaagtgtcctggagccaatgctctgcaaatatcaagggactagggataactgtatatagacaatacatatgttaaataagttgcatgaataaagtgctgttgctgcaagttcaatgttagtgagtcaacaatttatattaactaagatgtctttaaacaagaacacacataaaacaaggttatgttttgactagttgatgaacacgttgtgactaaaggctcacagcaacctaagcttgtatttcctccaggagtaatggtcattattcactaatttactgtttgctgcatgtttatagaacattactgtgaatgataagaattggctgtaattacatatagtcttaatctggatgttgttttagtcaggtttgtagcctttctttggctgtggaatcagagtaacttggacatttaaaatagaaaaatcattcttaacttacttagcttggcttaactaaaggaggattctttatacatatgtactggattctcaaaacacctcactagcagatacttagatcctttaaatattccctgcagacatcttaaggacatgctaatctacagagaatttactttcactttcttcccaagattgcattaccaaaaatatactctctttctctacaatctactcttcccctttctcctttcaactctaattcctatgatttctcataaagagaaactcatgaaagcttaatttttctttcttttcaacagacagttcttgtttaaaacaaaattgactcttgaattaccctgctattttttttcctaggtctctataaccttccttcttttcttcaacatttattaaatatctacccatcttagactaaattattttgtcacaatcaatagtcccagtatctcactggtatagaacagaagtttatttcagcctttatattcactgcagatggcctataactctgttctatgtcatcttcattttgagtttgaagtctaaaagaatagtctgtttctgggacataccaatcttgtagagcaggagtccccaaaccccaggtttcagaccagtacctgtccgtgtcctgttcggaacctggctgcacagcaggaggtgagccctgggtgagtgagcattacctcctgagctctgtcacctgttagatctaatgcagaggcattagattctcataggatggtgaatcctatcgtgaactgtacacgtgagggagctaggtcgtgcgcttcttatgagatggaacagtttcatccatgaaaccagtccctggtgccaaaaacgttggggaccgctgttgtagaaggaaaaacagatgataggggaatcatacaatggttcttaagattctgcttaaaagtggcacatgttatttctgctcacgtttcactgactgaacaaatcacatggctaaacctgacctgaatgggacaggcatccatggtttttcccacggagaggagcagtgtatattttgaagaaaatgcaattgacagcatcactgtgtgttgaaattgtattgaaactgagaaaaaacatgagttaaatagggtttagagactctgctccagcagttcacaagtctagtggagggatgagaaaggaggacagatataaataagtaaccacatacaaatgattattatgggcatgtcctaaatgcagtgggagagcagatcaataaataattgaccaacacttcttagggagataagagttgaactaagtttgaaaagtatggataatagagtgataccagcattttgaaatattgttttctatatattgaaaaaaattgttaatcaaggaatagtgaatatggagcattgcagctatgtagggtgcacaggtcagagaagtaatgagagggtgagctgaagagaatcagttgtgagtgttcttttgtgccatcctaaagatttccaactttgtcatacaggtagtggggaaccagtgatggcttttaaagtgggaaatgatacaaagacatgatgagaagtagaggaactctgctaaaagcttacatgacagattagagctgtcggagatgaaggttagggaatcaagttagaaaatatgttgcaatggtcaaggaaaccaatggagaattgaattaagggagtggcagtaagaatgaagagccatatttataaggaatcttaatgtagaacctccaaacttgtggggcatagaaggtaaaggagcatttttaatgattcgtgggaggagaataacaacattgcatgtagctccatgtcctaggctggacagtattggaaaagaacaggttttttgtgaaaaaggaagaaaatgaatatgagttgggatctgtgatgttcagatttatctttatacgatctctcacatttctttttctcctggatttctacatattctctccatatgcaactggcttgaatgttaaaaatgcaagttaacaatgttcgtacctgtggttccagtatgatattaacctactctgttgtattattgtatgtatgtttttgtttgctgtgcaatagctgttggcattcaaaaatatgagagaaaaatggtaattatacatctgtaaagatttataccttacaccattgtatgcttatactaaaagtattttaactttataattatttctatcattcattatattaaatttatgaaatataaagcagaccaatagttatagttataaaataattatgataggacttaacaaccaataggcagaatatcacaatctatttttgctagaatgtgaaacctcctgagtgctatatgctaacaggaatatataaaaataaatcttagacaattacgaagataaaagtctaaggattatggaatgttagggcagcgatgccaaataatttaaaaatctatctcccttaatgaaatctaaatccataaaatgcagacaatataattttttctttcttcatttcctatccatatatgttataagttattgctatggaaaacagaaaaatacatgtagccctgaaaattgcattgagtgatcctttagtaacagtctcaatgttttattcatttcaatttattaattcactaaacatttgaatgcctcctctgtgccagacactggtaggttccaggccatgccctcaaggagtcaacagtccattaggcatgacctgcctgaatgggcattgccagcttccagtccattgggtttttctcacttatccttcaaattaaacattccctttcctttttactcaatctttccataaacagtagaaatcattagatttccagtcactgaattatcatttactgaaaatcacattcctttcttgcctccctaagattattctctgatcacctcaattagtattctggatatttccaagttcttaattcttacatttataatctcttgatttatttatatggaagactaattatatacaatgggcatggattttcactagttgaactctcaaatggcaacatggttatttattaatactacaactccatggagattttaggaaggcatcccatggtgctacctgccataggcaaacaacataagtacattctgtacccaaaggagcaataccaatctaaaaatgttggaatctgaatgaatattcctagaagttagtggtcattaaacttgtgtcaggaaatataactatgtgtggggcatgctagggccacacagttattcttgcccactgaaatcattagttatgcttatcatgatgaaactggtactgctgagacgaacctcacacatcctgttgatcggagacatagaacattgattcttattccttagatatgttaatagtttcacactcctaagcctttgggtgtgctattccctctgcacagagtgccattcttttaacttctcacatgttttctgatttgataaaatgtaattcatcaagcagacagatttagcttgaatgcaacttatcaaaaagctcctctgggcttaatggttccttctgctctgcttctaaaatacagtgacattcattgctttattcactgaacaagtattgtgtaactaatattctaaatatgtggatatagtggtgaacaaggaaggcaagatttctgctctcatagaggtaacatgatgcttttagttttgcaattgtcattgtattaaagatagctacatttatttttgcttccccaaagtagactacaaattttatactttgcacatctttgtatccttaatgcttgttataatgctcagtacataccaaatactcaagaaatgtttaatgtaacttgtttaaaaattaggttttaaaaggaaaacttcaaataacacagatttcttttcagataactacatctactcatttgttaattgagaaaataacactgtcaaatgtgccttataaatgactctgaaaggctgagttgattcccccgtgcagaatggtcctcttgttatctacctgatgttattaaggttaatgaatgtattcattaggctgcatctcagtattttttttttcaaaatctgtttgcaacccacataattattatggaaactgctgttctacccacatgtaatcatcatcctgccaaatctcttactaatagattttaacagatattttgggattttaaaaaattctaatagtgggagtctacggactacttggctgttttcacataatattgctccgtgcaccccaggaggagtaggaagtctcaaatctctacacactagtgaaaagcaaggaaaaatattgagactctattttattttattttatttattttttagatacagtctcagtatgttgcccaggatggattcaaactcctgggctcagcctctggagtagctaggactacaggcctttgcaactgtgcctggctttgaaattttaaattaaggttcttatgaatataccccagccaacactaatgaattaattccaaaaagaatcaaaatttagaattgttcagaaaaagataatgttatcaactgaaaatcaacttatttctgaggtgtataaatctcaatatttctcatttcaaaggattcataaaaagtaagtagaggtagattggaggagtgatatcagaacattcaaaagaagggaaaaagtcaggaacttgaaatttgccacctgtatatcataagataatttccactgtatgactttttctaaagttctgcaggccttagagataattattagccctagtttttacatctgaggaaactggaggattaactagccttataactgaggaaatctgagggattaaataacctactcaaaaccccatgacaaatgtagaggggatataaactcagatcttgctaattctaaaactccagcacatttcatacttcataaacctgctaagtaatgacatacagtaatgacagcagagaactgtgtcttgatgaattttatttaagagacatgtattggaaaacagggatcagattgtatattgaaaatgtgtaggtaagattctaaaatggcatccaagatctctgatctttggggtatacacacctctcttagttattcaatcaaacactcatctagataagtgcttctctggaaggattttaaagatgtattttaggttccaaacaagctgactttaaaatagggatactaccctctataaatctgatctaactaggtgagtcctaaaagggactggtgatttctgatttaaaaaaaagattcaaatgagggggacttgacatgagagagctagaggagaatctccgttgttggctttcctgatggagggagctacagggaaaggaatgcaggtggtctctcagaaatgagtatggcctccagcaaacaaccagcaccagaatggagactcaagcctacacccacagaccaccaaattcagccaaaaacttgaatatatttggaagcagattcttccagaaagcctccaaaaagaaatgcagttcgccaataccctgactacagcctgtctgaccctgagcagagaacccagttgccatacccagactcctgacatccagaaagtatgaaataatacacgcatttttctttaagcttctaattttgttataatttgttacacagcaatatgaagttaatactcacttcccaactctattctgcatttcttcacttggaaggccaatgcctgttaatatttgaagagataaaatcttaggcggtctgacctaattctgggtgtggtcagtatagactgacttacaaagacgtggggattacaggaaataacagatagtaagaaaaacctattagaatagttggaatatccatcctgtcttgattttggtcctaggatggcaggcattatctcctctggtttaatgtcttgtggctccagggatgcttccacgtcatatgcatgctttaaataggagaggctgataaatatctttataaatagattgattacattgtgtgttacccaatcttttgtttctctcatcatattatagccatttggagaaatgcaaaaattgaggctattgtataaaatgtgcaacaatttagtaagcaaaatgatccatttcaacagagaaaacactttgaatgagctattgtatccatagctttatataaccttgtctgttttttcatgaagtttcctttcttaggatgatcttccagttttcatgctataatcccttcttccactgaattggactaattccttctgttaagcttgtaaatttttatcagtgggactagtgcttagagtttcctgttacatgactgtgctgggataacaccttttcaaaaatatttctcctcttcttaattgcctcttttatgaaggccaaacagcctctgagagcacaatcaaggtgattgcacggtgctaagtgcaatattaaatcagtaatttttttattgaacacctaagcaataagacaggcttcaagaggatatcaatgaatataaacctcacctcccagtttgttttatttctttttatatcataacaggtcactagggacttcataatttcaaatctatattttcctcatactttcctcaaacttcctgcattatttaacattactgattcatttagtaaaatctaacaagtaacattgtacttgctaagttctctgcagagtgctgcatatgaggaataaagagaagaaaaattatcattcccttcaaccttagagtcaggtaaatgaaaaaaattacttgaatgataactatgataatgtatgtagtgtttttttcctaccaaacattgtcctaagcaatatatgcttatgcctatattctgctaaatattatatatacagttggccctccatatccctgggttctacatgtgtggaatcaatcaacccagatttaaaaaaaactggaaaaaaaatggatggttgtgtctgtactgaacatgtacagactttttttcccttgtcattattccctaaacaatagagtatggcaactattcacatagcattttcttttcttttttcttttttttaaagatagaatcttaaaaatcttgctgcccaggctggaatgcaatggcatgatcttggctcactgcaacttccgcctcctgggttcaagcaattctcctgcctcagcctcctcagtagcagggactacgggtgtgcaccaccatgcccggctaatttttgtatttttagttgtgacggggtttcaccatgttggccaggctggtctcgaactcctgacctcaggtgatccacctgcctcggcctcccaaagtgctgggattacaggtgtgagccacagtgcccagcctcacatagcattttcattgtattaggtattataagtaatttagggattatttaaagtatataagaatatgtatatactatatgataatgatttgagctattataaaagtgacttgagcaaccacgaattttagaatccactgagggtcttagaatcaatcccccacagatactaaggaaagactatatgtatgaaactgaagtacataattttacatgttcacattccacatgaggcaactgtagcttgcaaagcaagcaaattgcccagggttgcacaatatttaaacccactctatctaaatctagacattaaaactgaactagaacaatgtattaaatgtgatctttaatacaaatctgtgtccaaaggtatatacataaaaatgtagatagaagagataatttaatttatttacacacacacacacacacacacacacacatccctcttggaatttctttcttttttttccttctacctgaatcgtcaaatagagaactgccttaaaccattaaattaatattctgataaaatgtctatttctgtattgttcagtaccctgtcattgttagtaagagtctctctaataacatggaaaagaccaattagaagatgcttaagagaccttgatttctgtacataaacacagaatgggctcatttccattcacatttcactttgaggcaacatgtttttcctggacaaaatatccccacgacactcagaaacctattgtgaacttctcacatttatttaatatagtttccaaataaaacgtataggtatagaggaagagtaaataatcaaaaattacactgggattcagattaagttttagaaataatcattgtacaagaagtgacacaaaattcaaaacctaagttcctgaaaaatttaggtatcatatgctcaataactaatccaagtagacttaaattttaagtcacataatagaaactgaacagctacttccacattttcctgtgatagattaggcaagccctcctctgaagacaactagaaaggctgaatattttttttttaatttgtttaagttgtcagaaagctatctagtcagccagtactgagggggccatgatccaggagaaaaaaaaaaatggactgaagaaagactttccctttgaagtatgtgacaattcattgaagttgaactcattgataagaagctaagaagttgggacagaagcaccaggtgagctttgaacatttttgagttctgggctagtattacatttaaaatcttatcagtgaatatctgggagggaaaagaagcacagatatctgaagcagatattatttcctcccttgaattctttgctaatttgtaggcatttactgaaaatgtcagaagtggctaagagattggacagatgagaagagctttaggcagtcatactgaattgaagaaaaaaagaattgtaattgttcattagtctatttcctgttgtttataagagaatgcccacaactgggtaatttataaagaaaacaggtttattctattttttattcggcaggctaagaagttcaagggcatgcctctagcttctggtgagggcttttgtgctgtatcacaacaaggtggaaaaggaagtggacacatgcaaagaggggaaacttgagaggtgttctgactttataatcactcactcttccaggaactaatccattcccatgagaatcaatcgagtctctcaagagtgagaactcactcaggaggagagaggagcaacaagccattgatgagggatctgccctcataacccaaacatctcccactaggccccacctaacaacatcacaggggggatcaaattccagcctgagttttattgagaacaaacaaaccattgcagatagtaaccactttgagtttttatttgggatcattacaggctatattttagttgtaaagacaaactggaaagtgataggctccaacaaaaatggaaactgcttcagatcctctcactatcaagctagcttaaaatggtcttcctctcttttaactgctataaacaagcaacagcaaattctctctggatgaacatacaaccagatgtagccttagattacctctacaatttttatacatgttgtctatcatttcagtagtaaatggacagacatataaagcattaaagaaaaagaatgaaatgattgaaaaccaggaaaaacagtcaatgaaatcaaccccatcccaatcattagaatcaatagagtgaatttaaatacaaatatgaataatatattcaagagaatagatgaaaagtcagagaagtaagttgaaagcagtaatttttttaaaaaagagaaatttaagaaactaaacatttaaaaatttaagaactcaatggatgtgtcaccttcagcagaataaacacaaccaaaaatgaagtttagaaaacttagaggaatagaatatatccagactgaaacatggaaaaacacaatttttgaatatagaaaagtataaaatatgatgaaaacatctaagtcagataattagttttccagggggagaagaaaaaagagaatagagtagaaatcatatttgaagagataatgatggagtatttccaaaaccaaatgtgcaaccagcatgaaacctaccaaaacacagattaataagtatgatgaatccaagcaaaatgaatatgaagtaattcacactcaggtttatcatagtaaagctgctaaaaatgaaaggcaaagttattgaaagtaaaatgcaggaagtgagaaaaagaagcacattaaaccctccaaaactagaggtcatagaaaaataaaaatttatggagaattgcttaaaaaaagtatagtagaaagaaaaagttaggccaggcgcagtggctcacgcctgtaatcccagcactttgggaggccaatgcaggcagatcacaaggtcaggagttcaagaccaccctggccaatatggtgaaacaccgtctctacttaaaaaacacaaaattagctgtatgtggtggcaggcgcctgtagtcccagctacttgggaggctaagacaggaaaatcgcttgaacctggtaggcggatgctgcagtgagccgagattgagctactgcactccagcatgggcgacagagggagactctatcaaaaaagaaaaaaaaaagaaaaaaaatgttaaagtcaaaattgattctttgaaaagactaataaaactgatgaacatttatgaacacttggcaacaatgaaagaaatgagaaatgcacaagttatacactaaaaagtaattgtaaaagggcagccaaaaagaatattgtgaaatatgttatggaaataaatttgaaaatttagataaaatagaaaaatccctacataagtattaaattatgaaacagaaacaaacataaaacagaataattttatatctcttaaatcagtggaagtttatttaaaacatctgcagaaactcgcacacacacacacacacacaaagacagaataattttatatctcttaaatcagtggaagtttatttaaaacatccccagaaactcgcacacacacacacacacacacacacacacacacacacacacacagagtctggcccaccaacttcactaacaaattattctatacctttagacgagaaataacaccaatactcaacaattttttttcaaaaaaaagcaaagaggaaaacttcattttataagtccagaaaaacagtaatatctaaatattaaagtgatttcaaaataaagacaaaatgtaggccaaactcttataaatatcaatgaaaaatctcaaataacatattaggaaactgtccagcaatgtatagaaatgccaatactcattcaaatttggtataccccaggaatgaaaaattattattgttattattgtggtaaaaacaggtaacaagaggtctgtcttaacaaatttttcactgtacagtacaatattgttaactataagcacaatattgcacagcagatcattagaacttattcgtcttgcagaactgaaactttgtatttcttgaatagcagctccccatttccttcatccccccaacccctggcaaccacaattcagtttatgcttttatcaagttgactgttttagtcatctaagttgaatcatgaagtatttgttttcctgtgattggcagacattatgttatttcacttagcataatgttctcacagtttatccatagcaaagtggtgcaaccactatggaaaacagtatgtagcttcctcaaaatattaaaaattgaattgccatatgatccaataatcctatttctgggtatttattttgaagagatatatacaccctcatgttcattgcagcattgttcacaacaatcaagatgtagatacaccctaaatgttcactagtggatgaatggataaagaaaatgtggtatatacatatataattattttaattttcgaaagctggtcagcttaatttaccacattaacaacataatgccgtcaataaattaaagaaaacgtgacaaattcaacatcattctgataaaatgaccttggcaacctagctaaaaaagataacttccttaatctatgccagagtctttacagtgaagataacacaacagtaaaatgttgaaatatttcttcctgatatccagcataagtaaaagatgtcttcactcactactttttcccaatattttattgaaggttctagcaagtttaataaggaaagaaaagaaataaaaaggagtaaactgtcattagccaagaataatgcaattatttacctagaagatctgaaataatctatagatatactacagatacactattacaaataacaaaggaatttagaaaattggtgcatactagtttggcatacataaatacatttaatttctatatatccaaaacaaatacaaattaaaaatttaaatatattacttaaaaaccacttaatacaaagaaataagcctaaataatatgtgcaagatctattcatgcatgcaagataaattatgggagattttacttgataaagagttatactgtattcataaattggatgaatgaataatgtacagttaattctcttaaagtcgattacagatggattgtaatctcaatcaatattccagtgggttttccttggtggggtttaggtggagacgatatttacaagtaggttctaaaatttatagggaaatgtaaaagttcaaaaatagccatgataaccttaataaagaacaaagtttatttgaaaaatgtagtattagatattaaggttttagaaaattagacataatttgttgaaattatgggaccaatagaacagagtcccacatgcatacagagacttaatttctaacaaaggcaacactgcaaagaagtaggaaaaaatgttctaataaaaaagattctaggtgaatcatatgtctttatgaaaaaagagtcttgatacttaatccacactgtttacaaaaatcaaaattcaagatagattgtagacctaaataggaatgataaaataataaatcttcttgataataataaaaggagatattttcaccatagaataggaaagagttttcaaaaagggcatagacagaactattaaagtcaaaattgttaaaagtatctataatataactaatagcttattttcatcgaaagacaccactaattgaataaaaatgtaggccacaaattaggagaagatcttgtagtgtgtgtgtatgtgtgtgtgtgtgttgtgtatacagatgacagataccaaaatgatagctagataggcaaaaagtctgaaaacgactcatatttaaagtatatgaataatttctataatttaatataaaaatagaaaatcctatagaaaagtaagtggtcaggaagcttgaacacttcacacctcacaaaatatgatttgaaatgaccagtgaatgtttttaaagtggttaactttaatcattaggagaatacaagctaaaaccactacgaatagcactactcacagaccaaaatggcaaaaagttaaaaacgatcgacatagttcagtataaaatggaaagcaactgcaattctcaatcattgattttaagagcataggttggtacaactgcattggaaaactatttggcaatatctcctacaactgaatataagcatacaatataacccagcaattctggccctaagtatgtttctaacagaaatgctattaaatacacaccaaaatgcatacagaagaatgttcactgacagagcaggagcatcgccatcttggacaagcccctcattctaaagttcaccttaataaaaaaccatctaaatccaaagagcatcagcttagtgggtaaggtcagcacgaccataaaccaaaaataacatctccaacaacaagaaacattccaaaatcctccccaagcagagacatgctagaccctagataaccccagtccaggccagaaagatgtctgccccaagataacctccccttctcccagacagattccaactctgccataaacttctccacatacacaaatattccaagcttataataagtttgcttaccctaaaaccaatatatactcttagtctgtaagagaaagtgctcctgaccaggatcgtccaagagcacctctcaggttttgtctaaagtaaacctgtctttaactgccagctgcatttagtgtttgtttcctcttttttcaactcttacattcacagtagcactatttgaaatagtctcattttaataacaaccaaaatgttcatcaccagtagaaaggataatgaattgcagtttatttatataatacagtagtagacagcaatgaaaatgaacaaactaccgttacatgaaggaaaatgaataatataataaacataataccaagttaaagaaaatatacggaaaggagaagattatacatattccacttacataaaattttgaagaaggcaataacccagaatattggaagttaaaacattggttccttttgaagagtgtgttagacttggaatgagcaagctggaacgttgggaccttgctcactggagcactggtaaagttttatttctggatctgattggtgtttaaatgggcttgttaatttcatgcaaattcaatgtactacacatcatggtttctgtgctcttttggttgtacattataatgcgttaaaatatttttatttaaacagaaaacttaaaatttaatttctgattagtcaagaaatttataatgctgacttgtaaaatttcagcagcaaattctgcttaaaggagattcatcattaattcatttcattcttaggagtcttcaaatgctcaggcatctttaagactgtcttggagtccttggccatcactttttcaaaaatccagtgatataatgataaaaccgattatagctaacattaagttatattatccatatttaggcttaaaaattgaaatttgtaattcttagaaaatccttttggaatctgaaaatagtggaccaaattcagtacagtccaagtacatcaacatttattaagtatctactatgttccaagcctaagtcaaatttgatgacaaacatattatatctgtcctaaatcaagcttatactctggtggaagacttgaagaaagaaagacttgaagaaggaaagactacagaaaagtataatttaaatacaattgaataatatgtataacaaagacctatacaaaatgagacacgagaaattgggcccatgtcttgaagaaaagttattttattttttataagttgatatctggtctcaaatctaaagtgtcaaagagctgacaattggtgaaatgtacaaaagtaaggataattttgagaaaactctcttgctgaatacagcagaaatatttttactcaaatgtgataggagcaaacactatggtccaggaaacaaatgttcaaagtaaaatataaaattctaggccatatttatataatacataataattacagcaataatgttataaaaagacattgctaataactggaaaaactgaaaggtactaaaaagtaaaatggacatgattgagacagaataaatcaatcagcaaatacatattaagtgcctgttgtatgtgaagcagtttattatatgctgagggtacagtggtaatcaagacagagaagttactgtatcgagtcttgaagtttttgcaaaattgtcagatataaaaatggagatggcatttgcagcactgcaaatatcatgaacaaaggcaaagaggcatgaatccacatttttttatgtaaggaaaattccagccacttaattttcacagaaatttaaaatgtgaacatgacacagtctaatttatactattttatagatgactcttatttgcgaatggatttaaacgttttccattttcaagtacttattaggaggccatttccataagtcaggtgagaagtgatgatttgaaacaaggaagtgattataggatggaaaataaggaactgaagtaagaaatactgtgtttatgaggacaaagaggcagggttttgtgactaatattctatggagtatgaggaaggaaaacaaatctagaatgacaccgaattttctgatttgagtgattagtaacatttactaaagagaaatacgtttcttggggaagtttagttttaaacatgttaactttgaaacgcttgtgaaacaatcaagtgaatgtcacaaatgcagttacacatataatctgaaatgtagagaagtctggcctgagatatttaattcagatattatcaataaatctatatttggtagaactggtaaagggaatgtgatcacccaatgaggatgctgcatgttatgagcaattgagaaattcatttattataattttttagtctgacaaaatttcttttctagtttgtattgcccccaaatggtttaactgtactggctgttcatacttgaatgtccagttagagcataagtcatatctcagacagaaagagataaaaatctgtttagggagatgtattgagtagaaaacatgaacccaggctacaagagaagcgtagagaaacaggcagtgccaaatggttcatagttcagtatctgtaatttcagatcaggggatgtgacactattttgaaaaaaaaaaaacaaacatactctagagtataattaccaagcatttctgttgtaggttgtgtttggaacaagcagatgtgagggtgaagcttagacctatatagagagaagcactgagaggattcaaacaagtacgagggaagaatcaacacatctcatttgtatgctggatctaagaaatgtcagtgtcagagtaaagtgaagaatcattcagggttgtatttaggtgtgagagggagtgttgggagtcactgacctttgctgcatttgagatggttgactactttctcctggaaaatctcatcccatggcttctatagtaacaaattctcctaacactcctcttgccaccctgttttcttcctctctatcctctaggtgagtctctcatcctacaggccgagtttagatatttcctagagatttgtctttgaaatttttctattgcacttttgtatagtttcccttttggattttatcctatgactccaattaccatttatatctaattacttctacatatctatctttagccttgttattcttcctgtgctctagattaaaatattcaacacctactagacagcttgctccagaggaacctccaataaaactggcctaaaatatcagtactgttcatttcaccagtagaaattattgccctttctgccatatatctctaaaggaatgctaccattgttcctctaattgttcaaacaaggattataggtttggggcagtgtcactctttctcaccaggaatctgctccttccagagacaaagtcatgatgattccattgactcagtgtcttgggaagctatttttttcccttgactgtctcagtgatggctttattttgaaccttattatctctcacttgaattaggtgctactgttctccctttgctgttatgagtgagatttctaaaacacaaatgtaataatattacatctctgcttaaacatttaaatttggctctctttgtctttaaataaagtccaaactccttgaggaggcacgtaagatcctttatcctgtaatttctcagtagtctttcttttcattccccttttctttctgtatgccacattactgtaggtgcctgcaagatatcacattttttattaatcatccctactatggtaccaatgttcacttcatgttcacttagtccagtgctttttgttttcattttcctatattctggctgtttttctaaccccatttcagatgccttttattctaagtcttctgtgatcctacatgtgggaaagagcagttttgtactttaaacactgtgtgcttaattctgccttagcgtgaatgacattgtaattttaattgttatgtgcttctctttttcaagacactatttcattccattgtcctagcacttcactggattcattgcttgtcaataaagaaggtgtctttaatattgagtaaatggacggagtgaggcaattgttagagaagaaagactattataagaagaaagagaaagatatgtcggcaatttaaatgagtaaggatctttggaggttatgctgaggtttaggctcaaggaagatatgagcctgtctgcaagaaaattagagtatttatgtcttcaagaaaattagagtattttggttaacaaaattttgatatagaaaacaacttagaacaacccgaagctatatataagcaaatggcagttattataatgtacgcattcagaggagttgaactgtaaggttatttacaggaataaaagtagtgagagtaagctttaaagaaaagacaagacttaaactgagttttctccccagttagttactctgtttggacttccgtcacgtcatcctaacccaaaaccttggactcgttgtcccatgtttctcacagagtcaaagacgtgtaataggcattctgtaaatgtttgtataatcagcaacaagcaagaattgggagtccaatgtggccatgtagaaagttaaacacaggattgaatatggaagtacagaaataacagatggccatattgagagtctaagcattctcacacgtaagagaatcatagtatttgtagagtgataaacatccaatgctgggaactgcagctctggttccatgaactcttggataaaaaccctaaggctagttataataaagaactcagcaagggggatcattaggaaagtcaaagtattttatcctttagggaagttaccatcattctataaagataatttaatgtcttgcattttattataacactctcaaacaattcagtttataattcagtgttttattcccctgcttgattgattttttaaccatgattgattggagccccactctcagcacttccagagaaactgagtgagttgtaaagttcttcaaaggacattatttattcagtttcacatgcattatttgtaaaggtaacaaatatttattaggcacctattatatgcctatgctatcatttgagatacaatgacaagctgttctttattcacctctacctccaccaccaccccatacacacttgaagttccttgggggcaggaattgtatattgaatatatttatattccagtgcttggcaaatagtaaacattgaataattatttattaaattaatgaatgacaatttaaacattataaatacaatgatttaaatatgcacaagatgctatagaaactataaaatgaagaataattacttactgcctagcacaatatatttcagagagattttcaattgtgttgataaattttggaatgaataagtgtatgagacaccatgaatccctcaattcaaatactccattgttttctagatgctatataatgaaaatacttttaaagtgaaaattatagtcttgataagttaatgcatcttcaaaacttgaagttaattcatttaagtaacacatttttatgtagcacttactgcgtgcaaggcattgcatttaatgcttgtgctcaaatggggacaagaaaaagtcattttgttgaaataactcggtaattcatctgaatttgtagaacagctaattatatgagaaataaaaatataatctcttctgattacctaagtgcttgaaaaagtacttgaaaactgtggaagtatggttagagtaataggatgaaaggttgtatggtaaattaattaagaactctacacttctttgatgggccacctataatttcatatttgtatttatgttaatgtccagtaaagttaattttactatattcatttatgtgactagaagatatatatacaacatgtaataacttttattcagttgtacatttacagcattatctagaagccctgacttttaatataatgggtaatgtttttcttccaatattcactcctgtcctctcctgtagtaaattcatattttaactctagagggtccagacttgtctctgtcaaccagagtaattcttctctttgctttagttattagtttaggtaaccttagtcaagctgtttagcacttagatttctcttagcctactcagaacatttcctgggaattgtgggacacagatattctctttctctcactggacaatagcatatgaggttgtaaggctggtgattgctacagtgattcttctacaagagaaattagcccaagaatgaagttgaaacatggagaattacaaagaaatggagccagaatcctgatcaccctataccttaagcctgaccactttgaactttttaattacataagctaataaatcctctttaatgctgaaaccaatctacaatgaattttccattatttacatcaatgacaaaaatattaaatgttataaggaggtgttaaattgagatgtgattatcaatttctcattaatcattaggctgcatctttccatttgatttgctacattaaacatttaattataagaaagagacatcttattgaatattagaaattggcaagattttagcttgataatgcatattaccacaatacatggaatgctgttactatattcagataattagttaccaacagttgggctccacacatttaaaaatgttgaaattaatagatagtattgaaaattgacttaaattaaaatcacaatatataaagtggaattaagattacaaacgtgatgcatttttattcatttttaatttctgaatttttttttttttagagacagtgtcttactctgtctccccggctggagtacagtagcataatcatagctctctgcagcctcaaactgctggccttaagtgattctcccattgcagtccccagagtagctagaccttcagaggtgtgccaccatgttcagctaattgttaatttttttgtaatgatggggtctttctatgttagccaggctcgtcttgaactcctgggctcaagtaatcctcttgccttggcctcccgaagcactggtattatggatgtgagccatggtccccagccatgttgcattttcaactgctctagtccatcttgaacttcaccttatttgtccattatctggaccacaccatctacataattacttctttcatctgctcaccatcagtactcattttcaacctttcaacataggttagcaattagctcatactttctcctccataattttctcatttattctttcatctcttcaactgcatttatttagcatatcctgtatgccagtcattgaactcaggtacaaaatacccactgaatatagctttgatgccataagagttgagaaaaatgctaataccaaatttaaatgatattttttcattacaaattgatgaccacaatggaaagaaatataatgaagaaactgattttatctactctgaggctacaaagaattccatgaatagtgaacatttaatctcagatccaaagatgagtggtaattaactaggtgaagaaatatgccagtatttattagccaggtaaatcaatatcccaggaagaaaaagtatcccatttgaagctctgtggtaaaaagaagcttgactcatttaaaaaaaaaaagtgaaagaaggccagtacagtgaatgaggaggatagtggcaaaagacaaactccacatcatatggaaatcacaggccattttaaagagtttagttttcatccgaagttcaatgaaaatacatgaaatgtaaataggcaatgagaggatcagatttatattttagaaacaactttctatatatgttacaatatgaaaaattacagaacagaggcaaaagtggaagatgcaattgcaaattaagtttcagttgcactgattcaggagagaggacactgcagtttggatcatggcaatggagatgggaaagagtgaggacatttaagaaatactgaggaatggagctatggaattttcagaagattatatgacttctaaatttcttgcttaaacaaccattaagaaaaagaacacagagaataactagctttgggaacaagattatgagatttattttaagtatagtgacttgatattcaagtagaaacattacatatactactttagaatttcaaatattttacattgaaaatatgaatctgagaatgatgagtcaagcctcttttggttgcagtatatatatagtatgtatattcaatctatctatccctctatcatctattatctatctatcagtctatttggattttattgccttgtattactagaaagttgactcaaagttagcttcacatatgataatatcctggggctcaaatacttttatacttttatgagtccctttaatttagaagctgagaggaagctagattgaatttggcaattctggaaggtgaatagttgaacagcatgtgtcattattctcagcaatatctctgttgctgtcacttagcttcaccatacttgatttatattaattcagtaagacaaaagctttaccacatgctcaacaaatcgattttaaataaggcaccattctatttatgaatacactttctcttaaaccttagtttcaccttcctcattcttcatcttcttaatctgtttaataaaaacaaatagacaaaaacgcctgagagttgaaacaacttcaattattaaaccactaattctcttacaccaaatgtagtctattctctgctgttgtgctggtaatctatgggggttaattctgtgacattctcaacatcaaactaatttttttaatttttgtttatactttaagttctagggtacatgtgcacaacatgcaggtttgttacacatgaatacatgtgccatgtaggtgtgctgcacccaataacttactcgacatttacattaggtatatctcctaatgctatccctccccactccccccaccccacaacaggccctggtgtgtgatgttccccttcctgtgtccaagtgttatcattgttcaattcccacctatgagtgagaacacgtggtgtttggttttttgtccttgcaatagtttgctgagaatgatggtttccagcttcatccatgtccctacaaaggacatgaactcatcattttttatggctgcatagtattccatggtgtatatgcgccacattttcttaatccagtctatcattgttggacattttgtggagaaataggaacacttttacactgttgttgggactgtaaactagttcaaccattgtggaagacagtgtggcgatccctcagggatctagaactagaaataccatttgacccagccatcccattactgggtatatacccaaaggattataaatcatgctgctataaagacacaggcacacgtatgttattgtggcactattcacaatagcaaagacttggaaccaacatcaaactaatatttcacaccttgatttttcatcatgtctacatcccaccttctattacatcacccttattgttttccttctagggctttcctgatggtctaaaaagccctctgaaagaattacataaggaatatggagaaggaggagtaacaatatgagatccaccctgtaattcatcacagcgtcaaatactatgtgagaaagatagctgagaagtacagatgagagacaattacagtaggaagtatgcaatattctgtggtttttgtaagatatcctcatgactcattctatgtctcagagtcaatgtcttcattgtctctacacctcagatttttcccttcaagacacatgtatggacttggtctcagaactcttgtcagtatttcaatttttctcattgaatttcaccatttcaccctttccaggacattcaaatttacacaattctcaaaatctttttttaaaaagaagtcttaatttgctctcatcccctcctgagttatatttctctctttctgtttactttcaaacttgtattaatggagcacattttatacttccattcctttattaattccttgccttctgaaagtcatcttctcttcaaaacttcctacaaaattgctttgttaaatgctaacattcttttttgcaatttactttttgctctttgatttctcttgaaccctttctttttgaaattccttcttctcttagcttttgtatcccagtgctatttgttttggaactactcttctgaattcttatttttccttttcatttctggatcatatttcccctactgtttataaactcaagaggttgagttcttccttttttttttttttttttttttttgagatggagtctcgctctgtcacccagtctggagtgcagtggtgtgatcttggctcactgcaacctcccctcctgggttcaaacgattctcctacctcagcctcccaagtagctgggattacaggtgcccatcaccacatctggttaatttttgtatttttagtagagacgtggtttcaccatgttggccatgctggtcttgatctcctgaccttatgatccacccacctcagcctcccaaagtgctgacattacaggcgtgagtcactgtgcccagccctctttttgttattcatgttgtatactcttttctttttgtgaaagtggaaaaccattttcatggttattccttgtcctactcattaaatgatccaaactgtagccaccgactatactaccacacatttagctatgaaaaatatactgttcacctaggatagcaagattaccaatacttgtagtacaatttaaaaattatggttactgtttgatttaaatccaataaactgattttaagtaactgagagtcagggcctccaatagataacttatttccctatggatttgacaatcatctctattgatattgattctgaaatttattgtatccaggccagacctctctgcttgagctccagactcatctactctctatgtatcagtatatgcctatttaggacaccaggaaggtggctgaactaaggaggcagggcctgtgagatgtaaagcagcatcatgcaactttcttgtgaatagaatataaacatttagcaattacctagccttggggaataatgattttaagtgctgagcttacaattcaaaccagaaaaaagcaaacaatggctataatcaggttatgttgttgaatataaccatgtgtatcagtaatacacaggacagtgagatacctatctacttagctatatgacaactatcaccagaatatcagttactcagcaactgaaacatttttttttttctgtttaaatcttgctttccttcaaggatatattctggcattaattactttttgacagttacccaatcctcccttctctcaataatgaatttatttttcatatatctgcctatgatgctttgtttatatttctgttaatgcagttctctctaatcatagtaagacaggatatattaggtgtttacctgtgcatgctacagctaatttctgatctctatgaattaaagaaatatggactttttccctcctttctcacttcttccctttctcttcaccttcattctttctttttttctttgtatttcccacaatgtctggctcattataggtgctcaatagcttactggtgtttaaacggaatagtttttttttttttaagtaatcagctgacatgttaggcaaccatttcatattaaacattttacatcaatttcattacaactttaagtagttaatttcttaactcataacagaaaacaagatacttccctcccagcttatatcagtattatgttattaataaaatttctatcctatttttccaggcacttttccttctaatagttgctgacaatgagtcatagctacaatgccaccacaggcaggtctcaggggatcattgtccccacaaggcagtgcattaatttcacactgtggttcattaatggtattgtcaatgcccccatggggtatgggtgtttgtgaatccctgatgtttcctgattacttggtttgcactctattccttctccaaaaagtcattcccactatgctgtcaccagcgaaaacactgcctagtggtacatcatgtaaactatgcacatagtcacattctattactttagcattttatattgcacctgttgattttatttataaattgattttccttctgctaggctaaagcatgttaatgattttctgggtataatgtgataagctatgcatggaactttcagatgaatctgtcagttctcattgtcttcaaaactcactaatattccctcagaatattttgaaaagccttatttggaaattagtttaccatataaattaatttatagttggtagtttaaaagtaactctttctgctcttgtgtgaaattcaacatctactttaggtaaatgtaaatttattatataggaaaaaataatttaacagctaaaaatatttgataagtgctaatatgtgtcaagcacatgtccaggtactggcaatatatgataagagataagaagggtgtttacttttatggggcttttgttagagaatttagcagaaaaaacaaatacacacatactcatagatagataatatatttagatagcaatacatgctgaaataaaacagtaaaatgcgatggagtagataataatgctggaggggattgtggcactgcagctagactggtaaggaaattgcattctgagatggcggcatttgaactaagaccaaaaaaattagaagagtcacatggaggtctatgaaaacaatgtcctgggaagaagacacaatgaatgaagaggctttggtgcagaaataagcagtggtatgttctaagaatagaaggaagaacattgcggctggagcataatgtgccaaagggagactagtaagagattactttgaataggtagagaggaacacgatcacatttgatttgtaaatcattttattctaaatatgatatgaaaccattggaatgttttaagcaggggaattatatgattaatctacgcttaaagattattccaggtactctgtggaaaatgtactagagaggatctaaaatgaaattagaggatcaattaggaatctaatatgctaatccaggtaagggatgaagatagcttggaattgagaagtgcaaatgttagcgatatattttgaaggtaaacacaatgtaatttgctgttggattggatgtgcggagttataaatagagaggagcaaagggtgagcttaaggtttttggcttgaagaaggcatggtagaaacataactgaggtggaagtgtctggtgctgaagcaaggtttagaggcatagactccaatatagtttggctctgtgtccccacccaaattgtactcccataattcccacatgttgtgggagagacctggtgggagataatttgaatcatggggcagttcccccgatactgttctagtggtagtgaataagtctcacaagatctgatggttttatcaagggtttctgcttttgtatctgcctcatttttttcttgtggctgccatgtaagaagtgccttttgcctcctgtcatgattctgaggccttgccagccacatggaactgtaagtccaattaaaactctttttcttcccagtttcgggtatgtctttattagcagcatgaaaacagactaattataataaattggtaccaagagtgggatgttactgaaaagatacctgaacatgtggaagcagctttggaactgggtaacaggcaaaagttcgaacagtttggagggctcagaagaagacaagaatatgtaggaaagtttggaacttcctagagacttgctgaatggctttgaccaaaagcctgatagcgatatagacaaataaggtccaggctgaggggttctcagatggagatgaggaacttgttgggaactgaagcaaaggtgactcttgttatgttttagcaaagagactggcagcattttgctcctgccctagagatttgtggaactttgaaattgagagagatgatttagggtatctggcagaagaaatttctaagcagcaaagcattcaaaaggtgacttgggtgctgttaaaagcattcagttttataagggaagcagagtgtaaaggttcaggaaatttgcagcctgacaatgtgatagaaaagaaaaacccattttctaaagagaaattcaagccagctgcagaaatttgcataagtaacaaggagccaaatgttaatccccaagacaatggggaaaatgtctccaaggcatgtcagagatcttcatggcaggccctcccatcacaggcccaggaggcctaggaaaaagtagtttcctgggcctggcccagggtcccagtgctgtgtgcaggctaacgacttggtgtcctgcatcccagccactacagccatgactaaaagtggccaaggtatagcttgggctgtggcttcagagggtgcgacccccaagtcttggcagcttccatgtggtgttgagactgcaggtggacagaagtcaagaattggggtttggaaacctctgtttagatttcagaagatgtatagaaatgcctggatgcccaggcagaagtttgctgcaggattggggtgctcatggagaacctctgctaggacagtgcagaagagaaatttggggttggagcccccacacagaatcctgactggggcaccacctagtggagatgtgagaagaggtcgactgtcctccagaccccagaatggtagatccaccgacagcttgcatcgtctccctgaaaaagcttcagacactcaacactacccgctgaaagcagccaggagggaggctgtaccctgcaaagcaacaggggtggagctgcctaagaccatgggagtccacttcttgcatcagtgtgacctggatgtgagacctggagtcaaaggagatcattttgaacctttaaaatttgactgccctgctggattttggagttgcatcggccctgtaaccactttgttttggacaatttctcccatttggaatggctgtatttacccaatacatgtacccaaattggaaccaggaaataattagcttgattttgattttacaggctcataggtggaagggacttgccttatctcagatgaggctttgaactgtggactttcgggttaatgcttaaatgaattaagactttaggggactgagggaagacacgcttggttttgaaatgtgaaggcataagatttggaggggccaggggcagaatgatatggtttggctctgtgtctccacccaaatctcatcttgaattgtactcccataattcccatgtgttgtgggagggaactagtgggagataatttgaatcaagggggacctttcccccatactgtccttacggtagtgaataagtctcacaaaatctgatggttttatgaggggtttccgcttttgcatcttcctcattttctcttgtggctgccatgtaagaagtgcctttcacctcctgccgtgattctgaggcctccccagtcatgtggaacctccttttcttcccagtctcaggtttgtctttatcagcagcatgaaaacggactaatacagactctcatggcactgaccagattttgcctcctattacagttttaagatttatctatctcctctactaaacccacagagaacagtcacatctgagagttccattcaggctgactagaaatgttatttcctttcccaagccctgactactcccagcatttcatctggcctatatttattcatttggctatttcctccccaaagccttccttcatcctaccccaccatctaaattaggctctggtacaactctagattcacattctctgacagtaggaaaatcattcagaagttcatcataaaaaatatattctggccaggagcagcggctcgcgcctgtaatcccagcactttgagaggctgaggcaggaggatcatgaagtcaggagacagagaccatcctggttaacatggtgaaaccctgtctctactaaaaaaaatacaaaaaattagccgggcatggtggctggtgcctgtagtcccagctactcaggaggctgaggcaggagaatggcatgaacccgggaggcggagcttgcagtgagccgagatcgcttcactgcactccagcctgggcaacagagcgagacttggtctcaaaaacaaacaaacaaacaaaaaatacacacacacacacacacacacacatacatatatatacacacacacacacacatatatattatatatatatatatataatatatatatatatatattctccacatgtgcctacctgatggaggaaaatgaattatacgtgctctgcatctaaacctatttctatatagtttcactaggaaaaatggtaattttcaatactatatatacccccgtatggtgctttatatttacaaaacctctgtcagcaacattatttaattaactcatctgagttctcctgctagttaactatttattagtgttactaaactctatatgagaaaagtaagggtcaagactcttcagacattttaattaagattatgagatagtgatagtactgagaatcaaatttagaactctgttacaattgcaatcttccttccgccctaacacagctttttctgaagtcccaaatatttaattttaaccttgatttaatttttaatcttttgctttccttcactacatgtattcacatacacacattcacaggttttgcatataaatatccatttacattaagaggtcaagaagcttgggcactttggaaaggtcttggacaaagtgaggagagcagtgacaagtgtgattatagtcctgtaaaagtgaagctctataaagatcttccctcagtactggatgtaaatactaaatatttaaactcagaatcagtttaaatagatgtcctgcaggcactaaatagtggataaaatatagtttacattttaacaactagttattatataatctctttcaattttccttaattgtacttaatattaaatcattttattcccactattggggtatcagaggatatttacaactataataagtgcaaatggacaataagaaaactaattttctgatgctttggccctatgaagcccagataagaactgagaaaaatatactgtggatttcagtacaaagctcaatagcatccataaaatattgactaaaagttggaactcttaaattttaataaggcctatttgctttcttaattaaatatagcctaatgaaaagtaattaaggtacatagagagatctggctagaaatttttttactagtcctgagaattttgtttagttatatagacaagttccaaaggaaacaaaatcatccaattatttattcactattgtcaaagacatcaaagatgaacagaatctctcttttatttgctcacaaaattagaaaattatattaattatatatattcatagttgcatagtagggaaataattgtctttggatcagagagacctgggtttgattctagcacctcatcttgttaggcgattagacctggaacagttagttaacctccatgagacatgctttcattagctgcaacatgtgagacaaaagaaccaaatctacatatttattgttatcattaatgttaaaatactaaaagcacccatataaaacggacacgaaatgaaaggggtcattgtaagattaaaaaattaataacgtaatgctcacagaatctagtacagtacctgggaacttgataaatatttgttgaataaataaatactagatactgctaactgtgatactaaataggctactcaatgtttcagtagtttccttcccatttgtaaaaacaaaacatgcctccttatttcattcaacaaatatttaccaaatgcctgctctgtattaggcactgtgttaagctctagctactgggaataagttcaactttcagaaaaattagtaaaacacatccctgaatgaactatttccagacactatgatgggtttggcagcacaaagaacaatatgaccttatagaaagtgttcccagtgtagttttgaggtgtgaagacttcttagagaataactgagatgtataagccatacaaaaatggcagaagaactgaagtgatgaaagtaagttataggtgaaaggaacagtataaatactaagaaagcatggcttattctgggctcgtgtggttttggtgtgaagaacttgtatactgcagataaactggctaattttcttaatttgtcactcatcaacttctttagatgctgatcttagacagtccctaagacactgttgttttccctttcatccggattcagctttagcagatcactttctgatccccagctctgtttttcttctacctgctcagctttaaggtcacgcctatgccttctggtgtctgacgtcagttcatgaccttcactgacttcctacctgtgcactgttcttgccaagaagtcagaggcttggctgtggagcatagcgatacgaataaccagcagacactatctaagactaagccaggggggtataaacaggcctgatctctttattccaaaattaaaagaacattttttttttgttttgtcctttattgaagagatatatttaaagttccttccttatgccagacattgtcataggtactggggaatcaaaataaactgtcctttaggagcttgttctccaactgggtaaataacataaaaccaaatacataacacagcaagggaggcgctgataaaaatctatgaaaatgtctataacacagagatgattcttatctggtagtaaatttttttaaactcagatacataagaatacaactgagcatatataacagaggcatcacagttttattattttctgctttatgattaaatcaactttttttattacagtaatggttttacaatatgagaaacttgctttaccctgaatttcagatatttgattctaacttaattgtccacattttgtttttgaacagaaatccatttgctttttgggagaaaagaaactccatcattatgggaaggcatattataaaccttgaacaaaaaggtaatatcatgaaatagattcattcattaaaataggatattatgcacaactccccagtgatatttttattcatgctgctttattttttaaaaaaaaatgagttctgaaatgaattaattacaatttatttttaaaaatttcctaattcctaaggatcatcataatttggcattgataggtaaataactaaattctgaaaactgctgagagtgcctattttggatttgatgtcacactaggtgtggagatgcctcaaatgaatgacaaggtccctcccctcgaggatttgtcacttcagtcacagacagataaaagctgttctgatgtggtgtgaaaagtgctcttttattataaatcaggttgggttggcagtaagagggggccatacaaggtttcttggccagaggtacaacctgcactgagaattaaaaggaaattctataattgtggaatccacattcaatttcgacttcacctctttattcatctttctgctcagtggttttgtttagctctttagatggaacctaaataggtagagtttggacaagaagcaatttaaaaccagcctatggatcaattttttagtctgatatgtgaagtttgtaaagcacaaagaggctccctgcctttaaggtcttctgtaaataagtttccactgacacttgaagagagggtggaaactaacgttaagcccttcaaattgcagagaatgatgggctgggaagagggctggatgaggagagcagcacaaaaggtggtgtaggaaaggatagtatatttctaataaagttaaatagaggcttaaatcaaacactttttctaccataaccatagttttatttttttcttgatcactggagaaagggtcacatttttacataatttaattattgtatttatccatgtagtcattttcccatatttgtgagaataatgtataaatgtgtcaaaattttggtgtgtggtgtttcaaaaaataatagttactttagccatgtagaataaacttaaagtgaccttcttattaaaagtacaaatcactatgcagccaaagcaattagaaatacggttggatatagcaaagatttcacctacatccatagttttaaccaatatctctttatcattgactgttttatacctcctgatcatacttctcaccttctctttgctatgtctgctctctgccatctgggtattttacagacttcaatctcaacatctactttcattttgtattttctaacactgtgatagatgtgcatccactcatgtatttaagctggaattttagggtttatcctgagttcccacttgtctcttttctatgacttacacgccccaaaaccaggcatttaatcaggattctgttctgttattctatcataaaaatctcttaaacaggagtcttttcctattagacaaggaatacgacaacaatcgacaatctggttctacaataaactttttataatgtaaattttataacatgatcctcccctttgaagcagctccctgtgagcaacaggaaagtccgaaatacttgcttagcatggcctatgggcttcaaaatctggccttagctggtgctcagttctcctaatctgctatacctctctccagagaaatattctgccccagaaacactggaagctgcacaccattttcttttgtttcttgttaatgcctgctaaagtctcaatgttcagctcaaacctcatatcctttatgagattgttctagacccaggatagttagaacctctcttttatcctttcttagctcccttaccttattatagactttatcactaggtactatactaattcattttctgatctgtcattcattgtgggctccttaaaggcagaaacaatgatttgcctatatctgtctttagcaattcctattggattttatacagagtaagtgcccaataaaagcttattgaatgttttaaggcatagatgcattaatggatgaatgagtgagtaaatgaatgaactaggttattattagctacagaatagcttcaaataaagacgaatgctgaatgaacaattccaacccccccacaggcccttatgacatccgaaagtcccatcactgatgttctctgtcacctctagtgagtcacttagtctctcatctgtaaagcttaattagtgcttcagcaataagctcaagctcttaaaatgctaggtgttaaattcattgcttcagaaaaactgtcatgttcatagtcatttggaataaaactgtaagatatgcaacaagactccattttctgttaaaaatgctaggtttcctcatgcctaaaatagacttaatggcagctggctcccagctactcctgaagatgtcacagcttcaaacatgggggtattgccacttctgagactcgaagttccttctcttaatttcagggccaccctccatgcctccatcctggaggcctgcacagggtgggtaatcatagtcaacgtgaggagaaacaaacaggcaattctcctaatgggaacagttaactggctcactgtcagtcagaaggctggcaattttatagcttctccactgtgcctgaatcactgcactgagtggtctactgcagagaggagaaaatggagtttgtatctcctatggttcttaacagactgcagaattaaggaaaatataaatggaaaaaaaaagtttaaagctatacacgaagattacatagcacagaaacaattcaattcaattcaattcaattcaattcaattaaacacatgtgtttttgaggtcctactacctacaaaacactatgttaggtactatgggagaagcacttataaatgggtgagagaaatagttctgagcttctacagtttcatacagagttgtacaattttccactaatataaatgaacatgtataaaggctagtatggaaatacaaagtagtgaggagataggaaagggaaaggtgatttctgactgggggcctgggaaaagcctttcgaggaagcagaacctgggattttgggcagcctctcaaacagtctccctcattcctgtctgattctgaaaatgttgagaaacaaaagatggaggaaaaaaagtattcaccataaataccgatgacactaggctgggagcttagtctaatgtcaaatgggtttgctgaaactgacccctgaaaataggcagacttacccaccgatcacggtactaggagactgggctcacctctccatatggatgggctgcccatgtaagccttagaaccccaggatagctctttctctaaaagaattttcagtccctaaggaaataaggtaaagatgagctgagcctagttactcttctgaaacttacaaaataagtcactcctcctcctctgagaaaagcctagagccacactaattgatctccttctaaggaatgaaatgttaggtgtgggaaaaatacattcctaatgcgtgataggatcttaatggtgagagggaaggaaggacatctcaggctgggtaatagataaatgtgaaatttgtaagcaagtcctgaggagacagaaaaatgtcatgattaagaacactctttttgtagtaaaacagacatggtttaatcttgactcttttttgatctgaataagtcacctaaatgctctggcctggttttctaatctgcaaattggagataatagtacccgtttcatagaactcaataaatagttgcaataatatttaaccaccagcataattgagcatggggatatgctgcataatcagacacttcctttacaaattaattttggaattttaagttttattaaatgatctatttccttttaatttatcagcttggtgagatcaaattcctgtgtattgtgtttttcttgaagtgaactgtaccttttacacaccgttaggtctcctatattgctattttatatcagtacaggaggagagtggtatggattgtggggacaggagagagcagcataggcaggtacaatgaatagcacacaacaaaatgtagaggtgaatgcaaggatgtgacaaagtgtaagtgatgtggtatgaatttaaatgaagactaccaaaggggaatacaggtggaaagaacagcaggcataacttcatttccagctccatccttcttagagaactatttttttttttttaacgagagcatgccaatgagcttgaaaagtgttaaactgaaccaaaaaatgatatctctaattcttcagggtcccagatgcttttaaatgcatgattggacaatcataaaactatcatgaccatataactgaagatgatttaagaatgtactttcttggttatttagagagcaatgttatgggtgtttttcttttattatatagatatgattgcttatgattgcagtatcacattaggttattgattacatggtactctcgggacagattatttctcttgtatatgtatatgctaggatgctaaaggacatctaccacacagataatttttgaagaagatgactacatgaaaaactgagatcttcaaatggaagcatttttaaactcctcagtgaagcatctactctcacatgagctctgaacttaaccatataaaacatggccttgtaccaatttaatgactgatgcaagagagataagttatgcatgtgggtcaaaagctatggaataattgagagggtttattcacagctctctaggtatgacatctgacaaggagagagaaagaaaatagcaaagagcttgcatgtctcttcgtttccatcaaatatattttcagaagcagaccaaaaggagttgtctctgaaatttaataacctctagaaatagttacataacatgtagaaataagtttgttttataatatgcagttcttagatgttgaaaaaaaaagattgcttgatcatttcttaacccagccatcttccaagtatgtacttccattatttatatagtggagctgtcctacttgctttgtaaggcaaaatactgaaattcactaaaaagaacttctcacacaaaggtacatttctactttgtgtgatattacttactgctttgaatggcctcaggtcagtatttttaggaaataactatgacttttttgactaagtcctctagatcccaagtaatttttatctttcccattgccaaagaaacattcatatgagtctaacaagatgacttagattaaattcacttttatatttgaatatttcctggggcttttctataccttccaaatacaatggtcctgaaaggatatttgtaattgagttttcaaggaatcaacacctatttttggtagttgtgttattgaaacgggagtgtagttcccttatccctctcacagggcgtgagacagggtgtggctcgcttcttccatgctctgctgctagaagccctaggggaagcatgcagaagggtaggttgtgtggagcatttatgggctcccaccccatcggcgttgtccagggttgagtgtttgcagcgccagaaacctcagtaggcatgtgttacagtttgctctttcagttttgccctcttcaggcgacttgtgtgaatcagctcaattagaccctctgccttaccacaaagacagaaggctttctgtatcctggattcttgccctagtgtaccagaaaaattgggtcacacttgggcttggaggatagatacaaagttttattagctgtcagtgagatggatggggaggccagaagggggatggagtgggaaggtactcttcccctggagtccgattgcccagcggtagggctctcctcccactgctcctggctgaatttcactgttgatggtctgccagcgtctgctggtttctgtctgtgggtgttctcttctgctcctctccatgtccaactgcttgtgtctgtgcctgctagggtttccggtgttttatgggcacagaatgggggcatggcaggccagagtggtcttgaaaaatgcaacatttgggcacaaaaacaggagtgcctgttatcacttaggtctgtggagcctttgtcagggaccccacccttctctacccagcacttccctgcctccctgcctcccttctgtggttaagaatgacatgtgatttgaacattaaataatcataatgtccaccttggtggggtatgtggtttaagtgaagtggtcatctgtaagataataattgggatttccaagtcagacacacctggattccgacatttgatatttgataatgaagccctgctgggaaaattatgtaacatttctgactctagtttattttttagcagaatgggttttataatgttacctatctcattgaatggttgtaaagattaaatgacatgaagtacgtaaagtgctagcacagtatttggcatgcagtaagccctcaacatgtaatttggtgttattacctttgaataagataaatggaagaaatctttgataacttatcactaaactccaaaaaaagactaaatttcgtgtcaaatgattgtgagattttaaaagaatctttggagaaggtgatgctgtatctctgtgtatgtgattttcctttaaaaattttttctttctaagcctaccagctgcaacttaagcacatatccttttttcaatatttccagattggcacaagagctgatttggcatataatttatgtctcatgtgtatacagtatgtagtgtatataattgctatatatagtattttttataaaatgttcatcatggaattagattctaagtcagcaattctctttcaaacgcagctgcatccaaatgactctttccctggggaaggaaattttttattttcccctaaggtcacacaaagccataaatgtgaagagcagctgacagaaggcagtttttctctgcggcactttttcctgacagtagtgccatgatgacccttgtgtttggttctgtcactaggattgatgcgcttttgtatgggttcccagaggaccatttatgttttgcaattccttccacagattaggatagtgctctgcaagtgctcactcaatactcatttgttaaccaacagtaaaatactacaaatggatacctgtagaagcaatgcaagatcatgttctttatcttccaagtttgtttactacaatgtacaagtgcagccacaaggtacacattataaagatttagtggtttcctagcctcagatccatggactacataaatgccatgtgatatgaaacttacttgaatgaagcagacccacaaaatacatgcacaattgtgactaggaaagtgcttttgtctagacagaggttttataacttttattaatttcctaaaggatgaacaattcaaaaatcagggatcatagcactgacaaaagctctaaagtaatagatttctctttgtatgcaagtgaaatctttaaatatataatcacattttgcctgagaatgctttcatgtttatatcttggcactacttccattcaattgtgctaaccaaaaacccagagagtcatactggacatcttcttgctcatatgtaatccagtatcaagtgctgtcaactttactgactaaattctgttcaaatccatctgcttttctccagctctgctagcacagttaatccatgctatcatcatctttcatcaggaaaacagcaatagactcaaaattctttactgtcattcagactcgtcctctgccaatccattctccacagggtagctagggaaacttttaaaaatgcagatctgattattaactcccctgaataaaaagtggtttcccatttctctcagggtaaagacaaaagtcctgaacatgaccctatatggtcgggccctgcttgtcctgcagattctctttatgccatgctcttgtttggtctctctattccagctagaataaccttctttttattctttatgtgtgtcatgtcctcttctaccaaggcttctcagcatgtattgtttcctctgcctgaaatacttaaaaacattttttctacaaattcactcttagtgcttcttatatgctgcacatattactttagcaaaatcttccatgacttccactattatacaaattcatgaaaccatatgctctgtttcagagaacttgttaccttgctagcacaatgggctcaagaagagagtagttattggctacgtatggattcaatagcatgggatcttattctccagatttgatctagttactgccaccatcaaagggtctgcctagaagtaacagagaccacagctgagtcccctgtgtggcaatatgtttttatttccttgttaataatttgatgaatgtgaatctttccagttagactgcagtctcagtgaagggaagtattcttaatggtcaaattttcaggtcttggcattgctcctggtacagagaagacatccatatgaacagactgaatgaatgaaaaaatggtctccttcattaagcataatatttgtaaaagtagaaattatgaatgtatggtggattgaacaaagtggagaatttacaaccatcttccttgagatcaaatgccctttccatctgctctctagctatatggtctcagattatacaagtggttacaacctatgagtaaggactattgctatttcaaggtacagatggagaaaactgagacttagaaaacgaacaattctgcattagtctcccattccgacaaaacaaaaaacaaaacaaaaaaaaaaaccgagttattctctaagggtcattcttacttacggcctctaagaaatttgggaatgacaatgtgttctatattcacattctttacatgggtcagctgtgaaagtgacttagacttgtaggtagagacagaggctttgaacctaacttttcactacagcattttttaaaaaaagcatatgaatgaaaaactcatcgtggaatcagatcccaagcagggttgagagtttccaaacttctcccatttcctaggccttatctctttcttattatcctttaaaatgtgtgcagtagaagctgtgaggtgccataaagatttctcttcaggaccaaggcagtcattcctttggctgccaggagtgttgattgctgacaactcacagctgagtctctgtctgggcctctccatcatcttcatctaagagcagctaggaagctgccttaccctaggcactcccattccatggggacagcctgcttcgaatgaagggtatatgtacaagtataaaagctgccctcttacttcaaatagagacaactctggagggggcagtagaatttcattataagatgtaaatgtgatacatgtggatcaagcatgagcaagactagtagacactaatttgctgcacgagcagagtgtccaggtctaatgccattcacttaaatattgatttaaatacgttatgtcagcatttctcccagagctgacacctgtggctgcatgagaagtctcctatgactcgatgtcagaggagacaaaaggtaagcttgattcatgaatgagcaagttctgtgtatgtttatagcaaaagagatttgaggatgacactgtgcagttggaggcattctataccatagaccttaggggagtcctgaaagataatggtaacaggaaatcctcccaatggataaaactttagtgaatatctacttcatgagggaagaaaagtggcccaaagtgaataagtatgaattattggacagagttgaatggcttggctgattgattaggaaaggcctgcaaataaaatagataaaaggtaatcaggatcacccagaaagactggggaaaaggtatatatgtgaacctatgggagtggccagggtatgaagatctttgtatttcatgttaaggtttatcagagaccatctagtacacaggaggtatcaaacaaccatttaatattagctatcctctgttatcaggcatcccattgctagcatgatgggctcaagaagagagtagctatgggtgatacatggatctgaaagcatgggatctcattcttcagaattgatatagttactgccactttcaaaactacaacctagaagcaatagagacaacagctgggtccccagtatggcacaactgctcaaggagaccaaccagctatttggtggaatgttgtctgcattgtacttctactttgaaagggcaaataacttattttgactgaaatcaaaagtattttccatgtgaagatttactgttccttttcacagggtctcagctagaaccactatggcagctcatagagtaatctaccaccatggcatcctttataatgttgcacaagacaaagggactcacagaacagccaaggaggtgtgacagtggtgacatgtagatgggacccactggtcctacacatttggcacctaccagaaactgctacacatatacagcaatgggacaggctcttcaaggtacaactgagatactggcttaggtacaatgccctgcacggatggggtgccattttataagatgaaataaacagctttaaccaatacagtgtttctgtgtccctaggaggcagaatacgtttgtgcagcaataagacaattgatatatgagtggtcccacttaaccatcactccaagtgtcccatttgggttttctgtgcttttcatccctacaaatctggattctgtggctccagaggtcctgcttcccaaggagggaatgcttccagcaagggacacagtgagtttcccaataaccttttagatttagctgccactcagccactgtaggcttcttgaatgaagaagtcaacaagcaaggaaagaaaccaccatcttgttagagcagtggggctgcagatccacagtttttaccatgacagggaagagtataatcactggggtgtcttttggtacctccttgccatatcttgacagaaaattgacaagtacagtggtcatggactaagaaggacatggtgatcaggaagtcagacctctcagggatgacattctgggtcacaattagataagcgatcaagacaagcatagtcaagggttcttggaagagtgagggaactttagaatgcaccggagaggataacaatagcaacagctgaggactcaaggtcagcttcagaggtggggcctgtagtttgttccaccaaacttgctttgtatattttccctggaaaagaaaccaaccagaatctttgagcagctatttctagtacagatagttaggtcatgattctgtcttatacattttagggaagtagaagttacagacaaagtcataaatcgatacatggaggttacattggtttggcccaaaaaggtagaacatcttgaagcaggggcttacaggtcataaatgcgttctttaatttgcaattagttacaggagtaaaacttttctaaaaacttggagtgagaataaaggaatgtttaggttaagacaaggaaggctgttaaccaatgtactgggtcagcgtgacctgtagggttacatgacttaactcttgtctggcatacttaggtaatgtttataatttgatatcttattatcaaaaagagtgtcttttgttagtctcatgatctctattctaacattaatgctggccagttgttgtgtctaaagtccaaaaaggaagggataaaatgagtcatatttgacctcccttcctattatggtagggaattcagttttaaggttgtctgctgtcccgttagccaagggggcattaattcagtctgttggttgggggttaggatttcatttttagtttacacactatctagttactatgaagtaactatatctaccatatagcctgtggtagatagatacaaggaatctgccttatctgaggtattccccatccatggcagcaatcttccaatacagaggtacaaaaaggaataaatacctcaaactgggcctaccctgaaaggttatccagctcaagagtttcaaatggtcagtgaaagatctctgttgcaactgcctcacagtgcagcttctctttctgtccagtcctgcttcgctcagctctcacaggtgtcaccaaaattactatccaataaaacccctatatttgttgtgatcccaaaaagaaattcagctactcctaaatgtttggtgtttacttggctttctgggaaggtaacatgtagttgacagtaatatgaaagatattttagggccatttcatatgatcacaatcatatgatccattgaagactcattgataaggtgttatggactgaaatgtgactgcccaaaattcatatgttgaagcccaacctccaggaccttagaatgtaatcatatatggagataagtatataaagaggtgattaagttgaaatgaggctgtttttgtgtggtcataatccaatgtaactgatgtcattataagaggagaaatatacaccaggggcaccatgcacagagggacagccacatgagtaggcagcttgaggtcaaccatctgtaggtcaatgggagaggcctcagaggaaactaaccctgctaaccaacttgatcatagacttctagccttcagaactatggaaaaataaatttatgttgtttaagccattcgatcggtgatattctgttaggtcagcctagcaaactaatacctaagcatgctttaaattgggggatataatatcttgtttgacttaattagcaaatattttctcaacatgggcaatccaaaatgaagaatccagtctaaaatgttgttgtatataaactctaaagcattggtagatgtctgtaacctggagaaagcgctgggtcctctccccagataacccctttctgtcccatgttgtaaaccctctacacctccatggaataatcaagatcactaagacaaatatttaaagaaagaataattctcttttcaatcacaatagttcctatttattttactatactctaaagaataataattgcaatcttttgcaaagaaacttgtcacattgggatagtactggacacctgagggatggtatgtagacatctcatgttaccttaaaacactttgtccccaatctgtgatcacagtgggactatgggtcaaaccaaacctagttcaattaggggtttttagtttgaaacaaaaggttgggcaaatgacaagcaatatgggttgggtctgtgtcctcagccaaatctcaccttgaattgtagttctcataatctccacatgtcatgagagggacccggtgggaggtaattgaatcataggggcggttaccctcacgatattcttgtgataatcagtatctacccctaccaactcctaattgtgtggtttctcacatcctggctttttgctgtcatcagtgtgaagtgggaaggatcaaactataatcattaaaataataatacaataaatgcagtacgacaatacaaggtctaacttttataagcactgacaatatgctaaggtcctaataaattcatgtgcctcaacctcatcaacccttccaatacctggaatatacctatcttagtcagtttgggctgctttgccaaaataccagcgactgggttttttcaacaacaaacattaatttctcatagtactggaggctagggagtccacagttaaggccctagtagcttcagtgtttggtgagggcctgcttcctggtttactgtcctctcactatatcttcagatggcccttttgtggtgcatgcatatggaagaaaagagatgtcttgtctctttctctttctataagggcattaatctcattataaggtcccactttcactacataatctaatcctctttatcttccaaaagcccacctccaaataccatcacattggggcttagggtgtcaatatatgaatttgagggaaacagaaacaataatccatagcagtacctattttaagaaaactaatgctaaaagcagtgaaggaccttgccccaagttaggtggtaagaaacagggcctgattttaaaaccagaacttactctccattgagaccacactcttacacacagagcatcagtaaaagtcatgtctacatagaacaccaaacctaggatgagaaccactgataattcctctgccaaagaaactcaaagccatttctgccagaaaaataagcccagcatataagaggaactgcacattttgaacattattttctcatctctgagactgttcagccagatttaatggaccaaggagaaaaagcagatgagtaactgcttgacccttttgccctctccatgcctgcctttcttccatctatctagaccttaaataaaacatgggactagtctatttgcaaagtgctgtccttggtgctgaggatggaaaatgaacaaattaggcacagccctttgctttcatggaggatttttttttcttcctcttcttcgctctatactttttctgttctctcctaactaccatttccccattcaccctggaaggaagctagtttttcctatgataattagccttgtcttcccttggtctgtgaaatgaatgcatggtctcacttcatattgtttgcataaactctccctctacctcttttcctttattttgtaattttcctttcatctcttattttatctcaccatctctagcatcagcataaacataacatatgattgtatatcaaatgttcaagaggttctaatcttgttacaagtgtgtaagaaactacatatgttataggtaagacagttaacacaataattacccatatcataaaagaagcagaatatctgagactcactttctactctgtccagtgtggggttggatgagatcaatgggggttcttcagcctggaagcacattagaatcacctgacgagcttgaagactcagcagtgcttgagctgcactcccagggacccttactcaattgacaaagtgtgagtactcaggattggtattttgaaaaatctccccaagagattttaatggcagccaggctgcagaaccactggacttgaccattcctttaggtattttctggctttaggattcagtcacctctaaatgtatcttttaaaaacagatgctagaagtatcactgttttgaaggcccacatttcatccccacaccttattttggttaattagcttttgtggtgaggatgcactatagcatggtgaaggtgaaggttttgacatggagttaggtggtgctgcataaaatgtttcctgagtagagcagggttttttgtttgtttttttttctcctaccttgctgccattcatcatcgactgcaacatcttttctctctgctttctgctaatctcatatatattccatcttccacacacttgccaagaatgattaatctctaaaaaatccaatctgatcttatctctcctctatgtttctctccccttcaataattatttcccttaggatcaaatgcaaacttcttgggtatgtcacccaagaatctgtctccatctctcaacttatgacattcaaaatacatatatcaaacttattaaaccaatctattaaagcacttactatgtatcacacactttttagagtgcttaaatgtattaatttactgaagcctcaccacaaccctaagtgttagattatcactattctccattgtaccaatgaagaaactaagactcacagagattcactaacttcccaatggcacacagctagaatttcatagtcttgggattcaaaatctgacattcttttcccaaatcctgtgcttcttgatgagtatgtgttaatacctgccttacataacccatcaaagttcacttgttttccttctattttgaatgtttatcttccatcagatcttcgagtactgatcaatatctgtgatctttgaaggtccagttgtgttaccattcccagaagcagtccctaagccctcacccttcctcactcaagatttagggcttcttctctactatccaggcacattgtttcaacatctgtgttctggcatttattgcactatattgtaattttctattaaagtatctcccttaaagcagagtaaaatccagtctgtgaaatccttgaaggcagcaaatatatcttttatctctgtattactatcctccaccacattgaagagtgaagtccccaatatgaaatgttcttttagtaatattgcgatacaatttatcatctaacccaggaaattttggaaggtgctattaataattttcctgtgatgataggtatgaacctggatggatggtcaccttatttttaaaactgctttctaaggtgatttttctaatgccttatctaccaaatcctcccagaaataatacagaaaatgttctgcctttaagtatttttttattttgtgagtcagattgtacaaattctccaagatatgaatgcttataattcctcaacatctacacctttgcttgtagcttagtgtaagaattagtaattgaatggaatcagtatcttgttaaaggaggtggtacttagttaaaatgacaaatgaatggtgtttttgagggaaagttcttgaagttgacgatcttatatttaagtttattgctgattgacatgtacacatattgcaatgtttgaggatcagtgaagtagaaccttctttctgtgtcttatttctgctggaagtgctccaaggaatgattctgcatcgctctgcacaactcatttctgagtccctccaggagaacacttgtggatgatcagattgatcctggcttagtgattaagagtgtggtattggtacttgagtgtatggggttcactcctcccattagctgtgtgatcttggatggattacttaactgtgcttcagtttctttatctgtaaaatattacagtagctatcacatatagaattttgtgcattaagttaatatctaaaaatacttaggtcagtgcctgggatttggtaggttctatataagtatatcctaattaaataaatggatagtgtcactgtaaacataaaggcattcttctcttttccacccacatgaggggagatagagatgtcttcctatgcataactactccacttctctcatatatgacacctgtccatatatttttctctgcatctggctgagtgtgttggtcatcacttcaagtttctatgccacagggcctccagcagataatataattttgaggtttaaatcatctagaaataatttaaagtagacaggaggatgtgtgtaggttatatgcaaatggtacaccattttatatgaggggcttgagcatctgtggattttggtatctgtaggaatcctggaaccattcctctgtagataccaagggatgactgtggccagctaatgaaaagtgttactttccatctaatatataagttctttaggattatttggagagaaaggacatttagcagtacaagatttgaaaattctttgcgcctttaactaatctcatattatatcattaaaaccatatgcttttattgactgaagagcattaagtagtgatagatcaaagaaagatcaggtagcctacaaacttataattactctgttaccatcactggaaggcatttctgattttccagattatggtctttcttttatcaccttcatggattttaccttatttgagaaccacctgcactacaattttcctcagttttctttatattccatatttgaaaacttaaatatgtttaaagaaaacactatgtcactactataaatgtaggagcaaaattgccatttagcttatcataaatagaagatagcctaaaaataaatatgatgacaagaaaagagtgattaagcagatactcctgcttgccaacatgttgagtcccaggttcgctccccttttattgcaaaaatactttagcacatttttgtaagtaaatgtgtcccagcaccaaagggagactgtcttctagagttgatctaaaaggctgaatgaaacagggaataattttttcagcatgagattcagtggtatttagtgctttttcttttcataaatctcttgtagacatctcacattttgggaaatattgagaggaataggaaagaagcaaagcaacataatataaagactaaagactttgaggtatgagtattgttttcgaattgtgtctctgtcacttaacatgtagtttgatcttacaaagtattttccttttctgagattgtttccatctccaaacattgaagaccacatctacagcagggatttagtgacaatcacattagacaatgtatgtaaaagttcctcccacactaagcctcaaacattcagggtttagtaaataatttactttttctaaatttatttaaaatttatataggaaaattagctttttctatatccagctcccaagattttaggagtagtaaagacttgctttcctaattctatattggatcatatctgaatactctagagataccacctggttcatcacccataatatctcttttgctaattggaaaaaaattcctaggagcctaatacgaaccagacattgtggtaggaactaagttacagaagtgagtgattaaacacttgtcggcaaaaggtctaatggcagaaggaagtaaacagaaaattataataccatatttaatcagttctggttagcccatttttttttcatattttcacatttatgtgaaatgtgccttatatttgatgccatcttgtaaagatgaaaatggtaagtactattttggagagaagtccctggacttctggtgctcttggcagggcaggagaaagtagccctcagaaaaagcactccaaaggaggagttgcttagtgatatggaccaagggaggaggaaattggcaagaaagggagtggcatgtgcaaagacatagccatgtaagggatcatgttcagggcccatgaagcattctgtgcagcagcagcatgaggggagaatgaggggatggaccatgaggctaaaaggtgagttataggtcagatcatggagagccagggtaagggatctggacttttttctgaagaataagaaatcctttaagcaaggatctgggatgacttgatttgcaatatccatagatttcactgggtcactggcatggaagaaagtaggcaactacactgaggagcaaaatgaggaagagacttatcagaaatcaaaatccaacccacctctctgaagtgaactaatcaaggaaatgctctggagaggaggtcacctcagtgtcatcctgaggggtcagagcaggagccagcatgctctagacatgaatctgtggcactgggtggctgggctgtttgcctggactcaccctaagtcaacagaggctgtatttccatcaccatttccgggcaagcttgtgcttctggcatcatctccatgtgccctgggggcaaatttagctgagttttgaatgtgtgaatgccccattatatctgagtgtctgaaaatctctctcttcacaaacatgcactgaacaaacagaatctgttctcaataggaaacaactgtgccactggagttggcaggaggaagttggaaagaaagcaagtcacagctctgctgcctaccaagctgcctcttccagcttcctgttgaaggcccctttggttctctctccacaaaccagagggaaaatgctgggtattcgcattcacaacttcaattgtttcaaattaaactcccccaggagccgaattacctgagctaatgtatctcattattgtgcctcagtgcaatctaagaggtttcagataagatttcctgaagatagccattattccttcatctgttcaaaaataaggcacttgcaaaattgcaatcatgttcaccacagaaagtgttgctttgtttggtttcataaaagtagtgggtagaaagaacatattgacaacaaaatagaaaaagaaaggtctagaaaaaaatagtctccaccacatccgttaaatattttattgaagccccttgtatttttagggcctgacagaaaacctttgttgagcagcatgcagaacagtgttgcctgggcctgcctcgctagggagagcccaagaggcatgaattcaagcagacctgggattaaatcatggtactgtcacttactaattaagtttttctttttaagcaagtcacttaagttactcagaactcagctttccactcccacagaatatgtgttaggaaaatataatatgctactataaactgctccataataataggactctaaaggataaaaattgttcaagaaaaatttgaagaaggcagtctctggcttttaattctgcgaattaacttgaaaaatattgagatctattatatgtggcaggtaggtttgttgagtgtgtgtgtgcatgcatgcgtgtttgttggggtgaggggagcagtgagattgagaaggtgcattgcaggtagaagaaacaggatacgtaaaatctctacaaaaagaaggtgcatccaagtttgaggatttaaaaaggctcatgtgacagtaatgctgaaaaatgaattagaaaaattagactatacagggtgagttgggaccaggaatgctcatcatttagtgctttataaaactggtatttatctcattccctggagggaatagatgggacactcaggttaaaacaatttagggaaatttgaggaagataaataaagggactgtttataaaggtgtcagcaaggtgcaatgaaatcactagtgatagtgcaccattggggcctacttaccagacctaaaacaaagggataatgggagggagcaatggccttgaagagacccagggatacgaaagtttgaatgaagaagggctctgacagcagagtttgtgaaaggaacacagacagccctacaggaaggaaactcaacaaagccataaatattctgacctcacttgccttcctctgtctatcctcttgctggtaccttccactgactgaattctaccgcagccaaaggcaaaagagcctactgatgccatgatccacttgtgtcagctcccaaggcactagccagggcaaggaaaaagggagagtgggtctggaggaacaaatgaaagggacattctttctaaaggaatatgtctaatcaaatggcaaagagaagcttctagcctcaaaatcctttgccttctagcacccatggttctcatgctgacaggtacttctccactctgattgcttgagttgatggcctgtactaagcacttgttggctaagtaaccataaacaagtcatatcatctctcagtttcttcatctataaaatatgaataacaatagtaattttgattgggattattgaaaggataaatgcaataatacattgaaaacatgtaaaacagtgtctgacaaatagtaggcactacaaaaatgcttcctctcctgactcagattattgacatttcaaagaataaggaacaaaagtttagagacttttccaaaaacatcatataactagccaatgtgagaactcagagagagagacagagagagagagaaagagattccacttcaaaatagcaagtctaataatggtaatctacactctccctgaccactctcctacactgtgaattcctttaaggcaagcattatgtctcgttcattttgcatctcaggaacccattacgcacaagagttttttctcagacagtgtttgatgaatgagtatataaagcacagtgacagaaggtatagaagtaattactggaggacagaggagaactttccttgcaagtcgaaaatccttctctcttgtcttgtataactaattctataaataacaagatataacttggctttttcaacaaggtactgagattcagtaatatattgtaaaaaattaacatattgtatgattactctgaggtccattatttttgttgaatatttgaatcaccatttctgaagtagccccgtctccaggacatcccatatatgtcctacaagcagagatgatctatatcttgtaggagcatgttagagccaacattctctgcagtctagggtgtttgttatggtttggtagagaaatgatgtcttatttaacatatgtttttagtggtctcattggagttttatttatttcatcttgcactgaaagtatgacgacagcctggggcttctctgtgaaattgagtctgaaagtgtattaccaaggtgatcatcttaacatcttacttgcatggaaataaggtaggattcttaaattatagtagaggcaactcagtcatcttagggttaaaatggtcttataatgaatactgttcgtagtttgatgcccataaaaccacacagaaaatagactaggagtcaggagacacgggccatgtcattgatagtcagacagttgtttcctaaacattgaatagttgtcagtttggcttcatgtgaattcagagtaataacttgccttgccaccatctcagcaatgacattagaatcagatgcaattttatctgtgaacatgctgtgaataatataaagaataatgtaaagccaaagttattattcttctgtttactgtatttgacaaatatacattctttttcctatgtggtatctttgatattcagtgaggtttgtttcttccgtttggtcaaggcctggggctatgacaagtgtaggtaggctccagtttacaaaaaggaataactgccttctattcccttctagatttgggtagatattagtaggtttatggcaaaattttggaatattcacagcttgcaattgtataccagaaagcatactgctatattgtgcctcttagtcacagtgaacatttagtttaaaaaaacaaatatttattaatcacttattaaaagtcaggtgctgcattagctaaggggtctctaaataaaattaataaaatttgctgtttcctagggatgttcatggcttattacggtgcagtgcagatatagagtaagaactttgggtagataacctgatgtctctccatacctccatttccatcatgtgtaaaatatggataattatatctaccacttaatgtttctatgaagatgaaacaagtttggtcattataaagctttaatacattgtatgtcatgtaataggtgctgaactaatgctgacgagttgtttattattaggaaggacacacaaagaaacagatctctctatatctgctacatagtgacagacagaaatgatgctgttatatgaagaatatttacccatcttcttttactctcccagggtggaggcatgttttcttgtacactcaaatattagaatgtcacagacatgaatatgatgttgcagaaatcatagaaagaaaaacaacattttttctccagtgggaaatacatgtgtttctgttggtccctgccagcatatacaggtactctctgatgaagggacattttaggagacttaaattcatttgggggcctaaatgattaaaatgctacaaaagaaaaaaatattccaattatctctaggaatttcccaaaattttgattgttcttcatgaaattaagaagaaattgaaagcaaatttctttcaattgctttcaattgaaagcaaaatatatttcaaggactatgcagaaacaagattgacactttgtaaaattttaagatttatgaatcttatgggctataattaacttatcaagaatctttttgagttcaaataggtggatgtttttctgtgcaaagaacatagattttagctttcatatctttcaattctaatttgatatatactttaggattttgttttgttgtttcagttaaccagtgacaaagtggcatagagaataacttttggagaaacttagaaggtggggaagtcacaacaggctacagtaggctgtggttttctttctaaaggatacaggccatgtactgggtttttagggcccattaaggcagtggtaggtgaaaggggaggggtaggaaggtttctcagtgagcagtaaaggcatccctgatgtcaggcatgcataaaggtggtgggtagagggatcagcagacaggccagctgcaaaatgtgacatctacatccatctttgggaaagcattgtgttcattcatggtaaaaatgggggaaaattattgtggtagagacattgttaaaaaagtgatggaaacctaaagcatatatcatagtttacatgtataaccatatagtattacaaatctggacagtcctccaaatccctataatctcttctttgagatgtagttgcagtttgattatttcctagatggtaatgaatttgcctctgctgcttgcaagtgcatttacagtcacttcataaagcccttaaacacacttgtgaaggagcttcatgctcatcagaattagtctggactcatgtttcctgtgatgcatattgacttcatctgtagtacagctgcatctacaactctgtgaagatgcaaactgctagttcttcctgaggacaagtcaacgtgaaaaatcccaaatgagactgtaagttccactagcactgcatgaaaaatcagagcctagatacaggccaaagacctgttttggaccctaacctctgactgagttttcttcagaattagaatatattttcaaaagggacatagaattattttcacaaagatattttggggtctgtacatcacttgatgaaaatgaaagatggggaagggaattaacatttattgaacgactgcaaatatacaaggcttgtatgtatatttcgccttcataaaaatcctctgaaatagacataattatgccttgtaaataaaagcattactagggcagtggttgttgtcagtgcttaaaatagtacctgttacatactataatagatgctcaattagtatttgtgaaaaagagtaattgaattgaatcttgtagctgaagaaatagtagtaaagaaaagttaagtacttttcttaggaacgacctgcagagagactttgggctaaggcatggtgcatgtgggaagtgagaaaactcagattgggatgcaggtctatctgactgcaagacatatgattcttcaactatattttaatatccctccctgatggcattttttcatgaaaaaaaaaactatataattctcaataaggtggatgttactgatttctaagttatctatgaagcaggcagagctgctgacctccctggattattctacaacgaaatcctcccctcctgatcagtagaatagagatagattttacacgaatctttgtcagctgcctcaaatccttttttaggaacaaggatgagaaaacataatcacacaaataagtaatgctgacggtgtactgtgatttcattttcatttcaacaggtatttactgtgtgccaactatgttttcctgctttgggtatgcagtattagaaaaggaagatatagtggagaaaagatacaattcctgcctgaatttgctcagttttattttcggtggaaagaagaatccaatcagtgcttttaaaacctggttgtatataagaataacccatggtgtttgctgaaagaaccgaattagactatctgggtttgggtctgggaatttctatttttatcaagagccccagatcattctgatgcacagccacatttaggaaacactgaattagatgcaagctagaatcccttccagcttttgaattctatgactttctatcattacagaactttctcacaaaaatagggagaaaaaagaaatgtatgtttctgccaacagagcattaaggcaaaaaaaggatgagagtttgtaaggcagagattttgttctgtaaggtcaagggcagcttgggccagcaccagcccaaattctaaatggttcaggccagatgtagattccctaggtacttgataggaaagagcatggattatgttggaggggtagtgaaaagtacaaaagagtaggccaggaaggtttaaatgagtgcatttagcatagtgtattgcacatagtgaactgtcagtgaatttttgcttaagcgatgattattattagggtggtgggtgggtgattaggctgagcattgagataggaaagcacccacatttgatcagcagttagaaaggagattgaattggccccaatgaggaatacccaaaggaggttttaaataagacaaatgaagctgcattccctcggcattctatgtagtgtgtgggtgatttgtattgactgcttaatgctttcagagtgctagtcaacaatgttaagatacaaatataataaaagaaatcaggagaggcttagtatttcttgagcacccacactgtaccaaatactgtaaagtggcttgcatgttaaaccatttaatgcttaaatttacccactgaggcaggtgacattagtctcattttccagtagggaaactgagactcagttatatttaacccatggttatgtgaaagccatggtctaaacttcaggctgagttgagaagtacttaccattctcttttaactgtcacttagaaaaatcaccatgatggtttttattctagcatatgccttagtgaccataaattcactcattttttctaaggcccagaatgccccactgttttatttggtttgctttgcactttagttcaggtgtggctaactcaagggacttaaactaattatgaagaataagccagccctgttgcttgtacttccaatggcttttctcttagtaagatagtaaattatcatgtatgtctataccttattagcaaagctaaggaatgcaactgttttccttctttagaaaaaagaaactcagtacaaaatcaccttctctagacaaagccacttaaataggaatcagttctcttcattacagataatcaatataatggccattgagaattacatgctttaaaaaaagccatttattagtctttgtgtaggctagggttgttttataaacactaaaacataggcaaacagttgttaatgttttattatagataaatgacatttgttaatcgtgttaatgatcatagtggctaacattatttattgaatggttattgtatctaagcattaggcttttgaaatgctttccatattttatttgaatttcataaaaaccctatatactagatctcttttgatctccattttactgatgaagaaattaaattttacaaagattgaattcctttaaataccctgctagtaaatttaatgcaaggcctaatttggtttaactcttcagcccatcttttgaaacacatcactgaattagctctaagtaaataaatcttttcatatagcaaaatatcgttctacaactatgtaattatgtttctgaataatatttaaaggcatgagaaaatgtccatagcacaagagtaagggtgtatgacacatatcaaggaaatgtatatatacatttaggaaaatacttcaaggaaatacattgaaacattcacatttttcactaaatggttgaattatatgtgtactcttgtgttctgctcaaaacatctctgttttcatattttctataataactatttatagttagaaggataattacgtattaataattaaaatagaatctattaatgtagtaggattataaggaaatacatcaaaataatgagaaggttttatttaggcaacagactatgaaaatgcaaaaatataattcttttgcttataattttgacaggctcatcatagaaaatattttaaaaattgaaatggctgagttaccatacaagatcctttgtagtctagcccctggctacctttccagaattaattcttaaaactctctgtaagataaattctacttcctgattttaccatatcacttgaaggtactatactctttcacaagtcaatgcctatatatgtgattccatttgcctgcaatcacaaaactgtaatgtttttgagagcaaaggtcatatcatcttaactctggcatccaattttcctaacacagtacttacaatacagtaagccttttaaaatgtatatttgtagagcaaatacgtgatcttctttcacctgttcctccctctattttcagtttaacaaagtgattagatgatccaggctttagagacagtggaattaaaagagtggtgtataacattcacatttactctatgctttctgtttcaaagttttacagtgcaaatgtattcatatattacttatataatttaaaatcaaaagaggaggaaacatattttattaaaatgttctctacagaaaagttgagatattattattaggcattgtcatcttttaatcctttgttcaaagactgcctcttttctaaagcctccctgaattcctcataggctcagttcacttctctatcttcctagtttccattttgattttgcttctatacctacacattctgcatgaaatttttctataattttctataatgtgagtgaaagcacagagtctaaatcacctttatagactaaaggcttaactcatagtatatattggctaacaactgaacatgcacgtggaatcctttctcaaagaagtcacagattctgtaaaagacttcactgagaaattgacttttgattaaatgtttgttttgtcttctccttgttattctcagtgaagcatgtttggccaccctatctaaaattgcctcatgctatcccttgtcaaacaaacactattccccttccctcttatatttttctccttaacatttattatcatctgacatacttttttttttaactttagtttaagttcaggggtacaagtgcaggtttgttacataaacttgtgtcgtggggatttgttgtatagattatttcatcacccagatattaagcctgatacccattagttatttttactaaccctctacctccttttaccctccaccctctgaaacacccagtgtatgttgttcccttccctgtgtccctgtattctcatcgtttagctcccatttataagtgagaacatgcagtgtttggttttctgttcctgtgtctgctgaggataatggcctccagctccacccatgtccctgcaaaggacacagtctcatccttttttatggctggatataattacatggtgtatatgtatcacattttcttcatccagtctatcatgatgggcatttaggttgattccatgtcttttctattgctaatagggctgcaatgaacacacatgtgcatgtgtctttataacagaataatttacatattttggggtatatacccagtaatgggattgctgcatcaaatggtatttctgtctttaggtctttgaggaattgccacactgagttccacaagggctgaactaataatttacactcccaccaacagtgtataagggttcccttttctcccaaacctcatcaacatctattggctcttgactttaataataaccattctgactggcatgagatggtatctcattgtggttttgatttgcatttctctaatgatcagtgatgttgggcattttatcatataattgttggctgcatgcatgtcttcttttgaaaaatgcctgttcatgtcctttgcccactttttaatagggttgtttgtcttttccttgtacatttgtttaggttccttatagatactgggtattagacctttgtcagatacatagtttgcaaaaatgttctcccattctgtagcttgtctgtttactctgttaatagtgtcttttgttttgtagaaactctttattgcttgactctcttccctaaaatataaaagtcccgtgaagacagaacctggcatttaggaggtatccaattgatagttgttgaacaaatccatgtcacgtacaaaatcacagagatatgcatggaagacaggaaaaatggaaggtctctactatacaccatctaagcccttttttgaatattgttttgacaataaatgagtggctgtgaacttttaagataatacactggaaaaagctttgaggggaaagtgtttatacctatgactgagtgcagatatgttttcccttgcagacaattaagtgaaggtggaagtaagcatcattttattacatataaataatctgctaagaggccactctcagcctctggtacaaggtaacttgagataggagttgcctgcgagccagccttttaccttaaaatcctgttcaggatcctgccattcataccaactgggtgaataaggctatgaagtttcaccccacaaatcatagtcaaaacagttttagctgaaaacactcaatgcagaaaaaaacagctactggccacttttttttctctgtaatagggagacatattcagcttatccaaaatgaacacattttagaaaaagttaaaaataatattggagagcgtccttctgtctaatctccattaaaattgttatgtgccctgtgcaaaagccatttatatggacagactcacacaggtttgcaggaaaatcattactctgtgtgtgtgtgtgtgtgtgtgtgcgtgtgtgtgtgtgtgtgtgtgtgcctgtattgaatttatactgcttggcacaaaaccagtctctatcaagagcaacaaaatccagtaaggttcacaatatctcagatgtgttttttcataatttaaaaataaatacacagtggttaatgtgggatagccatcacgtagcatttctatatgtggcttcaaatcctggctctaccactttaccacttgtgtgattttaagtacattctttaaccttcctgaaatttattctccttaggtgcaaaaatatggtaatcacacaaccttaaaataggattcttagggagattacatgagcgaatacatgtaaaaacatttagcaccacgatggtgatacaaagcacactcaacaatcgttggctataacagtgaatattttcatcatgaaaagagcaactaatttttctcctttctagaaattcaatcttttttggtgggagtgcaaggttgagaaaggtcccgggaagagttcgcatcttgtcattaaagccacccctgcatcattggaatatttgaactaagaatgcactatttcatattttattgattctattaactgaagaatatagcactgcaaactgtacaaaagttagaccactcttcttaatttctaatgtttaccaagtatctggtggttacaaaaacacagtctaatattacagtttatagcattatctttcataagtgactttaatcatacatgcttatactgttaatataaatgttaataattattccaaacaagaataaacatctccagattcatactgttacaaatgcacatccataacttgattttgtgccatttgggtaagtctccatcttgtcactgatggttggaaataagtgaaaaacatcctatctatgaactcactttcagtaatgaagtttttatgcctctcagtaatgaagtttttatgcctccaaggtgaatatagataagaacatcctcttttactgaaatcatcaaatatgtgaaaagaaattgacaaaggaaaagacagcttttgttctccacagtactggatgcaaatgtgaaagactgttcacttttatgaagatatacctcattacttcttaatttctttccagaaaaacagactggggatgtaaggtgtgactaaatgactagtgatatctaattttcacaagctgaacacatggcccgacactgggtatttggtcaattcacatttctaaattaattagcaaagcagtgagaaggaaatatcaaataatggaatattctcttggttcacatttggtcaaaatttcattgcctggctgagaattactaacaattaacacctgtgcatttagcctgcaaccatatttggcattatgtttggttttagcctttactggagggtggaatagcagaattatactgttaaaccactcctctaaaactgtggaaaaatgagttggtatcactgtaaggatgccctgatgacctggtgtgaaatctgcctccaaccatttgtagcttctcagggaatctgctgagctttctgacacaactccaacctgcctcagggcccttgctgtgactgcgttttcaacacttctccaagtgttgagcagagggagaactcggaagtgagaggaattactttatggtaacttttgtacatttcagaagccataacatgcagaaatctcagtgcagctgctctacttcctagatctctcagatttgtccaggagggactggcacaatcaatctttatatactaagacaagggagatacctggacaaaaagctagacatatactattgtttactgtataacaaaatggtctgttttgtttggattttccagcaattcatggctatgctataatttctttaataagtagattttaatttttagcatagttttatgtttataaagataataatgcagaaaacacagatttcccatataccgcctcatccccagtttcccctaatattaacatcttgtattattgtagaatagttgttacaattgatgaatcaatattgatacattattattgactgaagtctatagtttactttagggttcactctgtgttgtacatgctatggcttttgacaaatttataatgacatgtatccaccattatagcctcatacacaataaaatttcaggccctaaaaatcccctgtgccctgcccattcatccttcttctcctgctccctcctcccttgaaacccgtcaaccactaatatttttactgtttccatagtttttctttattcagaatgtcatatattaagaataatacagtatgtagtcttttcagattggctttttttttttctcatagcaatatgctctcaaggctcctccatgatttttcatagcttgatagctcatttcttttcatcactgactactattctattgtatgaatgtgccacagtttataccattcacccactgaaggacatcttggttgcttccaagttttggcaattatgaataaattcatgaatacatatttatgtgtaggtttttgtgtgggcataagttttcagctcaactggcaaaatgcaaaggggcatgattgcttgatagtatggtaagagtatgttttgttatgtaggaaactgtttgttcgtttgtattccaaagtggctatgccatttcgaattcccacaagcaatcaataagacttcctgttgctccatgctttttttcttgcttgtctctcaaacaaatggttgttactatggaagaggtcattaagctacatgagttctacaaaagatgtgggaaacctctgaacactcaagcaactagataacaacttttcactgtggaacattccttccccttatcattgaggttttaaacagcagtgtcaacctttgtgtactcactccatcactcttcatagctcctagcatgatccttatcttagccaggcatcaggaccctctaacctcatgcttactcttgtagcatcacttcaggctctttgttcacttggcagccaggatgccctttttatttatttattccttacttcttaaatcttgtttcattttagattcagggagtacatgtgcatgttgctatatgggcatattatgtactgctggggattgggcttctatttggatatccattacctaaatagtgaacattatactcaataggtactgagaatgcccttttaaaaatgaaaatccaaatttaaactctcttaggagatagttcaaatccttaatataatctatgaggacttacatgtgctcgtagctacctattcctccagatccatctttgaccattttctttcctgcttagtttaactcatctctattggctgccttctcattccacatgagtgttgttactaatctgccactgagcctaagcacataccatccctgatagtggaaaggtatcttctttcctacccaatcttcacctgttaaaatcatattctttcttcaggtctcctctgcactgaccttttctcaggaggccgtcggtccctgccactctgcttacactgtgtcctaaagttacttgcttcccaatactccatatacttactcctaactaactgccctccatggtgttattgcacagttcttaacttgatatttatcttcttctctagatagtatgttttgtgatggtagggttgcatctattttactcactagtttattctttggaccagtaatagtgatggggcattgtaatatattaataagtacttacttactgcatgaatggatggataataacaaacataggtggctggcaagatggccaaatacaaacagctccagtctgcagctcccagtgagatcaatgcaggtgggtgatttctgcatttccagctgaggtaccttgctcttctcactgggactggttagacagtaggtgcagcccatggagggtgagctgaagcagggtggggcatcacttcttccgggaagtacaaggggttggggaactccttcccctagccaagggaggctagggctgtgctgtaagaaacggtggattctggcccagatactatgcttttgacaaagtcttcacaacccgcagaccagagattccctcaggtgcctatgccaccagggttttgggtttcaagcacaaaactgggtggccatttgggcagacagtgagctagctgcagtttttattcatactccagtaatgcctggatgccatgatacagaaccattcactcccctggaaagggggctgaagccagggagccaagtggatcccatcctcatggagcccagcaagctaagatacgctggtttaaaattcttgccaccagcacagcagtctgaagttgacctgggacactcaagtttggtggggggagaggtgtccaccattatcaaggcttgagtaggtggttttcccctcacagtgtaaacaaagccaccaggaagtttgaactgggcagagcccaccacagctcagcaaagctgctgtagccagactgcctctctagattactcctcactggtcagggcatctctgaaagaaaggcagcagccccagtcaggggcttatagatcaaactctcatctccttgggacagagcacctgggcgaaggggtgactgtgggcgcagcttcagcagacttaaatgttcctggctgccagctgtgaatagagcagtggatctcccatcacagcactcaagctctgctaagggacagactgcctcctcaagtgggtccctgacccccatgcctctggactgggagacacctcccatcagggatcgacagacacctcatacaggagagctctagctggcatctggtgggtacccctatgggatgaggcttccagaggaggaaacaggcagcaatttttcctgttctgcagcctttgctggtaatacctaggcaaacagggcctggagtggacctccagcaaactccagcagacctgcagcagaggggcctgactgttagaaggaaaactaacaaacagaaaggaatagcatcaacatcaacaaaaaggatgtccacaaaaaactccatctgaaggtcaccaacatcaaagaccaaaggtagataaatccacgaagatgagaaaaaaacagtgcaaaaaggttgaacattccaagaaccagactgcctcttctcctccaaaggatcacaactccttgccagcaaggaaacaaaactggatggagaatgagtttgatgaactgacagaagtaggcttcagaaagtgagtagtaacaaactcctctgagctaaaggagcatgttctaacccaatgtaaagaagctaagaaccttgaaaaaagatgagaggaattgctgactagaataaccagtttagagaagaacataaatgacctaatggagctgaaaaacacagcacaagaacttcatgaagcatagataagtatcaatagtctaaccaattaagcagaagaaaggatatcagagattgaagatcaacttaatgaaataaagtgtgaagacaagattagagaaaaaagaatgaaaaggaacgaacaaagcctccaagatatatgggactatgtgaaaagaccaaacctgtgtttgattggtgtacctgaaagtgatgaggagaatgaaaccaagttggaaaacactctttaggatattatccaggagaacttctccaacctaggaagacaggccaacattcaaattcagaaaatatacaaaaacaccacaaagataatcctcaggaagagcaatcccaagacacataatcgtcagtttcaccaatgttgaaatgaaggaataaatgttaagagcagccagagagaaaggtcagattacccacaaagggaagcccatcagactaacagtggatctcttggcagaaactctacaagtcagaagatcatgggggccaatattcaacattcttaaagaaaataattgtcaacccagaatttcatatccagccaactaaacttcataagtgaaggagaaataaaatcctttacagacaagcaaatgctgagagatgttgtcatcaccaggcctgccttacaaaagctcctgaagaaagcactaaatatggcaaggaaaaaccagtaccggccactgcaaaaacatgccaaattgtaaagaccatcaatactatgaagaaactgcatcaacgaatgggcaaaataaccagctagcatcataatgacaggattaagttcacacataacaatattagccttaaatgtaaatgggctaaatgcctcaattaaaagacatagtcaggcaaattggataaagagtcaagacccatcagtgtgctgtattcaggagacccatctcatgtgcaaagacgcacataggctcaaaataaagggatggaggaagatctaccaagcaaatggaaaacagaaatcaggggttgcaatcctagtctctgataaaacagactttaaaccaacaaaggtcaaaagagacaaagaagggcattatataatggtaactggatcaatgcaacaagaagagctaactatcctaaatatataagcacccaatacaggagcacccagattcataaagcaagttctaagagaccaacaaagagacttagattcaaacgcaataatagtggaagactttaacactgcactgtcaatattagagagatcgatgagacagaaaattatcaaggatattcaggatttgaactcagctctggaccaagcggacccaatagacatctacagaactctcctccccaaatcaagagaatatacattcttctcagcaccacatcacacttattctaaaattgatcacataattggaagtaaaacacacttcagcaaatgcaaaagaatggaaatcatagcaaacagtctctcagaccacagtgcattagaactcaggattaagaaagtcactcaaaaccacacaactacatggaaactgaacaacctgctcctgaatgactactgagtaaataacaaaattaaggcagaaataaataagttgcttgaaaccaatgagaacaaagacacaacgtaccagaatctctgggacacagctaaagcagtgtttagagggagatttactaaatgcccacaggggaaagcaggaaagatctaaaatcaacacattaacatcacaattaaaagaactagaaaaggaagagcaaacaaattcaacagctagcagaagacaagaaataacttagatcagaggaaaactaaaggagatagagacatgaaaaacccttcaaaaaaatcagcgaatccaggagctggttttttgaaaagattaacaaaatagaccactacccagactaataaaaaagaaaaaaagagaagaatcaaatagactcaatagaaaatgataaaggggatatcaccactaatcccacagaaacacaaactaccatcagagaatactataaacacctctacacaaataaactagaaaatctagaagaaatggataaatttctggacacatactccctcccaagactaaacaaggaagagttcaaatccctgaatagactaataacaagttctgaaattgaggccttaattaatagcctaaccaaaaaaaaagcccaggaccagatggattcacaaccgaattctactagaggtacaccgaggagctggtaccattacttctgaaactattccaaacaatagaaaaagaggggctcctccctaactcattttatgtggccagcatcatcctgataccaaaacctggcagagacacaacaaaaaaagaaaatttcaggccagtatccctgaggaacatcaacatgaaaatcctcaataaaatactggcaaaatgaatccagcagcacatcaaaaagcttatccaccagtatcaagtcggcttcatccctgggatgcaaggctggttcaacatatgcaaatcaataaacacaatccatcacataaacagaaccagtgacaaaaaccacatgattatgtcaatagatgcagaaaaggccttcgataaaattcaacaccccttcatgctaaaaactctcaataaactaggtattgatggaacgtatctcaaaataataagttatttatgacaaactcacagccaatatcacactgaataggcaaaagctggaagcattccctttgaaaaccagtacaagacaaggatgccctctctcaccactcctattcaacatagtattggaagttctggctagggcaatcaggcaagagaaagaaataaaaggtattcaaataggtagagaggaagtaaaattgtctctgtttgcagatgacatgattgtgtctttttagaaaaccccatcatcatagcccaaaatctccttaagctgataagcaacttcagcaaaatctcaggatacaaaatcaatgtgggaaaattcacaagcattcctatacaccatgaacagacaaacagagagccaaataatgagggaactcccattcacagttgctacaaagagaataaaatacctaggaatccaacttagaagggatgtgaaggacctcttcaaggagaactacaaaccactgcccaaaaaaaaaaataagaggacacaaacaaatggaaaaacagtccatgctaatggataggaagaattatattgtgaaaatggccatatttcccaaagtaatttatagatttaatgctatccccatcaggctaccattgactttcttcaaagaattagtaaaacctactttaaaattcatatggaaccataaaagagcccatatagccaagacaatcctaaataaaaagaacaaagctggaaaatcatgctacctgactacaagctatactacaaggctgcagtaaccaaaacgcatggtactggtaccaaaacagataaatagaccaatggaacagaacagaggcctcagaaataacatcacacatctacagccatctgatctttctttgacaaacctgacaaaaacaagcaatggggaaaggatctcctatttaataaatggtgttgggaaaactggctagccatatgtagaaaactaaaactggaccccttccttacaccttatacaaaaattaactcaagatgtgttaaagatttaaatgtaagacctaaaatcataaaagccctacaacataacctaggcaatagcattcaggacataggcatgggcaaggacttcatgactaaaacaccaaaagcaatggcaacaaaagccaaaattgacaaatgggatctaattaaactaaagagcttctgcacagcaaaaggaactatcatcagagtgaacaggcaacctacagaatgggagaaaatttttgcaatctactcatctgacaaagggctaatatccagaatctacaaagaactcaaacaaatttacaaggaaaagacaaccccatcaaaaagtgggtgaaggatatgaacagacacttctcaaaagacatttatgcggccaacaaacatataaaaaaagctcatcatcactggtcattagagaaatgcaaaacaaagccacaatgagataccatctcatgccaattagaatggcgattattaaaaagtcaggaaacatgctggagagggtgtggagaaataggaatgctttcacactgttggtgggaatataaattagttaaaccattgtggaagacagtgtggcaattcctcaaggatctagtgccagaaataccatttaacccagcaatcccattactgggtatatacccaaaggattataaatcattctactgtaaagacacatgcacacatatgtttattgcagcactgttcataatagcaaagacttggaaccaaccgaaatgttcatcaatgatagactagataaaaaaatgtggcacatacacaccatggaatactatgaagccataaaaaaaggatgagttcatgtcctttgcagagacatggatgaagctggaaaccatcattctcagcaaacgaacacacgaacagaaaaccaaacaccacatgttctcacttataagtggaagttgaacaatgagaacacatggacacagggaggggaacaccatacactggggcctgtcagggagtcgggggctaggggagggatagcattaggagaaatacctaatgtagatgatgggttgatgggtgcaacaaaccaccatggcacgtgtatacctatgtaacaaacctgcacgttctacacatgtatcccagaacataaagtataataaaaaaacataaatattaccattctggatagtagttactatgaattaagagcaatttattaatgcactactgcaaacagaaacttctattatccacaaaaaatgccatttttttaatggctccagaaagctgagaaagtcctttatgatacacacttatcatatggacaaggttttcatgacttcattcctgcccacttctccagcttcataattcaccacttctacttatacatgagtctctagtaatgttaaactgcttcctaatacccacaggcatcatgctgttttgtagctccatggcattacttagtattattctactgcttgaaaagcgcactcccattgcctgacaaatcacctttgattctttggatacaccttagacctcacgtctttcaagaagccttctttgaacaccagtgcagaccaattatatctctatgccgtcacatcactctgtgtagtcctacatcatggtgcaaatgttcaacaaatgtttaatggaagaaagtgaatcacttgccaagttcaaccaacatcactggaatattttggtttatcttcctatcactcttgagactaggagtgacattattgatgggattttgttgttgttgttgttgttaactgcaatatccccagtgtattacaatgtgcctggcctggagtagccacctgacctatatttacagaaattaactgaaagatcaaggtaaaccagtattaagatgtgtcagatttgctcaagagtagtttaccaaaacaatcacagcatccattttgttcatcctagataacctaatagtttatttaaaattgaattttctgactttctgaacagctatcagaatttattccttttaggctataaaaagggtgtgttccagctgcaggctgagctgacctaagaccattgaatcaatgctcagtataaatgatgccttgcaaaaatgaccacaaaagtaagatttgtccagagtctcttggattacattctagtgtccttttcactaattgaggtaataattattcatccaatccctctttgaaacatccctgcctaccaccaactttgaccactcctttctctgagccccactacacactgtacatgtctctatcatagcacttagcaaactaaactaaaaccaattgttgaaatgtagtctcctgtttgactgaaaattccctgaatgcaagattactttattaatttctacacttcaagaatctaatccagtggctagcccatggacatatcaattaatgtttttcgaatgaatgaaccaatgaacctatgtccaaaggaattagttgagttgtagtgttattaataaatgtcataaatatataaaacaaaaaattgcaatatttgaaaacaagatataattaaccttgactctggggaaggaactgacgtttgctgaacttctatgatgtgccacacactgtgctgggcacgagggactttgtcaatgttatcttgtcacaccttcacaacaataataaatttgtaaataaaatcgccttatttttcagatgaggacacttgaatttagagaaaaggattataaatttaagataattctgatatcaaagtttcttttcctgctgttcagagaatatgacttaaagtgaaaaatactcagaatgagtgtgaatatatgaagaaagaagataaagagacttctgattaagggttagtggagtgaaaaatactctttaccatgcaaaattttattggctcagattacaaggtctccttccatccacttgactgtcccctgcccacccctctggttagatagaaatcattctgccctagagactgtggatgtcctgtcttggctatagttttccaggactgagtggcagggatagatgccttaaattaagactcttgccaaagaagactttcaaagcaatgatttcttcagtgcattttccgtttgtttatgaatttccttagtacttttattatagcacaatctattgatcttgctaaatgaatttcatagacatgacccaataaatctatttatcaatatttaattataacagcaaatggaaaaattcattttctataggatagaactctaccttgtactataacgtgtagtttctctgagtattgatgcattattctcgtcactagattagaagctttttgaaaatggaaacaaattcagcttagcttagctgcttatccccagcatctaagataatatcttgagtataacagctgccaattaaaaagagtcagtcattgaataacttaaaatatatatcatcctctaatctgtttgggaaggttctggaaatcctgataaaaatatacaggttgagataagaaataatttttcaagtttatatatatacatgaaatatgagactcagtgaaatcaaatacttctcagactatgcattgtgagggatggaacccacgttccggactctgaattatctcttttcaatttaagcatgttggaggctaggagttgtcttaatatggcataccttgaaaacccagcgaattttctatgagattttctgttttcagaaattgcaagctattatttaagctatggtagttttagacacattaacaagtgaaaattaagaagctgaaaatagcagtctttgtggttacatattaagatttctgagagttgacccacaggtctagacattttctctgcttctttatgttatacaatagcagataaacttctcgagaacgtgtaaattttattcttgtaactgtttattgtcctaggggagtgcaaggacattaataaactttagagaaaggcagttggcattcatgaaaacaaaatgcagtagtgagagaaaaatagggaaaaagagggtctatgaccaatcccacccttaccttagaggtttcttgctgattctagatcactagtttcctgctgtctgcttgcttggcatttctaagaccatgaacagtatttaccaaagtatggcgtaagggatgctgggaatatacaagattattttaggtcactattgatgaatatttttatttcaatagtcatgcatttttataattaacttatatttataaaattgctgtttttcacttagaggtggaattcctgcaattcagtagcaaaaaattaaataacctaaacaacagaggagcaaataaacatttctccaaagaaagcacactaatggccaataggtatatgaaaggaccctccatatcacaaattacggagtgatgcaaatcaaaactacaataagatatcatctcacacctgttattattatgttttaaaaagataagtgttggcaaaaatgtggagaaattagaccccttgtacactgttgggaggaatgtaaaatggtacagtagctatgaaaaacagaaataccatataatacaacaatcctacttctggatatatatctaaaagcattgtaaggaagatctcaaagagacccaccctcccatgttttttgcaacattattcactatagccaattatttccaataaatgaatgactgaagttcaggaaacagttacaacataagttgatccaaatatcttctattttaaattttttcttgcaaaatagtaaattctcttggttacagttacttaacatgctgtaactttgtaactttttagattacagaatattttcatcattttctgtctgtcacagatgctagtgacaaaattctgtgtatcatttttcttcaaaatataacacttggtacagtaagtgctaaacaaagacaaccaattatggatttattaagtgtttgttattgacaatgaatatggaaaattggaaatggattccagagatggagtcaacaatatttggtaaccagatggctgtgctagctgaccaaggagagacatcatagatggattctgggtttgctaaattagtattttaattagatagtaacatattaaaataaataagttctctaatctactcataaactaatttcatcttattgagattgcacatttgatttttacaattcaaaataaacctatcttaagatcttaagctagtcctgcttttctaacacttgagttattcattcttaataaaatcatcttatataactcgaagaaatacattgtttagttttatttttttaaatgatgatattcaccacattctcactcctgtctcatgggcttttccttcatttgcccaaagatagctgttactttaacagtgatatgaaatctctcagcttctctggcactttgtggtcagtaaattttgtctaaaaatgtagctttgccaacattcattttgctgaaaaatgaaataaaacgagttttcaggataaacgttttctgtgcccattaccttgttgtttggtttcacactggtaaaactttgtttgtccctgttgctatcatctttgccaactttctctccacatagcaatctgcaataataacttccccaggagtgagcttagtcctcagtctctgagccaaggaaatcctggaagtaggttggggcttccttcccactgactggtaaacaggatctgaaatgggtctgctgccttcacgcctgatatcctgggcaggtaggcagccccagggtgtacctaggaacaatgccacacacttgcattgacatctgtctgtgtattctgtcttcccattaatttatatctggaaaataattcaacatcctttcattttaatctcaaatctgtgaagtcaccatgtcaaaatgtcagaccgttcgggagacattgactgcgttaatactgtccttcacactactgatacactacatgcacagccagccacaggctctttcccaagatcatgaagtggtgtactcgtgtaattgataaccaaattcaaaagatataattattaattatttctatgctggagcaaccatatggcctatgttttcctgtgacatttccttttatgattgttctcccagagttacaacacttctgagcactctcgaagttagacaatcatttgtggtcatttagacaatcatttagataatcatttgtggtcaacctatttatgtccttagaaaaacctgttcaccacttttagtctcagttaaaggtattgaacactatgatttctaatgacaatttcagttttaacatttacaaaatataaggtcagcctcaagtacacagaaatgcaacaaacctaaaaaaaactttcttgaaagtaacggatgcctaatgtttacatgaaattaactttatttttggatacagaaactgacttctgcgggatctttgtgttttaatgtgcaaattgattttatgattatccaacccttactcaggtaaagaagggtaagttctgaaggtcctggaggcttgttttctcccaaatttttgtatctctttgcaagtggctagatgtgtatatcttagtcaactcaaaaacagggcaggttgatgccagcaactgaattttggagcccacctttactaaaaaggctattttctcaaccaacaaatgtctcttattacatagtagagttaatgttccctgatttcctttccaactttgttacaaatatgtgagtgtgaggggcatggggtcctgctttgctggcatttttcatggtgcctccagctggtctactcaggcacatttccctgcaggatgggaattgaaggggattctggataattcactgattctctgccatgtaatcccttgcaggaaaatactgtaatacaccatgacaagattaaagtgccactttcatggtatcagtagccattatactagggacactgaactgtttatcaatatactaaaaatgaggcagctcagtttgacaagaaaagtgttggaaaaggtctgacccctatgctaagtttcccgtgctgtgcctcagcaggcttgtcgcacagcctccaagtctgtcccttcatctaggaaatacatgcagtggatagatcagattaagtgctaaaccagtaagttatctaaacaaattgattatagaatctaggattaggaagaaggaggtcactagaggaagaaggagaaattgaatcacacatactgtgttgagacctaggtgtacctgcaacttaaagctcacactatgaaaagatttcatgtcttcaatgaagatgatacattctcataagttactgcttcttatgctcagacacagatttcattgtggatgtctcctttaacagtataatgctatcagggcacacatctaggtctcaaccttttcacagacagaggtaagagttgaattgtccctgcatgtgtagcctctacagctatgttgaagtcaagaagagtgttttttctctgggaggcttggtgctttaatccagtaggtattcaatgaacacttaaatgttgattaaaagtaatgaaattcaggactgtataacatgtattaaacatcttttatgggctaagtttttacaggtaatttcttgcttcaaaaataagaaaattgaacctcagagagtccataatgcttatgaatggaacaataattactgatttttttgaagcccaagtatagtgatctgtcctctgtactgacatgccagtatggagacaacaacaaaatagttacatgagagtcttgtacagaacattttgtgatattttttcatcatatatttagaaaataaaaaggaagggaaggagcttgtcatgattttaagcaggctcatcttggccatagatttttatcacatctaatcttctttcacatctatctatactacaatatgcatgatccatttaaacagatttaaaagacaaactgaaatttagctttaaaataactttttaaatgtcatcaagttatatttggaaactttatgagagcagttatacaatcctataattatcatgttcatgaacctttccaacaagtatacaattcatgattacaatgtttttgaaagatagatgtgaaaatgaataaactagaataaagacagttgtgaaatttcatctagtgaaaatagatttttaaaattcatgtattcagagagtattttttgaagcaagacagtttgagtctggctaaatgattgaaatcacaagaattttttgaaatgtttctgtattttatgttattttattatttgtactttagcacaattataaaatctatttttattataatatgtggcagaatagagtgaaaaaagattatataaactggtaacttaagaaacacatttcaacatttgtgcaataaataaatatttaataaatgttgtgggaaaatcaatgatcagaaccacagaaaaatgttgtcttcagattacagaattgcacttgaaatgctgcatttcctaaattttgttataattaaatatgtatacacatccaagcctttatttaaaactgtcccatctattgtaggaaaagctgggtaaaaaatgtattaagaggtctctttaattccaccatctgcttctgcaaatgtgaagagctctgagttcatgattcttaatcagtccatttaaacatgaacaactatttcacagttaagaaagcaatgcaaatacctgtggaatacttcttctcttaatgttgaatgtttaaatcacataaagtggtcaatggatatgccctgatccttccttccacctcatctaacacagtcactcttatacatctctgtttaccaatcttgacattatcctgcccaaaaaacttccatggcttcttacggactactgaatgaaatcatgacattttgtcattgctttcaacactttccctaatgaaatctcaatactcatgcccagctagccttctacaaatacccaatgctccagtcctgaacctttcattgaaatcaactgctcttggctcttggtcacgcgtttcttacactctcttcttcgcctatctttacatgctccaattccagatgtcatccaatgtgtggctaaaatgctgccttggtcatgaagtatatttttcactttccattagaatacatttctatatttccaaaatttccataaaattaaaattacgtatttcatagcacatagcattgtttacattgtcattttatatcctttactagactataagcacttgggcttataaatcctatgtttgctttctgtaaccttcgtagagctagaactactattctctccttggcatatggtaaacaagacttacaaaaatctcactaatgcgtaattcttatgcattcttcactcgaattcaccaaatgttgacatattacataaattagtacagtttttcaacaccagggaacaccatttctaaactattaactaatccattgacctttttcaaagtttatcaattgccccactaaagtattctataggcaaaaatcttattcaggatcatatactccatatacttattgtatcatcttacatttattttaatttaggacagattttcagcctttctttgtttttgatgactttgtgaagaataatggctgatatggttaggctttgtgtccctaccaaaatctcgtcttgaattgtaattcccacgtggggagggtggaaagtgtttggattatgggggcgggttgtcccatgttgttctcgtgatcacgagtgaattctcacgagactggatggttttataagtgtttggcaagttcctccttcgctcacacttctcttttctgccaccttgtgaagaaggtacttgcttctacttacatcatgattgtcggtttcctgaggcctccccagccatgtggaactgtgggtcaattaaacctctttcctttataaattacccagtcttgggcaattgttcatagcagtgtgagaatgggctaatacactggctaattgttttacagaatatagcacaatttggtttgttccatattactcctgattatatttaatatgtagattaggcatttatagtaagaacacaacagaagttattttgagacttcttgggacattatataaagaagctcatgacactgatttgtctcattatgttagtgttcaatttgatcacttggctaacattacttttatcgagtttctccagtataagtttactatttttactttgtaatggctaagtacattgtagaatactttcagaatatgaaaatatcctatttctcattacttccacacactaattttagcagttattgattactgaaactattattttggtgtttaccacaggataatttttttccatctttttaactttttctatactcactaattcaaattctgccatggggaataatagctttctattgcctcccttatttctttatatttagttatttacctttcttattattgactcatggatgtttgttcaactaatattttaataagactattaaatatatcttggagcagtacatatatttttagagaatatatgtttaagattcagttgggtactgttctcagtattccacttgtttcaactattaattgtcatagtaaccataagaagttggtagtgttaccatactcatttcaaagataaggaagttgagacacaggagaattaggtaaccttcccacattactccaccagagtgacagagttgagattaggacctcagcaatctggctttagagtccatgctgttaacaaaaataataaatttaatctaataaggcttcgtgagactcaggagtagtttttctctctctcatcattagcacatcttcaaccaaagccagtatgtgcacaaggcatgctcagatctcagcatcatgggaccaggagatggtgaaggaagctaggattaagcagaatttgcttccaagagtaaaggatttggcaggttggaggaagattatctagccacagaggtaagtcctagtaaggatggtggagcaatctgagatataccagaatacggtcccatcatagcccaaatgggatctgttggtggtatcttcctgctatgttcactgctatagtagattaggattgtatactatgtgttcaggatagaagaacagctttacctgtagcaattaattagtcaaatatagaaggcagacaaagagttgggaaactaggcggcaaccacagcttaagaggagttcactggtaggtaattaaatgatatttatgatgaaaataacaaatatcagcgtggctagtcaggaccagctgacactactggtctggaataccatgaagataatcaggcaaactacagagtacagaaatgaagcaaaaattcacttttgcaactggaccagtacagtagggagaatgaaatattgcaacttggttgcaatagggcacctgcttcggtaggtgtagcaacacagtaatctcactcccaggtttaggcctacagtgattagacttcttgctaaacttcatttgatggggctgagacttctgacattcttattgcttctgccaggaaagtctttacagttccaactcaaaaactgtaaatatttgaacctatacatgggattcctttgacatttattcttacattcatgcattcactccttatcaaacacatacaatgtgccatgaaaatgtgcaggggttagaccatgaccaagacataatctatactatagtatattaatctataccatcaagtaatttattttctagtaaggtagttcttcaataatatatgcaagacataatctatactatactaatctatactatcaagtaatttattttctagtgaggtagttctctaataagtactgagcgcacatggaaagcagtagtggctcaaagttctggtggtgtgtgtgggtgggagggttaagagaggatttcctggaggaaatagatccacctgtgaggataatggaggcagagaaaggtagacaagcagcaacaggaacatacacctgtttaataaaagcaaacacatttaaaacaatatggaagtggcccagcaagatatctaccccagtaaaagaaattcatgaaaaccacccccactgccatctgattaccatgttcagctgcggtgaagtggaaggaaggttaggctgtgccacagatatttatagactcttaaatagctgtaaaagcgtggcattgaatgacatttgtgtaacccctttcctaataatagggattagagctgcagaagatctaggtggtcatgtagttcaatctctgatcatttctaattctagaaaggtgtaataataattatttacatttgcataatactttataaagcactttcatagccattatcttatttgctcctcaaaacaattttctgaaataagcaggaataatatcatcaaaattataaaaaacaattttctgaaataagcaggaataatattatcaaaattattattgcctggaaaaggaaacttaagacggtaggaaatttacattaatggctagagatgataacactagggagtggagtcaaatctgggatccaaatttctaacctcttatccaatgttctttccataataccacctgctttaatttgctaaccaagggagagctgatacttagcaactgggagtctcatatcctctcttggtgactctccaggtatttattgttcctttctgtgaagagcctatgaggagagggagaaatcatgttacacagagaaagtccttcaaagtacgacctctctggaacacctatcttagtttctctttggcagtttgtagaaaaggaatgtttttgtccttacctcaggctttctatttgagaatctgtgggtgtaaggaatgcatttttaacaagcccatttgggaatattgatgccatctgggaagtgtaaaagtaattacagaactgcttctacagagtgttggtaggctctaccatctaagaccccctaccccagtcagaatagatgaagcagaaacaagacgaggaggaagctccagtcagctcctcttcatgcagaaatggcatcaaggactagtattagagaggatatagcccccgacaaattctatcaacttctgaaaagatgcatttaaaaacagcgagattgctatgaaaatataccttcaaggagactctcctaggctctccttccaacagaattgccatttagccctgttttatagaaaccccatgtctgttcttgcatgggctattacagcaggacccacagttttaagggaaaagggtgatggaccatctcacttcttctgtaagaatccagtaggcaagtaaatgtgtaaagctctgaggaaaatatcaagagaaaatatctactcaagttgccactacttggcaccaaactgggtacacgatagacttcatgttatgttcaggttttactagtacaagattctagggggaaggggaaagtggtgagcagatgatattttcataacctgagtataatggaactttatctcaatctcagtttccaaacatctaggacatccacacttctcatgccaaataatttgcctcactgctggattaagttcagggtgactggaaatgacagagccaggcctttctcataacgaccctcaatggtgacctcctcatagaaggcattgtatcttttcttctgtggactctcacaggctgaatgggcttgcaggattcagagccagtgagagatatgattacaaagcctcaggataagccttaggccattttaccaggatccaaattatcagtgaaccaaacagcctggctggaggagatttgaggcaaatacaatcacattgcatcgtatcagaaacctaataacaattttccacaagtagtcactaaccaaaaatggcatattgtagccccataagcagcagatacttctaattagctctagatgattgaccacacatacagatttggctatacatgctagaagtaattgcagttaattgtcaatggtaatgaagcttgtattgactagttaggcaaacatcaaaagcaaaattcaaagctgtttcaagaaaatattgaaatgatacaaaggttgctgaacaaggcaactgtccacagatttgtgaagttaatgtaagaagcatactagtaaggttccatcctatatcacaattttaagggcagattaatcatatacctcccatttcctaaggtctaaatttaaaaatctaggaccatagttagataaataactttgcgtcttctttcagtggaaagccaaatgagagcaatttgatttacattaagtattttcaagtgaataatattaatgaaaggccagagggaaaaaatgacaggaaagaaaattataccgaggcctaatagcaatacattacaaacagacagggagacattaacagctagacattctgtgcagcaaaccattatttatgacaaggtcacctttgctttaagtagatattcagcagtcattgcataataggctagtggggacttcagaaatcttaaaacctcgcccctttattttatagcttttgcaactgaagcccaggagtggggaatggaagagaaggaaaggaacaagtatcgagcacctatggtatgaaaatgcacatttctatgcctttcacacaccccacctttcaatccctacatgaaccttgaaaggcaggtgtcactggtctcaagtcatgctttaggaaattaacgcttcacagcagaaatggtagggcgtgtcctactgcaccatgatgccttcctaaaaagaaaataaaggtggctcatttggtgaaccagcactgctctggtattagaatccaatcctgactcaggaatcaacccataacaactctatcagaagtactttcgagaatctaaaaaataatatccaagaaccatttaaaaagtgaaaacatttggcaaacactgagtttaaggttgaggtaagtcctacatactccagaatatgtatctatatgcttactcagaaataaggaagtctagtagagtacattgattaaaaatgatgactgacattgattgaagagagagtgtatgcctgtctgtatactagactattttaattgatactcaattataattgttatattttacacatagcaaataaatataccgtagaattgttaagtgacttcacaagttatatagtcaagaaatggaaaagccagattttaaacccagggttatggtcacccaaagcttttgctttttctctactactcacttctcctaatttttttttctttttatttttctttttttttttttctgagacagaatcttgttctgttctatcacccaggctggagtgcagtggtacaatcacagctcactgcaacctcaacccttcgggctcaatccacccacccacctcagcctcagcctcccaagtagatgggactacaggcacgtgccaccccacctagctaatattgtattttttgtagagacagggtttcaccattgttcccaggctggtcttaaactcctgagatcaagctatccacctgtctcagcctccccaagtgcagggattacaggcatgagccaccatgtccagcctgatactctttactcttcactataacattcttaggctgagcagttcgtttggaccttggccttgtagatcttgtaacttctatcttttattttcttcatattttgtaacttcaaacttttatgtttcttttctgtaccagtcttgtgtctccaaaaagatggaaaacttaagtgtctctctatttaattccaacacccagtgtgagacctcacagattgttggcagagaaaatgtcaatagtgatatctgtgagaggagctgcttttggtaggctgtagtgatagagcctctagcagccaatccacctcagcgtttttattcaatcactttttgctcatgctgagaaattcctgaggcattcaagaagtaggcatttctgaaaagccccatctactacttaagtgaccttgggaatattatttagtccgtctgtgtcttggttccctcatctttaaaacgaacctaagatcacatatctcagaagcttgagtaaaaattagaagaaataattctttgttgagtgactggcatgtaataagcatgcaataaatgttgatcattatagccccctttggttccaacctttgctaatcacccttgaataatccttagattgataacccttggaatccctctgctcctccttgacctctttaacacggcccaacaaacagcttaactcaggtgttgtctctctaggaatagcatcatcattattcttactcccacagctctggcttggttaataatacattttttttgtgtgtttcctctgaaatatatatagacttccacaataacttctacaacactgtaaagtagtttttcccctttaattttcctttttccttctactgggcaataatatgcttgacaacagggatggtgcctaaggtatctttgtttagcctgattctagcctagtaagtgtcacatttgtgctgaattaatcccagatatcatatacaaacaaacaaattattcctatactggagactatagtggacaatttattttcttgaggcagaaatgggattcaatttggcctcaatgattctggagacaaaaaaaaaaaaataagcttaagccaacatctttttccaatatacgagctgatttattttcacctgcattcatcatatactaactgcttattaaatgaaaataaattatctgagtttctgacttcttgctatagccaaagatagagactgttaatatgctagaatagctattttctatatattcacacatcaaagatggttgtaatcagaaaaaaagtagcatgtaagaagttgggaataaagaagtatggctgctgttgccaatatcaaaacttaaaaatttaatggagtcaagaaacctaaccataaaaatccaaaaatcaatgaagcatatcgtttagaccttgtgtttctttctgaaactttcaggtatacagaatatccaatttaaacagaatttttaaaaatgtcatatattattttttactttgaaatgaacaagattcacaaagtaagtatactgtgagtataatattgtcattgcataaagaagacaccccgttatccaattattttaatgagataatattccatttctaacaaacaaccttctgtttctcactaaaaccaaaggctctcaacctggtttcccattttctggtagtgacgagttaaggcttcaaaactgtttccaaaaacacagctcatttttccacaaactctaatgatttattcagatgcatgtggttttcaccatgtcaatgtgaatacagcataacaagctgggtaacacattccttagacttaagcattggagataaacagattatgactgaaactgacctaagacttggagtagatatagaacgaagataaatgcctgaatttagataaacatgaagcttcttacttatgttcctgttaaactaccagatcactagaccccactagaatatttctgaactctaggctgtacgtgtacctctaaattttaaaaagcctctctagatgatagatacacacagtaaagtgtaaggactacaaagtgatttcctaaaaatggaaaggtgtcaagtagttcttccttatctaacatgcaggtagataagaaaaattcactagaatatacatactttacttctcagattttgtggtaagaaaaagtgagtgcagtttgtctaaccggctatccaggaaaaaaaaaaaaagatcacgtaacgaggagtaacacagaataatggactaaaaacatatagaaataccattttaatagttgttcaaccaccttctgcttagaaactgatttgtgttattttttattaaaatcaattattcattgacccagagggccaattagaagcagctgtggtctgcagcactcatggagaggaatataaaagggtgagtgaattcagcaccttcgactgaaatatccaggttcttacattgggattgactaggcaaacaacctgacccacgaagaaggaagaaaagtcagaggtgaagtatgttccactctggagtagcagagagccaaaggaacccccatccccaggcaagggaagcagtaagtgattgtacaaccctgcccaggaaaccacacctctcccatggatctttgcaacccatggatcaaaatatcccctatgaggtgatccccaccggggctttgggtctgataaacagagttgtgtggagtctcagcagagcagccactcaggcacacacagagactgggagttttacatactccagccctgggattcctagcaaggcatgaaagccaaccatagctatacctaggaagggagcttaatccagggagccaagcagtattgttctgcaggccctacttccatgtcacctcacaagttaagaaccactggcttggaatcctaggcagccaacagcagtgggttgaggtcttcctgagatgggtctgagttcccagggggaggggtagccatcatctctgtggttcagttgagtcagctgctccagcctgcaggctgtggagaacataagtggtctggatgagaaagggttcaccgcaatgcagtgtacctgctctaccagaaagcatccagactgcttctctgggcaggtccctgatcccgttcctcctgactgaatgagaccttccaatggaggtctccagccacctcctacaggtgaatgcaggctggcaacaggtcagtacccccccaggaccaagcttccagaaaagacactggatgccatcttgctatttcacagccttcactggtgatacctccaggtatgggaaaaactgaggcaactgggttctggagtggacccccagcaaaccacagcagccctacagtagagtggcctgattgttaaaaacaaccaaaccgaaaacaacaacaataacatcaacagagaaaccccacagaaaccccattcaaaggtcaacaacctcaaaagtcaaaggtagatcagcccacaaagatgagaaagaatcaacacaaaaatgctgaaaactcaaaaagccaaagtacctcttctcctctaaatgactacaacacctctcgagcaaggacccagaactggactgaggctgagatggctgaattgacagaagtaggcttcaaaaggtgggtaataacgaacttcactgaactaaaggagcatgttgtaacctaatgctaagaaggaaaaagtgataaaacaataaaggagctgatagccagaatggccagtttagagagaaacataactgatgtaatggagataaaaaacacaagagaacttcacaacgcactcacaagtatcaatagcaaaatagaccaagtggaggaaagaatctcagaccttgaaaactatctttctgaaatttgacagacagacaagattagataaaaaagaattaaaataaattaacaaaacctctgagaaatatgggattatgtaaaaagactaaacttatgacagattggggtaccaaaaagaggtggggaaagtggaaccaagtaggaagacatacttcatggtatcattcatgagaacttccccaacctagcaaggcaggccaacattcaaattcaggaaatacagagaaacccagtaagatactccacaaaaatatcaagccatagacacataatcattagattctcacaggttgaaatggaagaaaaaatattaaggacagccggagagaaaggccaggtcacttacaaaggaaaacctattagactaacagtggacctctcagcagaaaccctacaagccagaagagattggggccaatattcaacattcttaaaggaaagaaattccaacccagagtttcatatctggacaaactaaactttataagtaaggagaatttttttttgagacaagcaaatgctgagggaattcttcaccatgaggcctgccttgcaagagctcctgaaggaagcactaaatatggaaaggaaaaaccgttgccagctactacaaaaacacactgaagtacacagaccagtgacactatgaaggaaccacacaaacaagtctgaaaaataaccagctagcataatgatgatagaatcaaattcacatatatcaatactaaccttaaatgtaaatgggctaaatgacccaattaaaagacacagaatgaaaagctggacgaagagccaagacccattgtaatgctgtctttaagagacccatctcacatgcaaagacacacacaggatcaaaacaaaaggatggaggaaaagggatagcaagaaaatagaaaacagaaaaaagaagtggttgcaatcctagattctgacaaaacagattttaaccaacaaagatcaaaaatgacaaataagggcattacataatggtaaagtcttcaattcaacaagaagagctaactatcctaaatatatatgcacccaatgcaagagcacctggattcataaagcaagttcttagagacctccaaagagacttagactcccacataataataatgggaaactttaacattccactgacaatattagatcattgggatagaaaattaacaaagatatgcaggatctaaacttagctctggatcaagtggccctgatagatatctacagaattctccacccaaattcaatagaatatacattcttaccaccacacatcactttaaaattgatctcataattgggagtaaaacactcctcagtgaatgcaaaagaacttaaatcataacaaacagtctctcagatcacagcacaaattagaactcaatattaagaaattcactgaaaaccacacacctacatgaaaattgaacaacctcttccagaatgactcttgggtaaataatgaaattaaggcagacatcaaaaagtttgttgaaactaatgagtataaagaggcatctctgggatgctgtaaggcatggttaagagggaaatttatagcactcaatgcccacatcaaaaactagaaagatcacaagttagaaacttcacatctcaactaaaagaactagagaaacaagaggaaagaaacagaactagagaaacaagaggaaacaaaccccaaagatagcagaagccaaaaaaaaaaaaaaaaaaaaaaacaaagaacaaaatcagagtggaaataaaggaaatagagacatgcaaaacccatcaagaaatgaacaaatccaggagctgttcttttgaaaaaattaataaaacagaccactagctagattaaaaagaaggaaaaagagaagaatcaaataaatacaatcagaaaggataaggtgcatattaccacttaccccataggaatttaaacaaccatcagagaatattataaacacctctatgcacataaactagaaaatctagaagaaaccgatacatttctggacacatacaccctctcaagactgaaccggggagaaactgaatccctgaatagactaataatgagttctgaaattgagggagtaataaatagcctaccaaccaacaaaagctcaggaccagacagattcacagctgaattctaccagaggtacaaagaagagctggtactatttctactgaaactattccaaacaattgaaagggagtgactccccgttaagtcattctatgaggccagcatcatcctgacaccaaaacctggcagagatacaacaaaggaaagttcaggccaatatccttgttgaacatgaatgcaaaaatcctcaataaaatactggcagactgaatccagcagcacatcaaaaagcttatccaccataatcgagttcgcttcattctcaggatgcaaggttgtttcaacatatgcaaatcaataaatgtaattcatcacataaacagaactaaagacaaaaaccacacgattatccaaatagatgcagaaaaggcctgtgataaaatccaacatcccttcatattaaaaactctcaataaactaggtattgaaggaacatacctcaaaataataaaagctatatatgacaaatctacagtcaatatcatactgaatgtgcaaaagctggaagcagttccctttaaaactggccacaagacaatgatgccctctctcacacctcctattaaacatagtattgaaagttctggccagggcaatcaggcaagagaaataaataaatggtattcaaataggaagagaaaaagtcaaattatctttgtttgcagatgatgtgatcctatatatagacaaccccatagtctcagcacaaaagtttattaaggtgagaagcaacatcagcaaagtctcaggatataaagtcaaagtgcaaaaattgctagcattcatatataccaacaacaggcgagccagaagccaatcatgaatgaactcccattcacaattgctacaaaaagaataaaatacataggaatacagttaacatgggaagtgaaggacctcttcaaggagaactacaaaacactgctcaaataaatgagagaggacacaaacaaatggagaaacattccatgctcatggataggaataatcaatattgtgaaaatggccatactgcccaaagtaatttatggattcaattatattctcattaaactacctttgccatttttcacagaattagagaaaatattttaaatttcatatgaaaccaaaaaagagcccaaatgggcaagacagtgctaagcaaaaaggacaaagctgaaggcatcatgctaccttacctgacttcaaactgtaatacaagagtacagtaaccaaagcagcatactactggtccaagaacagacacataaaccaatggaacagaagagagaactcagaaataagactgcacacttacaactatctaatctttgacaaacctgacaaaaaacagtaatggtgaaaagatttcttatttaataaatggtgctcaaagaacaggttagctatatccagaaaattgaaactggaccccttccttacaccatatgcaaaaattaattcaagatggattaaagaattaagtgtaaaactcaaaactataaaaaccctagaaaaacatctaggcaataccattcaggacagaggcatgagcaaatatttcatgatgaaatcaccaaaagcaattgcaacaaaagcaaaaattgacaaatagtatttaattaaactaaagagcttcttcagagcaaaataaactatcagactgaacagacaacctacagattgggggaaattttctgcaatctatccatctgacaaaaatcttatatccagattctacaaggaacttaaacaaatttatgagaaaaaacaaccccatcaaaaactgggcaaaggacatgaacagacatttctcaaaagaatacatacatgtggccaataaacatatgaaaaaagctcagtattactgatcattagataaatgtaaatcaaaaccacaatgagataccatctcacaccagtcagtatggtgattattaaaaagtcaaaaaataacagatgatggcgagatcgttggtagaaatgtacattagttcaaccattgtggaagacagtgtggcaattccataaagacctagaggcagaaatatcatttgacccagcaatcccattactaggtacatactcaaaggaatataaaccattatattataaagatacatgcatgcatatattcattgaagcactattcacagtagcaaagacatggaatcaacctaaatccccatcaatgataggctggataaagaaaatgtgttacatagacactgtattagtccattttcacactgatgatataggcattcccgagactgagcaatttacaaaagaaaaaggtttactggcctcacatttccacatggctgaggaggcctcacaattatggcagaagatgaaaggcacgtctcacattgcagcagacaagaaaaaagagcttgagcagggaaactcccgtttttaaaaacatcagatctcatgagacttatgcactatcacaaaaacagcacgggaaagacctgcccccatgattcaattatctcctgctgggtccctcccacaacacgtgggaattatgggaactacaagatgagatttgggtagagacagagaaccaaaccatatcatacaccatggaatactatgtaggcaccaaaaggaataagatcatgtccttttcagggacatggatggatttggaaaccattatcctcagcaaattaatgcaggaacagaaaaccaaacatcacctgttctgacttataaatgggagctgagtgatgagaacactggacacagggaggggagcaacacacactgggtcctgtcagggaatgctggggaggttggtggagggattgctaatggatgcaaggcttattacctaggtgatgggaagatctgtacagcaaaccaccatggcacttgtttacctatataacgaacctgcccatcctgctcctgtactcctgaacttaaaataaaagttgaagaagaaaattaattattcattataatgtaggtatattgactctatcaatcaggtgtggcaggaaaacaacattgaatattctaccagaatggaagggaaccaatactcaaaggtaggcacttgaatatacatctgagattctcaaaggtggtcattacactcccagatgtatccttatcaattcctacattttctataaaaaatttacagttattgggtattacattttttgagaattataagtgcatatgtgagggtctgtatgtatctgtgttcatacatattaactatcatcatcatcatatttttccacctttttatcccctcctaaattcaaagatggggaaactcaaactataacttgccaaagtctgacatcaaattctgcagttatactacagttggggttggtctgttctccaaatcaattgtctctgtgctctgcccaagtgctcctaaagacttcagcttatttttgggtcatcactcataggctgtgcagctctgaacaattttacaacacttctgtaggccttgctctcctcatatgcaaaacagagatatatagtccccactttctctacagaattactgagattcaaatgaaatattatattgaagaacactctgtaatcctgctaaacactagagaaatataatggattaacaatccttataagaaactgaagcaaatgtgtatttagatgtttcaataaggcatttggaaatagaagatatctcatcaaagacaagagcttggggattctcaagagctcaaattgtaactagcttctcccaatagtttcagaaaacagagtctcagagaaggtacaagatgccgtaaattaatatatctgaaatgggaaaaaacataaagtagaacgacttggtcaatattaacatgaacttgaccaaattaattttttcatataaagttatggtttaaagatgagagctaccatatctgtgtaggttaggaagagtttttaatcatatggtaggaaaaaattgaatttctttaagtgaacagtgtcctatcacaatggaaatgtaagtacctagaaaatcagtattttcattttatatttacattgcaataacagatgttagcatgattttgttgcaaactctctatatccacccctgctaagacaaacataattaaaataatttatggaattgtagtatgcctaagcagtttttgagttagagacacagcaaattttttctatgcccaaagatggcctctatgatctttaagtagttctgatatttaccaggacccatttgcctccaaacagagaattaaataattttgaatttagaagctgcccttgagaatattgaatctggcacttttattgtcaaggtgagaattttctaccttagggaatgtgaggatttacacagagtcacacaggaaatggatgccaaaagtaggatactgtgccaggttttctaactacaggtccagtgatgttttccctaaatttcttactaaaacaaaagccaaaaaaatatgactctacaaaaacaaacagaggttgggactgattgtcctcaccatgaacaaggcttatatttacctctttgtatctgctcctagcagccattttctgtctctacattctacccatctagggattggtgatccataaatttttgcctccaatagacatggaaacagccttactttagcattctaacagtctgactgtgtttcgtgttattccagtttcatcttcaataaaattgccatttagaataaagaaatactagtcatgagtggtcataaatggaagagatcatataaatcatgtatttcaatactcaaatttacagatgacagactagaacccagagaaatactccatccaaagatagaaaatcagtagaagagtctacattataattcaagattttagggtctcagatcttttcattttatacatctgtgctgtcatattcagtcagcaagagttcactaggcagttattcacatggcatttgtagttataaaataagagataagacatcagcatgacaagattttataaaaaatataaagtcgaattaatatgtctcatatagtactatatgattttttgagtttctataaaatgtaaatgatgaatacatacaaaaaattatatagcaactatgttatataaactctaaactataaattataaactataactttgttgtataaactataaactataaattatacattgtatattacacattaaaatcagcaaaattgaagataggacaatggaaattattgagtctgaggaacaaaaagtaaaaaggtaggagaagagtaaaaagataagggacctatctgtaggacaatatcaagtaggataacctatgtactgtggcagtcccagaagaataagagaaaggatgacagagaatatgtgaagaacaaatggctgaaaacttcacacatttgatgaaagacatgaatataaatatctaagaagctcaatgaactccaattaaatggaactcaaaaaactcacaccaagatacattaaaatcaaactttttaaagacaaacacaaagagaaaatcttgaaaacaatcagaaataagtggctcatcacatgcaaggggtcctcaaaaataatatgaacagatttttcctccagaaatattcgaggccaggagctggggaaaatatacattcaaagcagtcaaaggaaaaaaaaccgatctgtcaaatgagaattccatatctggcaaaaatgtcctttgaaagttcgggagatacactgcaagcttccctcgggactgcagccaccctccacatcattttgccagtgcacatgtatgcaggtagatttttgcattccctgtcctgctagcacatgtgtgcatgtgcactctgccatgcctctgctgctggtggaatgcactccaccccacttcccctaccctactgccattgcagttggagcctttgtgaacacagagcctgccagcctcacccccaccaatgctgtgctcctgcaacaacactgccattagagtgaaactagtatggatgacggtggaaccacccctgcctgctctgagcagccacagagagagcacacagacttgtgcccaccagtgtctcacccccatcaatgtcccacccccctgctaacaccaccaccagtggaaccacaaacacagtcaccaataagggatgtcctcctccagttacgctgtctcccccactgctacgaatgcaatacagaggcaggaaccttggcacccactagcaccctgctgcagtcaatgagtgtgaaccccaccatgctacctctgccactggcacatgtgaacaagaatggatcctgctgccatagccctacaaaatgctttggcacctcccattgatgtttagggaccagtggtccaagagcaccatggcttccccaaccgcccaccgattgtagttggtttctaaccttgaggagccagagaggaaagtcagactcgcaagtcccctagagtttgagggcacagtccaggagatggaagctgagccttgccccactaaaatctcccagaaataaagccaatcaactgaacccaccttataccacaatcaaatcctcaaataaaaataacaaaaaccaatccaaaggacagaaacttcaaagattgaaggaacaccagcctacaaagatgagaaagaacaagcacaagaactctaagtcagaaaggcagagtgccttctttcctgcaaatcactgcactacctctccagcaaagtgttctcaatcaggctgagatgtctgaaattacagtagtatttgaaattgggtaggaatgaagatcactgagaggcagtagtacactgaagcccaatccaaggaagctaagaatcacagtaaaatgatgcatgagttgacagacaaaatggccagtatagaaaagtatgtaaccaacccaatagacgtggaagacacactacaagaatttcataatgcaattgcaagtactatcaagtaataagcaaaatagaccatactgaagaaagaacctcagagctttaagactggctttctgaaataagacagtcagagaagaatagagaaaaaaaaataaaaaggaacaaacaaaacttcagaaaaatatgagattatgtaaagggaccaaatctaagattcattggtgttctcgaaagcgttggggagaatggaatcaacttggaaagcatatttcaggatatcattcataagaacttttacaacctagccagagaggcaaatgtttatattcaggaaatgcagaaaactccagtaagattcttcacaagaagatcatcccgaagacacataatctcagaatctccaaggttaaactggaagaataaatattagtggcagctggagagaaagctcaggtcacttacaaagggaaatccatcatgctaacagtagacctctcagcagaaaccctacaagccagaagagattgaagccaacattcttacagaaaagaaattcgaacccagaatttcatatctggccaaactaagcttcatacatgaaggagaaataaggttattttcacacaagcaaatactgagggaacctgttaccaccaaacctgccttacaactcccaaagaaagaactaaatatagaacggaaacatcattaccatccactacaaaaacacactgaagtacacagaccagtgacactataaagcaaccaaacaagtctacataataaccagctaacatcatgatgacaagatcaaatccacacatatcaatactcatcttggatgtaaatgggctaaatctcccaattaaagacacagggtagcaagctagattaagaagcaagacccaatgtacggtctcttcaggagacccatctcacaggcaatgacacacaaaggttcaaaattaagggacagagaaaaatctaccaagcaaacagaaaacagaaaaaaagcaggcattgcaatcctaatttcagacaaaacagaatttaaaccaacaaacatcaaaaagaacaaagaagggaattacataatggtaaagggttcaattcaacaagaagagctaactatcctaaatatatatgtactaaatacaagagcaccctgattcataaagcaagttcttagggacctacaaagggacttagattcccacacaataatagtgggagatttcagcacctcactgacagtattagacagctcactgaggcagaaaattaacaaagatatccaggatctaaaatcagcactgaattaaatagacctgacagacatctacagaactctccaccccaaaacaaaggaatatatattctttgattgccacatggtacatattttaaaactgaccacataatcagacataaaacacccctcagcaaatgcaaaagaactgaaattataacaactactctctcagaccacaacaaaatcaaattagaaatcaagactaagaaatgcactcaaaaccatacaattacatggaaattgaataatgtgctcctgaatgactttggggtaaataatgaaattaaggcagaaatcaagaagttctttgaaactaatgggaacaaagatgcaacataccagaatttctgagacaaactaaggcaatgttaaggaaatttatagcactaaatacccacatcaaaaagttagaaagatttcaatttaataacctaacatcaaaactaaaataactagagaatcaacagcaaaccaatcccaaagctagcagaagacaagaaataactaaaatcagagctgaactgaaggaaattaagaaacaaacaaacattcaaaagatcaatgaattggggagttggttttttcagaaatattataaaatagactgctagctagactaataaagagaagatctaaataaataaaattagaaatgacaaaggtgattttaccacggaccccatagaaatacaagtaaccaccagaaaatattgtgaatgcctctatgcacacaaactagaaaatctagaggaaatgggtaaattcttggatacatgtactctgctaagactgaaccgggaataaattgactccctgaacagaccaataacaagctctgaaattgaatcagttataaatagcctaccaaccaaaacaattctcagtgccatatggattcacagccaaattctactagatgtacaaaaaagagctggtatcatttctgctgaaactatttcaaaaaattgaggagggaatcctgcctaactcattctacaaagccaacatcatcttgataccaaaatctcacagagatacaacaaaaaaagaaaacttcaggccaatacccttcatgaacattgatgcaaaaatcctcaacaaaatactagcaaaccaaatccagcagctcatcaaaaagcttatccgtcatgatcaagtaggcgttatctctgggctgcaaggttggttcaagggatgcaaaccaataaacatgatgagccacataaacagaactaaagccaaaaaccacatgattatttcaatagatgcagaaaagtctcaaaaaatgcaatactgcttcatgttaaaaaacccttaataaactagttattgaaggaacataaaacaataagagtcatctatgacaaacccacagccaacaccatactgactgggtaaaagctggaagcatttgctttgaaaatcagcacaagatgaggatgccctctctcaccactcctattcaccatagtattcgaagtcctggccagagaaatcgggcaacagaaagaaataaagggcatccaagtaggaagagaggaagtcaaactatccctgtgtacagattatatgattctatacctagaaaaccccatagtcttggcccaacagctccttaagctgataaacaacttcatcaaaattttaggctacaaaaccaacattaaaatgttcactagtattcctaaacaccaacaaccatcaaaccaagagccaaatcagaaagacattcccattcacaacttctcccttaaaaataaaataactaggaatacagctaaccaggaatgtgaaagatctctacaaggagaattacaaaacactgctcaaagaaatcagagatgacacaaacaaatgaaaaatcattccatgttgatgaataagaagaatcaacatcattaaaatgaccagactgtccaaagtaatttatagattcaatgctattcctatcaaactatcaatgatactcttcacagaactagaaaaaactattttaaaattcatctggaaccaaaaaaaggttccgaatagccaagacaattccaagcaaaaggaacaaagccagagacatcacactacctgacttccagctatactacaggactacagtaaccaaaaaagcatggtactggtacacagacacatagatcaacagaacataatagaggacccagaaataatgccacacttacaaccatctgatctttgagaaagctgaaaaaaagtaatggagaaaggaccctctattcaatgaatggtactgggatagctggctagccatatgcagaagattcaaactgttcccctttctcaagccatatacaaaaatcaactcaagatggattaaatacttaaatgtaaaaccccaaaaaccttggaatacaacctaggtaataccattctggacataggaatgagcaaagattttatgacaaagacaccagaagcaattgcaacaaaatcaaaaactgagaaatgagatctaattaaacttaagagcttctgcacagcaaaagaaactatcaacagagtaaaccaataaccaacagaatgggagaaaatttttgcaaactgtgcatctgacaaaggtctaatatccagcatctataaggaacttaaatctacaagtaaaaagcaaacaaccccattaaaatgtggacaaagtacatgaacacttttcaaaataatacatatttgcagccaacaagcataagaaaaaacattcagtgtcactgatcattagagaagtgcaagtcaaaaccacaatgagataccatctcacaccactcagaatgtattattaaaaagtcaaaaaataaaagatgctggcaaggttccttagaaaaggggaaacttatacactgttgatgggtgtgtaaactagttcaactattgtggaaagcagtgtggtacctcctcaaagagctgaaagcagaagtgtcatttgaccaagcaatttcattacttggtatatattcaaatgaatataaattgttctatcataaagacacatgcacatataagttattcataatagtaaagacatggagtcaacctaaatggccatcagtagtaggtagactggtaaagaaaacatagtacatgtgcaccatggagtactatgcagtcataaaaaagaatgaggtcatgtcttttgcacgaacatgtaatggactggaggtcattatccttagccaactaacacaggaacagaaaaccaaatactgcatgttctcaattacaagtgggagctaactgatgagaacatgtggacacatagaggagaataacagacgtgggagactaccaggggttggagcgggaaaggagggagaggatcaggaaaaataactgatgagtactaggtttaacacctgggtgacaaaataatttgtacaacaaacccccatgacacgagtttacctatatagcaaacctgcacatgtacccctgaacctaaaataaaagtttaaaaagtgagggagatattaagacattctaagacaagtagaagctggaagaattaattagcactaaatcttttatacatgaaataggccttgagggagtctgtagggttaaattaagggacactagataataactcaaagccataagaagacataacaatgtcactgaaggtaaatatgtccacagtcataaaaattactaccattgtaacaatggtttacaatgccacttcttgttttctacatgactaaattacataatcaaacactaaaattattagtttaaagctaggattaactttggttagtaaatccacattttattttcctcataatttataagacaaatgtgtttaaagtattattagcatatgtgtttgggctcacaatgtgtaaaattgtaatggtaaaatcaacagctcaaaggcgtgaggacagagttgttaaaagaacagaatctctatatgttattaaagttattaaagttaaacaggtataaattcaaattacagtgttaaaagtataaggtgttagatgtaatccccatggtaaccacaaataagatagctatagagtatctacaaaaataaaatttgtcacgataaaaaatcagataaacccaaaggaagttattaatgcagaaaatgagggcatatagaaaagaaaaagcaaaatgacagaaatgtcactccttatcatttattgccttaaatgtaaataatttatccaattaaaggacagagattggcagaatgaacaaaacaattgatccaaatctgtgttgtctaccagagacccactgagattcaaaggtacaaatagactgaaagtgaaagaatgaaaaaagatacgccatgcaaatacaaaccaaaagacagaaaatattattatattactgttagaaaaaagagactttaaatttgaaagtgtcacatgagacaagaagggcatcacatattgagaaaatatgttcaatacaacaagaagatataaacatctacatacacaagaacagacaatcaaaatatatgaagcaaaaatgaacagatttaaagagagaatagtcctatcataacggttgcagacttcaacacctcattctcaataatgattacaacaacaagacaaaagataaggaaggaaataaagacaacacaataaaccaactagatgtaacagacatatacagaagaacactctaccaaacaacacaacatagacattgtttttatgtgcatatgggacattttccagaataaaatacacatattttaccacaaattaagtctcaatagatttttttatagatgtcatacaaagttattttctctgactacaaaagagtgaaattagaaatcagtaacaggtgtaaaaatggaaaacttacaaaattgtgggaaataaataaccattcttagacaatacatgaatcaaaaaaacaaatcacaggggaaattggaaaatacttaaagatgaatgaaagtgaaaacacaatataccaaaaattatgggatgcagcaaaagcagtgccaaggaggaaatttatagctataaacacttatattaaaaaattagaaaaattcaaatcagcaacctaactttaagatactagaataaaaacaaactaaacccaaagatagaagaaggaaggaaataatgaagattagagcacatataacttaaatagaaaagtaatagagactagaaagattatagagaaaatcaataaaaccaaacttggttttttcaaaagatcaacaaaattgataacttttaggtagatggacaaacaaaaggggagaagactcaattactaaagttagaaataaaagtggagacatgatgaaaaattctagggaaataaaaaggattataaagagtattatgaataattgtacagtaacaatttgataacctagatgaaatgaacaaattcttacaaacacacaaaacctccaagactaaatcataaagaaatagaatatctgaatagacctgtaagtagtaaggatattgagtctgtaagcaaaatgtctcccaaaaaagaaaaaccctgggaatcaaaaaaatctccctacaaagaaaagccctgggtctgatagcttcatgagtgaattctaccaactgtttaaggaaaaactaacaccaatacttctcaaattttcctaaaattaatatggaatttcaagtgagctcaaatagccaagacaatttgaaaaaaaaaaaaaaaaaaaacaaagtggaaggactcacactttccaatttaaaacttactacaaagccatagtaatcgtaacagtgtggttttagcatctagattaatggaatagaacagagagcctagaaacaatccttcacatatacagtcaaatggtttttgagaagggtgtcaagaccattcttgagaagggaaaatggcagtcttcaacaaatgatgcttggataactggatatccacacacaaaataataaggttgaacccttacctaacaccatatgcaaaaattgactcaagtggatgaaagacctaaatataattcttaaattatacaactcaaagaaaaaaaaacttaatgaaaatgcttcatggcattgtatttgggaatgatttgttggatataacatcaaaggcacaggcacaacaacaaaaaatagacaaatttgacttcaggaatatgttttaaaattgtgtatacaaagacactatcaacagaataaaaaggaaacacacagaatgggagaaaatgtttgcaacttatatatataagggacttatatccagaaaatatagagaagtcctaaaactcaacaacaaaatcactctgattcaaaaaaaggcaaagaacttgaatagagatttacccaaagaaggtatctgaatggtccatacacacatgaaaagatgctcatggataggaagaatcaatattattaaaatggccatattgcccaaagcaattagtagattaaaatgtcattcctatcaaactaccaatgatattcttgacatgactagataaaactattttataatttctatgaagccacaaaggagctcaaatagctaaggcaatcctcagcaagaagtacaaagctggaggcatcacattacctgacttcaaactatactacggggctcccataaccaaaatggcacggtactggtacacaaacagacaaatagacaaatggaatggaatagagagcccagaaataatgtcacacacctacaactatcagatcattgacaaacctagcaaaaagaagcaatggggaatgaactctattcacttaatggtactgggatagctggctagccatatgcagaagattgaaactagaaccctactttacaccacacacaaaaatcaaatcaaaatggatcaaagacttcaatgtaaaatccaaaactataaaaatcctggaagataacctaggcaatcgcattctggacataggaccaggcaaagatttcatgaccaaagataccaaaagcaattgcaacagaaacaaaaattgacaattctagttaaactaaatagcatctacagagcaaaaggaactatcaacagagtaaacagacaacctacagaatggaagaaaatatttgcaaactatgtatctgacaaaggtctaatatccggtatctacaaggaagttaaacaaattcacaagcaaaaaccaaacaaccccattaaaaaatgggcaaaggatgtgaacagatatttttcaaaagacatacatgtgaccaactagtatatgagaatatcctcaacatcactaatcgttagaaaaatgcaaataaaaaactcagtgagatgccatctcaccccagtcagaatggctatttaatttttttctcttgtttgatacagctggagtgcagtgtcataatcacagttcacttcaaccccatcttcagcctcccagtatgctgggattagagacctgagccattgttcctggccgagaatggctattatgtaaaattcaaaaaataaaagatgctggtgaagttgcagagaaaagggaacacatatacactactagtgggagtgtaattcagccattgtgaaaagcggtgtgtcaattcctcaaataactaaaacagaattgctatttgatccagaaatcgcattattaggcatatcctcaaaagaatgtaaattttctaccataaaaacacatgtatgtgtatattcattgcagcactattcacaatagcaaagacgtgaaatcaacctcaatgcccaccaatggtcgactggataaagaaaatgtggtacatgtacaccatggaatactatgcagccatacaaaagaataagataatgtcctttgcatcaacatgtgtgaagctggaggtcattatcctaagcaaagtaatacaggagcagaaaaccaaatactgcatgttctcacttgcaagtgtgagctaaacaacaagaacacatggatactaggaggcgaacaacggacattgggacctacttgagggtggatggtaggaggagggagaggatcagaataaatacctattggatcctatgcttattacctgagtggcaaaataatctgtgcaccaaatccctgtaagacccagtttacctatattaacaaacctgcacatgtaccccagaacctaaaaaaaaattaaagatgcttagcataattaatcattagggacattcaaatcaaaactatgagataccaccttacacccaataggatagcaacactataaaaagaaaaaagtaataacaagtgttggtaagaatgtagggaaattggaaccctcgtatgctgtttatagaagtataaaacagtatagctgctgtggcaaacagtatgatgggtccttaaaaaattagaaatataatttccatatgatccagaaatttcacttctgggtacatacccaaaacgttgaaaacaaggtatcaaagagataatgtttacacccatgttcaaagtgtattatttgccacagttaaaatgtgaaagcaaccccagtgcccactgatggatggacggatggataagaaaacataatatatgcatacaatgaaatattattcaaccttaaaaagaaggaatttctttcatagctataacatggatgactttgaggagataatgttaaatgaagtaatccaatcacagaaaagacaaatgatgtataattccatttatattaggtactttgagtagtcaaaattataaagacagaaagtagaatggtggttaccagacgctggtgggaggagagaatggatagttactgtttaataggtatagaggttcacttttacaagataaaaagagttatggggatagatggtggtaaggtttgcacaacattatgaatttaataccagtgaaccatacacttaacaatgttgaatatgatccatttttgttatatgtatgaaccacctataaaaattgaaaaaaaaaagagataatttaaaaatagccacacctgaaaggtcatcacactggtccttatatgaaagagacaagagagtgaatggggagagagatgggatgacagaagttggcatgatgtgaagaaaaggccacgtgaaggggtgatgaggagttattgaagatggaccaaaggatacagacagcctctggaagctgaaaaaggcaagaaaaaagatttccctctgaaggctccagaaggtgtgtagcccagatgacaccttcactttatacactggacctccagaaatgtaacagaataaaattttgttgttttatgcttcccttcaaacctccatgaataaaatagcctcaccaaggagttgctggcctaagttaactttagaaatgaatggaatctgtaagactaggctaaagaaactgcatgttaagtactgcgctctagtcaataaatttgtttcccatagggatatggggtaacaattctgattctgatatataaatattccttaagcaaggaagcaaatgaatagctcatggtggcagccaggttttccacttctggagtgggaatttgtggattggcatggtgaggagatgagattgatccatatggtaattgtttagacttggagacaacaataagaactcatgttcaacttaatatagatatagatcgttacatgtagagatatttatggacttgtgtatatacacaggtcattatacacacatttatttctttgttttgccaactgttaagtgtctaaaagaaatggcactagagcagtaatgagtatatgcaacacccagatccagatcttgatttctattattattttccaaagaaagtaaccagtgttgcttggagaaatggctggttcaggtgcaggaaatataaaagatgagcctggagcatgttgtggttccattgggtaaggaagccctcacaaagcaacaataacagcaacagcaagaacaaaatacattgatggcagtatgtcaaaaaggcacaagaatcaactgaaagaactcctagtggacaaagattgacaatttgagcagcaaaatagtgctggattttaattctaagattaacatctgcaagtccagactgatgtgaataaaaaatcgaataaattaataagtggaggacaataatcaacgatgcaaaagaattccaaataaattatgtaaatgcttcatcctaaaggagggagagcaaaactctccactgttaagtatgagctgtgcaaagggacttccttctaaagagtaaagtatggaagtggggaggagatagtaaatttacagcagagtaacctggcacacactacttcagtcaggtgatcaaggtcaataccaacagttataaatcatgttgatagtatacaccctggatatgatgtgattaaaatagtactttacctctgtgatctacctctctaaaacccataaccctaatttacccatgagacaaatctcaatttggagacattctaaaaaatgcctgacctatactcatcaaaactttcaaagtaattgaaagcaaataaggtatgaaaaactgttacagccaagaggagcctaaggagtccagataactacatgtaatatggtatactggatgcgaccccagaacagaaaaagggcattagataaaaacaaagggaatcttaataaactatggacttcttaataaatattctcttactaaataattatgtattgatattgtttcattaattttaacaaatatactacactaatgtaatgtgttaataataaactctgtgtatgtcagaggaaagagaggtaatgtaggaattctttgtactatatgctcaattttttagtgaatctaaaacttctcttaaaaatgaagttgattcatagaaaatcaattgaacaaatgttgcttttggttaattgatgatataactaaatagttcctgttttaaccttgtggaaagcagaaattgttggcttggttatatatttgatttattactatgtgatggatggtatgtgtcaccaaaactgaacagaattttatcacatgaaaggagtaacaggaatatgcttccagaaaagaatgtattcttgacagaaattgataggggttacattttgggggcatctaatgatttaaatcttttatgacacatgtattactagaatttgtcagaacgttaatctaagtacaatcatgtgataatgtattcggtttgaaacagaataacaaaggggcatttgtcacttagcgtcagaatggattcctggacagatatgaccatattgccactcagcagtagccaagaaatttaaatgacttttcctcattttttagtcacttaaatcagacatgtatcccttactacatggcaaaccatgtgcttaagaaaaataatacttgataaaatcagaaaacaaacatcttaatatgtagctaatagcatagacagacaaggaaatatttttagagatcacctagccctggcctgtcgagtatggtagcttctagccccttgaatgtggctagcaggaattaagacatgcttgtattagggttctccagaaggatagaactaataggatatatgtatatatgaaaggaagtttattaaggagaatgggcccagacgatcacaaggtaaagtcccacaataggccatatgcaagctgaggaaaaaagaaggcaggaggggctcagtctaagtccaacagcctaaaagtacggaaactgacaatggagccttcattccacggctgaaggcccaagagtccctagcaacccactggtgtaagtgcaggagtccaaaggctgaaaaacctggagtctgatgttcaagggcaagaggaacagatgggagcatgtagcatgggagaaagatgaaagccagaagacagcaagcaagcttctcccaccttcttctgcctgctttgttctaatgggcgctggatggtgcccatccacattgagggtcttcctctccagtccactgactcaaacgttaatctcctctggcaacaccctcacagacatacccagaaacaatacttacagctatctaggcatccttcaatccaatcaaggtaacagctaacattaataatcacaattatgtgagtgtgaaatacactcatggttttgaagacttagtaccaaaagagaaagcaaaatagctcaataatttttatataatcggcatacagaaaagtttcatctccctgaacatctccctccattcccatggcaatcactggtttgttctccctcactatggttttgtctttttgagaatgtcataaacatgaaatcatgtagtttgtaacctttggagactgacttcttttactcagcatactgcccttgagttgcttcatgtatcaacgcttatcaatcttttttttttttaactgagcagtattatgtgtggatattccactgtttattcacccattgaaggacattttgttttgttttacttactgtatcttgaaactcttaacattttattttaaacataaagatatctattgaaacattattattgctcttagtttaaattcaggactaatatgtgattggtaaaaacaaaaatgaaagcaaaaaaatgtaaaagagaagaaacaaaatgtgggttcactcctctgaccctcaaatacacatgaaggcagtaagaagctcttaaccgttttctttgcctcattgcagacttgctttatttcttacattcctttttgaaaactcttttaaatatcaatcatgtactttttttattttttttttactatctggccctttatttatttttattcattttttattttattgtactttaagttctagagtacatgtgcacaatgtgcaggtttgacacataggtatacatgtgccatgttgctttgctgcacccatcaactcatcatttacattaggtagttctcctaatgctatttctcccccagccccccatacccctacaggcctcagtgtgtgatgttccccgcgctgtgtccaagtgatctcactgttcaattcccacctatgagtgagaacatgcggtgtttggttttctgtccgagcgatagtttgctgagaatgatggtttccagcttcatccatgtccctacaaaggacatgaactcatccttttttatggctgcatagtattccatggtgtatatgtgacacattttcttaatccagtctatcattgatggacatttgggttggttccaagtctttgctattgtgaatggtgccgcaataaacatatgtgtgcatgtgtctttatagcagcatgatttataatcctttgggtatatacccagtaatgggattgctgggtcaaatgataactctagttctagatccttgaggaatcaccacactgtcttccacaatggtggaactaatttacactcccaccaacagtgtaaaagcattcctatttctccacatcctctccagcacctgttgtttcctgactttttaatgattgccattctaactggcatgagatggtatctcattgtggttttgatttgcatttctctgatggccagtgatgatgagcattttttcatgtgtctgttggctgcatagatgtcttcttttgagaagtgtctgtctgttcatatcctttgtccactttttgatgtggctgttttttttcttgtaaatttgtttgagttctttgtagattctggatattagcccttcgtcaggtgggtagattgcaaaaattttctcctattctgtaggttgcctgttcactctgatgatagtttcttttgtcatgcagaagctctttagtttaattagatgccatttgtctattttggcttttgttgccattgcttttggtgttttagtcatgaaacccttgcccatgcctatgtcctgaatggtaatgcctaggttttcttctagggtttttatggttttaggtctaacatttatgtctttaatccatcttgaattaatttttgtataaggtgtaaggaagggatccagtttcagctttctacatatggctagccagctttcccagcaccatttattaaatagggaatcctttccccatttcttgtttttatcaggtttgtcaaaaatcagatggttgtagatgtatggtattatttctgaggcctctattctgttccattggtctatacatctgttttggtaccagtaccatgctgttttggttactgtagccttgtaatatactttgaagtcaggtagcatgatgcctctagctttgttctttttgcttagtattatcttggcaatgaaggctcttttttggttccatatgaactttaaagtagtttcttccaattctgtgaagaaagtcattggaagcttgatggggatggcattgaatctataaattactttgggcagtatggcaattttcacaatattgatttttcctatccatgagcatggaaagtttctccatttgttcatgtcctcttttatttcattgagcagtggtttgtagttttccttgaggaggtccttcacatcccttgtaagttggattcctaggcattttattccctttgtagcaactgtgaatgggagttcacacatgatttggctctctgtttgtcttcatggtgtaggggaatgctgtgatttttgcacattgattttgtatcctgagactttgctgaagttgcttatcagcttaaggagattttgggctgagacaatagggttttctaaacatacaatcatgtcatctgcaaacaggaacaatttgacttcctcatttcctaattgaataccctttatttctttctcttgcctgattgccctggccagaacttccaacaccatgctgaataggagtggtgagagagggcatccctgtcttatgtcggttttcaaagggaatgcttacagtttttgctcattcagtatgacattggctgtgggtttgtcataaatagctcttattattttgagatacgttccatcaatacctagtttactgagagtttttagcctgaagggctgttgaattttgatgaaggtcttttctgcatctattgagataatcatgtggtttttgtccttggttctgttcatgtgatggattaggtttattgcgtatgttgaagcagccttgcatctcagggatgaagccaacttgatcgtggtggataagctttttgatgtgctgctggattcagtttgccagtattttattgaggatttttgcattgatgttcatcagggatattggtctaaaattctcttttgttgttgtgtctctgccaggctttggtatcaggatgatgctggcctcataaaatgagttagttagggaggattccctctttttctattgattggaatagtttcagaaggaatggtaccagctcctcattgtagaattcggctgtgaatccttctggtcctggactttttttggttggtaggctattcattattgcctcaatttctgagcctgttattggtctattcagagattcaacttcttcctggtttagtcttgggagcgtgtatgcgtccaggaatttatccatttcttctagattttctagtttatttgcatagaggggtttatagtattctctgatggtagtttgtatttctgtgggatcagtggtgatatcccctttatcattttttattgcatctatttgattcttctcttttctcctttacttgtcttcctagcagtctatcaattttgttgatcttttcaaaaaaccggctcctgcattcattgattttttgaagggtttttttgcgtgtctatctccttcagttctgctctgatcttagttatttcttgccttctgctagcttttgaatgtgtttgctcttgcttctctagttcttttaattgtgatgttagggtgtcaattttagatctttcctgctttctcttgtgggcatttagtgctataaatttccctctacatactgcattaaatgtgtcccagagattctggtatgttgtgtctttgttctcattggtttcaaagaacatctttatttttgccttcatttcgttatttacccagtagtcattcaggagcaagttgttcagtttccatgtagttgagcagttttgagtgagtttattaatcctgagtactaatttgattgcactgtggtctgagagacagtttgttgtgatttctgcttttttacatttgctgaggagtgatttacttccaattatgtggtcaatcttagaataagtgcaatgtgttgctgagaagactgtgtattcagttgatttcgggtagagagttctgtagatgtctattaggtctgcttgtttcagagctgagttcaggtcctggatatccttgttaaccttctgtcttgttgatctgtctaatattgacagtggggtgttaaagtctcccattatcattgtgtgggagtctaagtctctttctaggtctctaaggacttgctttatgaatctgggtgctcctgtattgggtgcatatatatttaggatagttagctcttcttgttgaattgatccctttaccattatgtaatggccttctttgtctcctttgatctttgtgggtttaaagtctgttttatcatagaataggattgcaacccctgttttttttgctttccatttgtttggtagatcttcctccatccctttattttgagcctgtgtgtgtctttgcatgtgagatgggtctcctgcctacagcacactgatgggtcttgactctatccaatttgacagtctgtatcttttaattggggcatttagaccatttacatttaaggttaatattgttatatgtgaatttggtctggtcattatgatgctagctggtttattttgcccattaattgatgcagtttcttcatagcatcgatggtctttacaatttggcacatttttgcagtggcttgtactggttgtttctttccatgtttagtgcttcctgcgggagctcttgtaacgcaggcctggtggtgacaatatctctcagcatttgcttctctgtagaggattttatttctccttcacttatgaagcttagtttggctggatattaaattccgggttgaaaattcttttctttaagaatgttgaatattggcccccactctcttctggcttgtagggtttctgctgagagatctgctgttagtctgatgggcttccctttgtgggtaacttgacctttctctctgtctgcccttaacactttttccttcatttcaaccttggcaaatctgacaattatgtgtcttggggttgctcttcttgaggagaatatttgtggtgttctctgtatttcttgaatttgaatgttgtcctgccttgctaggttggggaagttctcctggataatatcctgaagagtgttttccaacttggttccattctccccctcactttcaggtacaccaatcaaacgtagatttggtcttttcacatagtcccatagttcttggaggctttgttcatttctttttactccttctctaaccttgtcttctcgctttatttcattaatttgatcttcaatcattgataccgtttcttccacctgattgaatcagctattgaagcttatgcatgcatcacgtagttctcatgccatggtttccagctccatcaggtcatttaaggtcttctctatgctgtttattctagctagccattcatcttatcttttttcaaggtttttagcttccttgcagtgggttcagcatccttctttagcttggagaaatttgttattaccaaccttctgcagcctacttctgtcaaatcgtcaaagtcattctatgtccagctttgttccattgctggcaaggagctgcaatcctttggagaaggggcactctgatttttagaattttcagcttttctgctccagtttctccccatctttgtggttttatctacctttggtctttgatgttggtgacctacagatggggtttggtgtagattacctttttgttgatgttgatgctatttctttgtgtttgttagttttccttctaacagtcaggtccctcagctgcaggtcagttggagtttgctggagtttcactccataccccatttgcctgggtatcaccagtggaggctgcagaacagagaatattgcagaacagcaaatattgctgcctgatccttcctctggaagcttcgtttcagaggagcagccacctatatgaggtacctgtcggcccctacttggagatatctcccagttaggctacacaggggtcagggacccacttaaggaggcagtctgtccattctcagagctcaaatgccatgctaggagaacaccgctctcttcagagctgtcagacagggacgtttaagtctgcagaaattgtctgctgccttttgttcagctatgccctgcccaccgagatggagtctagaggcagtaggccttgttgacctgtgatgggctccgcccatttggagcttccttggccactctgtttacctactcaagcctcatcaatggcgacacccctcccccagccaggctacagcctggcagagtgatctcagactgatgtgctagcagggagcaaggctccatgggcgtgcgacctgcttagccaggcatgggagagaatcaccttgtctgccggttgttaagaccttgggaaaagcacagtattttggcaggagtgtcccgtttttccacatagtctgtcacggcttccctttgctaggaaagggaaatcccccaaccccttgcgcttcccaggtgaggtgatgccccaccctgctttggctcaccctctgtgggctgcacccactgtccaaccagtcccagtgagatcaaccaggcacttcagttggaaatgcagaaatcacccgtcttctgcatcgatcacattaggagatgcagactggagctgttcctatttggccatcttggaatgcccactgctcttcatttttatgttgttattaaaatacttaaaactatgaattggcttatatttgagtcctctcacactatagttttattagacaacattggtctagtctaagttgctttttatgtaaagaaagaacctatggcccagagaacttatgatcagtgccaggtcctgtctttaagtgatctggatatttttaaacaaaaatgtttctctatttaactggggagaagagttttttcaagttatctatcactaagaaaattttcacttaggcttcatgaagttcaaatacattttacataacattttcactgttttctactcaaggaagatcttggcctactgcccttctgggttaaataaaatgagctaccatttattgagtgcttatgccatgtagaccagtgctgcaatttgtataataaatagcttacataatttattattgagtttaattctcacaaaaatcttttatagatgaagaacctgatgctcagagagcaatttgcttaagcaaccacattaatcagaatgtggtaaacatagtatttaaatggggttcttgttctaaagcttgtgttctctccactgttctcaactgcttctgaacacatgaagttatttgtgtaagctgctacagctgtcaataggaaccctgtaaggattatttagcctttcacagctgtttgggattagtaagaagttgatattccttcaattcttcatctggcagaacctagcatggtaatatttgctctaaagaaaataagaatctctcatatttttttcctctggtgcctggaatacatcagactccgctgggtttagaggatcatactgcaacagaagttaaggaggaaggagcaccgtcgagtctagataagtgctcagttttcctgctgtttagcaaacccccaattatctgaaaatttcaataacagaatttttttctgtgctctttcagaaacaagaggaaatgacatcaaagttttctaatttcagaattaaagaaattaatatactcacacacacaccctcatacccacccacgcacagagctatacaggagattcatcacccttggagctgctgctcctcctcctaagttctatattgcagctaaaatttttccttatttggattcttagtcaccgaaaagcaaacaccagaaatcatctgattcaaatgatccattttcacctcgtacatcaacactgttgctaaggtcggtgaattccaactccatgatgtttcttgcatccttcccttgttctttgtcatggcaactgccctagtcactggtcccattcctttttcctggattagtgccccatctccctcttgttcactatgttccagtcattttgtttttctttaatctcctcagaatccagagctatgccctgtgcctggaatgttctccccatgccctctttggctaagtctgactaatttttcagatctcaactcttctgcagaatcccttcctgacctgcacagatgagggaggtcttcttttaataggctctcatggtatcctgttttccttgtggcacttacaatgataacaattaattgtacaatcatatccttaatagctgtcttccctgctggaatgcccttaaatattatgctgggctgctttatactacactgtgctgcttttttctaataaacaatttcctgtattacttccattggggcatctttgaaaatttctaaaatatttataaatgcaacaagtgcttattcatttatttctaactcccattatagatggttgagaacatgagtttatagtcatgacttaacactcctcttcttagcctccctatataaggctgatcaagctgccgttacgttttatgatgttgggagagtaccttagcttgtgggtgagtcaatcttctcaactgaaaaatggggataataatagtactgaacacttcagagctttacagataaaagtaaatcaggtaatattcagatgaaagttaattcagataatatatttgagggtacaaacaaaatgtccatgaaagttggcaagtattaatttacatttcaggggtatctgtatatttatttattcattatttttattaaaaaatgttgtaaagatgggggtctcactatgttgcccaggctggtctcaaacttctggccccctacatcagcctcccaaagtgctggaattacagtcacgagccaccatgccagaccctgtatatttttcctattgaaaaagtgttcagtataacttctcagaagcaaattccaattaccaaggggaacagctctcaagtgtgagacaaatttgcatcctcctttgatctattcatacatttcatttctgtagtcattaaacatggctttttttttccactaagaaatctttaaacttattgaaaataacctcaggctgatcctagtctttcttagtaactgtacatatggcatatagagctggaaaaacacataaattagacaatagagaagcaaccaagctgtgttttatatatatacatatatatgtatatatatatatatatatatgtatatatttggtgtatccttttgtgcagaggcttattttgaagagcatgtgggagaggaagtgtttaagaaaataagaatgaagggaaagagaaaattcaacatctgtaagacgcatgtatgtgattatcataactgggcatgtctgactctaaagagtattaaaatatgctctgagaatcagcagcaaagaactggaaacactacataaatggagatggacctcacaagatacattcaagcatcctaattatacaggtacacatctttcatttgttcaaagatatattcaggacccaaactactgtattcagacctctatgcccatatttatgtctggatgtacacttaaaggaggcaaaggcacggtgcagtactttgctcagaatttccaggcaggctgattgtcctggctatgattccagtcatcataaatacatttgattctcacaaatggttccctggttgcatccagcaggtccatttgtaaggcaagtagttagcttgttctgctgctctgtgactttttgaagagttcctgcattcctgctaagcatgaacaaagcaggaagacattaatgtgctgaccacaatctcctctggccacctcagggaaactagcatcatggattaaatcatttctttgctaaatgacacctgttgaaactgacaagccaacaaagctgagatcccatgctgagcagaagaattacaagcaatggggctgcccacagcattgctgcatgacagtgggtgactgagaatcacattaacacagtagtgaattcacacacttgatttccaagcattcctcacatgctatccttcttgggtgtaaattttgcatttattcattgaaaagtattgtgattcataaaattataatttttattataatttggattctctacagactttgttactgtattgcatggtatttattaatatgtatattattaaatctaatttttttacaaaagcttttaaaacatgaatttctaataagaaaatgacaattcttctagaagtagcagtgataataataacaataataataataattgctgtattagtctgttttcacactgctgataaagatgtacttgagactgggcaatttacaaaagaaataggtgtaatggacttacagttccacgtgtctagggaagcctcacaataatggcagaaagcaaggaggagcaagtcacatcttacatgggtgacagcaggcgaaaagagagcttgtgcagggaaactcccatttttaaaaccatcagatcccataagacttattcactgtcacaagaaaagcatagcaaagacctgcccttgtgattcaatcacctcccacggggtcccttccacaacacatgggaattcatgatgagatttgggtggggacacagtcaaaccatatcaatgggtaacttttactaattgcatatttttttgacataaacttccatatcaccttatatatattggcttatttaagattgtccctgttataaatgaagctttaagtctctgttctttgaaaattggaaagctttaggtttcaccatgttatggaagaaaaattgtctctgtgaatataattcccaaataattaaaatatcaattcacatggtccaaagctgacgggttgttgttctggcaggtttcagaggaaacatcaatagtgataatggctgaactcattcatggaccactcactatatatgccaagccgagtgctaagcccttcacagatattatttacttttatcccggcaacaaatgtattagttaaaaattaatattgtttccttctgacagatgacaattgaagtttggagattaagctatttgctaaggatcaccatgctagattgtggcaaaactagatccagaactaaagtccgcctgacttaaaggctggactctacattactgtgctaactggtggtatttaaatcaattatttcctaaacattttgtttgtgtctacacttttaaaagggagagaaaacattttcccataatcttaggggtttaactatcccctcttacagtaattttgggacatcttcaaatcaaactcaacataaaggacttgtgttcaaatgatttatgaattatagtcagacctgaatctttagaatcctgtaaacaatcaaacactaaattttgggtatcttcctcactgtccatatacattatcattgaacttctgtgaaataatattttatcactctagatgttatttatcacatacaagatggctatttaaaattttacaggcactagcacactaaaaagaaacaaataataatgcaggtaggtaggtgtgtcagagctgtaattggaataaatgcaacgacaagggaaacaatagaagcaaatgtcatagtttgagcagcaaccatattgtatagttaggtctattaaacaataaccatgattttccaagagtttcacttttaattcaaatgttttgttttctccctctctctctctggaaaatgaaggcaactctacccatactcatcttggatgctagaacatccatgtgactgaggcacagatgatatatgaatgactcaaaagggcacttctgtgtcttacttttttgtatgcacttagaaaacatcttagcattagttctcttatgaaaatgaatgaaaatacctacttttcagggttttaggaggattatataggttagtacctgcaaagcatctatacactggcacataggaaacattccatcttttgatcccataaatctgctagcagtgagtccttctgtacaaagaagaaaaaataattccccattatcagtggagtactgatgacagcctcataccagcttataggagccgattacattaatttcttcccagcttctaatgatgctaaaaattaagctcaatttttatacatttaccactataccaccatggccataatttatcttccatattctgtcctctaggaaatcttttagtagcaggtaggttagaaaataactactggaaataaaacaagcatgtatcttgtttgtgttaggcagcagcctcatattctgctgagatgtcaaagacaatgcaatgtgacctaattatatactgatccattagatgagattttcaatatcttagagtgaaaatctgctagttcagaaataccagtaggaagcacacttttcctattctccacttatgtgcccaccataggaataactgatcaatacactcttctcactgagtttacacatacttctgtgccacatattacactaagtgctttgaatacaaatcatatttaatcatgcaagtaattttctttgataagtatcacccaccacttaatataaaggaataaaataaggctcacaaggctaagtaaaggacctgatgttgaagagctgtgttagagattgactggctagaacacagactgcaaagcctgtgttcttcatcggtgtattctatcccttcccattctattgaataaatactgtgttgtaatgggtagaaattattcattttataaatgaaggtaactgagggattaggaaatgaaggcttttaaaacatgattccataaatgcaggatttcatttctccctatagaattacaaaataaaagcaagtccataaacccgattagcagatacagggctgcccgtctttgggaatgttaatctctggtcacatgttgcaaatgtttaactgttctatccatcacataatctcttcttgtaaatttatcatgaaatatatttacagctctctatatgacatataaatcatagactaagagctgaatttagccaacattttgaaatcattcccaagagatgttgcggtataaaattttatattcagtttagcacactatgttaacgaacacactaaaaccgcaggacatttcaattactagaattaaacagacctcttaaagtattccaaatgtattctgcagaggcttgtcagtggaggtggagtgtatgggattatctttctatctcaactgaaatgatcccacagtaagcgtttggttacttagtaacattaaaattgcagttaagttcccttacaattagtggccttcaaataaatagttttgagaactaattacatactttggcagaatttcattctttctgttttggtagttattctggtaaatttctaaatgtagtgggcatgatcttcctctccaaatgcttttttacgttttaaagaagaaaggctagtttgtactgaaacttgatttggagatgaatagatcaagaagaaatggacgtaagttgttcaaagaataaattgaaaaagatgaaataaagatttttgtcccattacttatgacctcaaaacatctatagttaaaataattaggcagatgaacaatcatatctaagaatatttgtgtacttacgatgttaaaaacatgatagaagatgatgtattatcctcggagacacaacatcatgcagtcaaagcattcagttctttggcctagttagtcatttctactacaggtatttgcaaattttaggaaaactctgttgtgactgatgaagtgaagcctcaaatttttattgaacattctataattaaagaagttaagaaagagtatccatatgttaccatttttgacatggttagcaacaatagtagtgactatgcaccatttatcttcaggcagggtggaaagtaaactactggaaagaaaacaagctgatacttgatgtgtaagagcactttcctgctttgctcaggttccaaagacaataaatgttacctattcatatattgacacattagataggatgcccattcacttagtgtaaaaatctgctagttcagaactaccaaggggaagcatacattttctgttctctgcttttatactcatgtgtccaagagatatcaaatatttgtcatacactgtgccaggtacatgaatatgacatggtccctagtacaaagagaattgtgatctgagaaatagatgataaacatacaacatagtgaaatggaactatccataagacgtagcagcaggtgatggaggtaacactgggcatgtgttctgaatgtgaataggaatttgataggtaagagtcatttcatctcagctataattttctccaataagtcattgttgacattgctcccttgcaccacccagaatgaatttgaggtggtacctctgagctcaaagaattcttaatgcattgctttgccatgacttgatataattagctaacatcacaaatcctctgaaagcttccaaaagccaaagtgcttatagttcttacattaaccaatctactctctttagctttttgaactcatctctttcaactcatctcagccaactagactctttgctacttgcgcaatgtgtggaacatgttctacttctgagcttttgttcttgctgtgccctcaacctggagagctctttccataggtaccaacatggctccccctgccccatctttaagtcttctcacatatcatcttctcattaaggacattcctgactaccttattttaaaacatcattcccacagacacttttttgatgcccctttcctgctttatttatttttttacgttacatacctttctgtgtctattatctatcccctttcctcgctccacttaaatatgagcttcatgaagacaggggcttctgttcgttttgctaattgctggactctgggacaagaagagcttctggcacataagaggcaatctataaatgtttgtagaatgatttaaaactgaaataatgtatgtattattcagaatacacagtaagtttttataatgtttcagatgccctttgaagatggctgttaggtggaaaagactgacagtatacaagtaaataagtaaataaaatgtactaattacagattgtagttaatagaatgaacaaaacaagcagatatctttatttaaaaatatgatatatgatatgatgtgtgtgtgtgtgtgtgtgtgtgtgtgtgtgtgtgtgtgtgtcttttaaaccaggacaatcagaaaatgcccctctgaagagataagctgagatccgacatccaagcatcactcatttatagagttggtgagcagaggtcagtactattcaaagcagaggatggagtaactgttaaaaaatatccagggcaggaaagaaatgaaatttttttatatcacaaaaattaaaaaggagaggatgtggaagacagtggaatgagcaagggttattggtggaggccacaccatacaaggttgtaggagacatgataaggcatttggatttatttgaagagtttttggaaagtatcaaatgattttaattggggaaatggcatgatttcctatagattttaaagagtcttctcttttaaagatcctgtgtagtgcgtgaataggactgtgacaagaatggaactggaataataggaggctcttatagccatccaggtgagatcccatgatttgggttaagaatattaatgatggtgatgcatggatatgtttaagattgactttaaggatagatcattaggtgttggattgcatttaggaggtaaagaaaagagagagaggaaaaacaagtcttcattttctggctttggtaataaaataatatcatttattgagatagggaatgtagggaaatgaatggggaaaaagggataaaaaagggatagaaatttggtttctttctggatatgttaagtttgaaaggcttatgtgatatccaagtggagatgtcacgtaggcaggtcaatacataggctagatctatgcctgtcttcatcattatacaatgaatttcccaagggaagatattttactgtattcgtccctaggtcagcagttggcaaaatggttgttttataaatgttgccctgaaagactactctctttatatcctgctgggcttaccagctagacacactgggcactctagctttgggaggaacatctccttattcttctttgctccttagatcagaacaggccattgcatataaattgttagctccagaataacttttcaaaaatattttacttcattttgaaaatagacctgacaaaccctttggatataacacaataagctaggtggtgtatttttagaagaaacaaagcagatcaatcataatagtaatattgtaagaggaaatatgaaaaattttagactcagggatcctgagagggattggaaaacagcgggaataaagtcaaaggaagccatgggccatgtgaggtgttaaagcacatggaaaaaaatgggatggtaggaagaatttttatgaacaagcagatcatattgttatccaataattccatttaccaaaagtattgaaattatcattttatattttattccacagggtatatatttcacatgacatctcttctaattgagaacagaaacatagtccaacttggctctaaaagttgtaaggatatattactaaaaatatgttaaaatatttgagatatttagaaatgtgactatctgatggaagtagattaaaacataaatgcttcttaatttccaattctgtttaaagaaactatgctgttttcaaaattctgtcagttgctagggaaactagaaagggggctattaaattgtatatggaaagctattttccaaaatacattaagtggaagatgtgagtagttagataaaacttttcataggcaagaaaacgtgtgaaatcctaggtgaaggatgaacgcctcctcaattgacagtttgatagagattctgtgcctcctttaccatgaaccattgttattttagagggcagcaatgttctcattgtcctcttggggaatgtattcttaaggaaggtgagtaatcctggaagaaaagctaagatctttttggaccaataatgttaatatagttacaggaaagatcactaggctaaaaattaggagaatcgtgttctaaaccagacccagatatgaacttaggaaagctagttcttccctggtctccaattccagcatctggatatgagtgaaataattgttagagttccttttgcctataatcatttaatctgtgagtgacaggtgaatggcaatccacaaagtagaggataatacctttaacaagaaggaaattgtgggtgatgagatcaattgtcaaggtctggaggccaagttccatttaaataacataaaagcaaagaaaaaaaagaaaaaagaaaaaaagaaagagaagaaaactttaagtgaaaatttaagaatgaattatttcggtaaggcttatctgtaagttaatgtacctgctaatatataatgattttcatttttgttataaattgaacattttttgttcaagtacactgtatttagccatttttgatatttttaatactcagagaatttataaacattcctaaaatccttttatgaaccttatcttttagaatgatagaagtctcttgattattcccttgtggtaccatattaaaaatgcaaaggaaattttctaactcctcaaaccacacaccagtggcattccaaagcctacagaatagctagtgaatatgaagttaaccagtccaaatgacctttccttccacttattcttacggtaaattatatgctgtaccaatattaatgtacttgcagcttcctaaaattcaacaaatatttattgaacatctacaatgtacaaggcaaattttttttttctttttttgatatggagtcccactctgttgcccaggctggagggcagtggcgcaatcttagctcactgcaacctctgcctcccgggttcaagcagttttcctgcctcagtctcccaagtagctggcagctgggagattacaggcatgcaacaccacgcctggcaaatttttgtatttttaatagagatgggattttgccatgttggccaggctggccttcaattcctgacttcagatgatccaccctcctcagcctcccaaagtgctgggattacaagcatgaaccactgcacctggctcgtacaagcaacttctaagaattctcccatatcctgtatgctatttttgctctaaatccatattttcttctatctacccattaattcattcataatgtatgagtcatattatttacaaacacagaacatcacacactgcacagtgtttatcaatctctgtgtttgtttttcccatcaaactttgacttgagtaacataattctgtcttgcttgtatttgctgaataagcaaattaatttttaaaaactatgcatgaattaattttaaagatactccataacagcaactttggctggaaatatttgttctatgaaaaattttaccatgtgagtgttacaacttcagatgaagcaggaaactcttcttttttaatatatagaatagtactaggagagaaggtatgataactaatttaaaaaataaatatatgaggctcgatgtatgtgacagatagatcaactctcaggatagtaggagaggacaggatgcctagaatggaagagaaaaagcatgaagtacaaatcaggaataaggacaaggggtagggtatcttaggcaacagaggtaatggtttgaaagtaggaaatatcacgatatactgtagtttggaaaggtaaatctggagcatttaggagtaaaaatgaacacagtagaagataagtttagaaaggaaggcaacggctagcatatgatgggctgcaaatgcaatgacaaataatttgaactttatcttgcaggcaatggggagcctctggaaatttataacagttagaattaaattttagaaagatcactggcagcaatgtggaagatgaattgcaagcacaggagaggaaatggaaacagaaaatactagacaattggaatggtaagaaattacaaaagtctgcaaacagtgacagtgtgaacgcagaggaatgaacacataggaaagaagttaaaccagtagcatgaacaggatttattccttaattaaaatttagggataaagttgtaagagaagattatatctactctcattgttttcaagacttaaaccaggaggacaggaggaagtggcaatggtaagataatgcactggctgggtttgagatgcttacgaaaaatgcactggaaatgtcatataagcagctgaatatgcaggtgaatacgttaggagagaattgtgagttgaaaacatacatttaggaaaacataagatgcttgagaagagcaactttgtcttgtttactctttattctcaactccacacataaagactgaaccttcagcaaatgctgagctgctactgctaatgttgaactgatactatcacccacttccaacctcccttgattagaaaactaatagatgcaagtctcctgacacataataaggatgcaataaatggaaatttcattgataacttgataacttggacaaggacagccctttttgtttctattatatattctagaatataaaatatgaatacatgacaaatgaccaacattacaatatatactgaagtatatggggcaagtgctattaaataaaggacatttaaattattttaagatactctatcaatattttaaaagcatacaagtttgtggcataatcagtattgaaatgaaatcaattctaaatcatgtttgacttctagttagaggtttatattctttcatttaatcagtgtttaccttgtattctgtaaattcatttggttttcactgggcttttatgtcattaatttcttatttaataatttgtaacatcccattttagcttagctgaaaaaagagtaaaatggattttatggcattgatcagtgtactacctaggtcaatgtaaaagctaggtagtagaacatgttttgaaaccaaagcaagttgggagagcatgttagtcagaatatggaatcccaggaataagactcactctttaggttatttcatctcagcacccaattttattaccaacaacctagttttttaaaaaaatattgtagtggcattagaaagttgggctttacactaaaatcaatagccctgttttcttagtaggggcctgaaaatatctcatagatattattgctctagaaagagtccatttcatgcacagatgagtctgcatgtatgaatcttacctgggcaatatcagttatgaggaacttaggacatttattctattgttctaatttgggctatttataggccagaattagcatctttggtgcccaatctctaaatagaaaaaacaaaaagctaaacatatgtggtaatgtggtgaccaagaaaactactctttttatgggtttccattaacatactgtgttcaaaaagcaaaacatgtttatgacaggactcctattatttctagtatcaaagaaatgacagtaacattacaactaggggatatttctagagattggtctgataaagctccagcttacttctccattgtaaaaaaagttatcttaaagatgggaatttttctatacaactcaatcaatatttagtctgcacatattgtgtgtcccacccaacatactgaggtatttgggaaggggtatgaaaactataagacatggttctgaggtgaaatactgctttttaaattgtcttttcttaaaccaattattagtgtttttttaatgaaattataccataaccatttgtatttacatacgcttagaatatgtgcaagtattattgaaaaatatttaaaaattacaaagttttaaacatgtaagatgggccttgtggcccatgtaagatgggcatgatctatttttgatactatttagagactatttctgatactatttagagtaagacgggccttgtaatatgcatcatcatgatctatttctgatactatttagagtatagcactagccttatgtttatgatcactatgcattcttatagttacagattatacccttctgttcagactcttatctccaaattgatgatatgtattacagagcagttgccacctaactgaataactcatatcaatcctaactgaaagcacaacagcacttaaatatataatctagcccaaacttaaacctaaggtagggatttctataggaacaagaaagcatatatatgaactgtattttttcattgtttcaattaattttaacctgtggtataagctatgtgctttccagatttacacatatataaaaatttgacatataattcgagagaattaatggattttatagtgaacatctaaggactgctaggtatttctggacctcaggtttaaaaacatgggaataactcattgatggtagaaccgtagtatcaatctggcatttaagatatggtatatttttgcatattctgaggaaggttcttctttttataagacacagaaatagaaataatagtattgggaagaattttaattagatctaagaataacattcctaatgtggatataaaaattaagatgtgtttctgggattctcagtaaagcttatattttatgatatagtcattacataattttccagaactataatagtttcagaacaaacctactgggagggccaatacgggagtcaggaagcactcaagaagttaagtaagaaagaaggatctgaaagaagcagggataggttgggaaaggaaacaacagagaagactgttttttttgtttgttcgtttgtttgtttttgtagagacaggtcttgctctgtcaccgtggctaaagtgtagtggtgtgatcacagctcagtgacacttcaacctgctgggctcctgtggtcctcctgtctcagcctcctgagtagctgggactgactacaggcacacaccactatgcctggctaattttatatacagacaaggatctctttatgtttctcaggctggtcttgaattcctggcctaaagcaatctgcctgcctcagcctttagcctcgaaaattgctgggattgaaggtgagagataattaatataatggtttggaatccttaatatacctggaacatgcatgttcttaagcattcccgtccccactattctgcttcaggggaccagcatctctcacctggactagtgcaataacctcctgaatggtctacctgcctctaatgttaccccatgttcaagccactatttgcactaaattaaaatgtttctagtaatatgagttatttcactttcctctgtaacaccattctgtggacactttttgttcttatcaatctgaattatttaccatggcttaaaattccctggcagatctgtgagagtgtagtcagcctgaaaaattgggttacagtcagaccacatactttgaataaattatgtgtttttattttttaaaaaaatattctgttagacatttagaggatgaatcaaggtggaaatactagaggcaaaatgatcagttagaaatctattccagttgacatgttaggaacataaagtaaggtgagtccatgggcatggatgtgaggagcatcatggaggtaagtttaatggaacttgaaaataaagtatatgtatttgatattaaatagcttcaaacctgagcaataaagaagatgatgatgaacgagtgttaaggtgaagcatcatatcctgttactggagggttattatggttactttgtctgcttggataaagaattaggccaaatagtacatttcataataaatcttcctcctagatgggctacacatagcatccaatgttcttcatgagaccagttagtgcaaaaaaatagctaagatagctatggctgtaaagcccagagatctctgatatggtgtgattaccatccttcacgatctattacataagaaagaatttccactgtgtgcctccaatgaaagaccaaaatgcaataagtagaacttacagaaatttcagataagaacaaacaagaatattttaacaatcagagctagaacatgtagaaaaatggtagaattcccattatatgaacatgagactatattgagagggattgagatctccacatgtagaagttctacaaatattagggcatatggaactgaaagggcctttaattcacaagcgagaaagcagtatcccagagaggggcaggcaacttggccaaagttgtacagctggttacagattctgatccagtttcagattcacagcccagtgacctccatgctacataatagtggctacccaaggccaaggagccagtgttgtgactacctcaaagacatcataaaggaaaggcttgaagtggactatgcagttggaagagaagggaaaataagttgaccatgaacaaagatactctactaggatggatcatatactagggaagggcaaatataatagtgaaaggattgctttccatttgaaggtatctgtgaagccattagaaataactaattactgttaataataacaataatacctacaatattgaacagattttttaatgcaagcttctgtgatgagtgttcaagatatcatgacaaccctatcaatgagatattattagcactctccattttacatatgcataaatgaaggcttaaagaggctgtataatttgccaaaaatcatttctgtagtaagcagctgaactgagtcccagaattcagcctatgttcataaccattttgccatattgctaatgtgggtatcatagtggatcccttagcctgagaaaacaacgagtttaatagttgcatatgtccctattgtgtaggagagccctggagagacattttagaagctttcttgataaaaaaagaaaaacaattagctaatcatctggattgttacttatttaatgaaacgtattagtaatttgaaatagactacaatgaattactcagagaaaatgggttcaactaattggttcagaaaagtcttctgaaggatataattaaattgcctagtgtactattactgctagcataaacactattactgatcttcaggaccacttgcatttccaacgtaatttaaaataagtagtgggagagacaagatccatggacacaatgtgtttcaaggaatcagccatgtggttagctaatgaaagcaaagcaaggtcagtatttgaactgtttccagcaattagcattctgttatatttttgttcctatgaatcatcaatttcaaataactcttaaacacctttttaatagaaaatactatcttatttaataccatacttctgggtcctagtatgctgtttggaataaaagatccttaataatgtatgctgaataagtgaattaaatttttataaaaagtgtcttttcttttaaattttacaaaagacataatttaaaatatacatatgacactcaccacatgacttattgaagattagatcagaacataatatttgacttcaattctgtatggttacttctgtgaagatttatgataaaaaagccaggaacaaatggtaaggaatgcaattattttttaagtgccatgatattttcatgactgattttcattaagcatgggaagtcatatctgccatggatcctgcattatatatgtcttataaataggctaaaatgatttgaacttcataaactgataaaaatgctcttgagatcttaggatcttaggatctttacataattctttgtcacaagttgacttctgtgaagatcatgaagcaatattgttctctagggaagatgtggaaagaaacaggtgcctgtatttctttttgtgattacctagatgaaaggaaagtacacacacacacacgtgtgtgtgtgtgtgtgtgtgtgtgtgtgtgtgtgtgtgtgtacagaaacaagcatagttttattacactcttagaacctggataatttcttagtacagagtggacaaacaggaaatgtttgctgttgaattaatgtatacaaaattagtttcagagactgtacaaacattgatatcatctctgcaaaatctaggtgttcaacatgagaagactggattcttttacttgttgttgttgtttgttttgttttttgtttttgtttttttagagacagagtcttgctctgtcacccaggctggagtgcagtggtgcaatctcggctcactgcaacctccgcctcctgggttcaagagattctcctgactcagcctcccaagtagctgggtttacaggcatgcaccaccacgctccgctaatttttagtagagacggagtttcaccatgttgatcaggctggtcttgaactcctgacctcctgatccatccgcctcggcctcccaaagtgctgggattataggcgtaagccactgtgcccagcccaagattgggtttttaattataaacccacttaaaaaaatcctgagaaaatgccagatataataagcatatcttaaatgacctaagcaatagcacaaataatcttactattaaattattctaatttgcttgagatgatactaagacactgtaagcagcagaaactagaatttagtaagtccagcatcactaattttacaatgctaataatctcttctttcttttgctttttaaaataggttctaaatttgttggattctcttacctgtcacaatataggatcctattttggtataagataattaagatgggtttttgattatttctatctagattttgaatatattatttactgcatccctttaaacattttcatgaattgctgttgttaaaaaaaaaaagcattatggatcttgatctcttcctctctctctcttgcctcacctccctttatatttagttggggagctaagaataaacatagaaaataataactcttaatatgtcatgagtatcatgacacatggtaaaataccatgctgatttttccttccatgcatattataatgtttccttcatcccatgcttctctctcactgactggaatctcatgctctcctgtctgctctttctcctttctcttagcaaatagcaaactcctcttttttccttaagtcccaggtcaagtatcaatttctaatggaaattatctttctgagactacatgttctcttttacctaatcagtgttgagtgatatttagctttgatttcaatcaatgttatcattggatatgacaatatcgttcaattttttttctcccatcctcttcatttgtctgaaaaatgccttgagggcaggcactatgtccaattaatctttcatctatcagtcccaaaacttttattaaatatttgctatgtgtaaagcactgtatttgttgctggaaattcttgaccctaagttcagtatattacacagaaaacacttttgtagaatgaataaatgggactttataatacatcaaggaaattctacaaggcttattttaagaaaaggtcttaaatgaaaagctggtgaatgtggggcagcgatcaaggcaggacaaagagcaaccatcttcatctcacatcattaagtttaaaagttatgtattttccccaggtttaacgatattggtctggaaaataaagagaaaataaatatgtatgtttttggaaagcctgtggtgttgtaaaagttatttatcacggtcataattgttgttttgtggataggagcatttgagagaaagctgggattgaaatccctgacactgagtcaaagtcatgagtgtttctctactctttgctacctaatgaaaacaccaaaaaaaaaaaaaaaaaaaaaacaacaacaacaacaaaaaaaaactgcaacagtggagcttattttatatgacaatccagggaagactcaaaaggagtaaagcatgaaaccttggcacctgttctaagctagatctagatgtatgttaaattaaaaaggtataaagaaaaaataaaagcttttgttttcataaataaatctctgtttagtatccaaagttagtaaagatgtgaaaaacagaaactcttgtgcccttttgaagggaaattttataatacgcataaagagttctaaaaagtacatggccttcaacttaaaaagtatttggcacttttagaaatttctcttaaaagctactaagaaaatgttcacatatttttatatgagaattttcattgaattgctgcttataattatgaaaattagatttgcattaattttctaaataacttacagcagaaccttaaaaaagattaaacacattaaaaatgaagatttaaagctaaccgtttaacatagcaatttatcaacaatagttaagttagggactataaaacagtatatacagtattaatatcattttttgtaactatctatatatgtatacttcaagagaattaggcacattattatacatgtgatgcattttgatataggtatgtgagtgcatggaaatttttgaagcatatgaacaaattatgttttattatgagtgcagtggagttatatataatatggataagtagacaatgaaataaataatacaaagaagtagaaactcatacagcaaagatatcccaaacttaaaataacacactcatcatctttaatggaaactagatatgctttcagcctaagtttaaatatggatatatatggcccccagtctcgagtttccctagagcaacattagctattttgtgtatccatggtcacagcagttctacgataataaaagtcagaagatttctcctttttcttatccttcacctacagaaatgaaaatggcattcatagtttagaaagttcttagctcaaactaaatactggataatgcagtaaagcacatatcaataatcccaattgaaacagtctgggctttgatcccagacttcctggcaaacaacagactctgtgggccaataggcaatggaaatgagaatcaacctcccagtgaaaagagaaaccaacatcatgaatgaggtcctaacttgaaagaaaaatctaagaagcaatttctgaaacagccccacagggagtttatgcacatttgtgagaaaagtaaaaaataaataaataaataaacaaacaaaacctcggggctggcagggaatttacctatcatttagcttgattctttcatttcacagatgaagaaattgaggcttaaaaggagggcaaattgccaaagttgctctaaaaattagttctataaagtcaaatctcctgattcctaacctactgcagttcttatgtaggactctccagccaaaacagtactgtttttgtgtgctatgcaattttcttgacaaagagagattgtcatagcaattccttttctgacaatcacaggcagagttatgtagttctttcatggttctacagtacttaaaaaaaaaaccttctagattacttgcaaaacaatatcaaaatttttgcttatctatttccagtagtaaattttgtgttcctgaaggacaagaatcatattgtgtttaccttaaatccttagtgccaattgcattgcacaaaatatagcaggtactcagcaaatatttcataaatgaatgattgttttattctgttcattagattcactagtgaggagaggcactcctaatggactagccaagggacattatgatatgatggaaacagcaagttctcataggtgacacctggatttaagtccctcctctatcagttcctaatggcaatgacaccttcaattgccctgagcaacacattccttatgcataagttgggagaaatcatacctgctaggctactttccagtgtggccatgaggatcaattgtgataaatgtgaaaataacagcaattttattaatagcaaattattacgtgaatggaaggaatatgtgtggggggcttttaaacagggtctagctttttcagggcataccattcaaacacaatgcccattatagtaaaataaaatatataggattgtttctactgataaatgctatatgcttcaggtatgttttatagaaatccaaagtcattggctatattgtactggggtaatgacagcccagaggcataccattaagcctttgacttttgagtgatgcatccacagatttagggattccataaacttgtagagattttaagttccaaaattttctcctaaaatgtataaataattgctggtagggaataagaaaagtacattgccatgtagatactgagaagctggccaaaggatttgttcctatatgtctccagatgtgagatttttatttgtgtctcactgaagctataaattactgttaagttggtgcaaaagtaattgcagttttgccattaaaagtaatgtaattactttttgagaggcaccctcaaaggtaatttgcaccagcctaacatggttcatgcttctgggtttcttctagtataggagacattgtaaatgttaaattccatattgccagcagtctgctagaactgcacagaacaatttagttatttgagacaaatatatctacttgtaaataatcatccatgcaagggttattagcatcaaattaaggaacaactgaatcttaacaaaacccacaaacataaattgtatgagttaaaagagtgtattaagaggacaatgtgggaggcataggtgagagtgaggcataggtgagaaacccacatgctagaataacttgacttctttcacagagatagtaagtatagtcaaatgaaaggcacatttgcttcaaaggcacacatttctccaattaagtttgaatttcaattctagtcctgctatttactagttatacattaacaaattttataacctctatgaggagaaaagctcctcatggtgtcaggagccagagaatttagtatgctgagcagaggttaacccttttctggttacacccatgtggatgatgcaataagggtcaggaatattcctaagctgcaggaaaccccttctctgcaccaagcagaaacaagcgtgggggagggaaatgtggagaaatgctttagaatatctcttttaagtttcaggaagcgaggttctatttttcctgggtttctttgattttatgcttgctttcaaatcttgcagtgacagtgatgagagctcatggatcaacattaaagagtagggtcataaagacaaagaactaagaaaaacacttcttctggtgtaggctttaagactctgagatccagctcagctcacaaaaatcagaagttctacatagcaaagacatagaatcaacctaagtatccatcaacagataattgaataaagaaaatgtatatatactatttatagtgtatacatagtattctgccattgaaagaataaaatcatgtcttttgcagaaacatgaatgaaactagaggtcattataataaatgaaacaactcagaaacagaaagtcaatagatgcagaaaaggcgtttgacaaaattcaacaaccttcatgctaaaaactctcaataaattaggtattgatgggacatatcccaaaataataagagctatctatgacaaactcacagccaatatcatactgaatgggcaaaaattggaagcattccctttgaaaactggcacaagacaaggatgccctctctcaccactcctattcaacatagtgttggaagttctggccagggcaattaggcaggagaaggaaataaagggtattcaattaggaaaagaggaagtcaaattgtccctgtttgcagatgacatgattgtatatctagaaaaccccatcatctcagcccaaaatctccttaagctgataagcaacttcagcaaattctcaggatacaaaatcaatatacaaaaatcacaagcattcttatacaccaataacagacaaacagagagccaaatcatgagtgaactctcattcacaattgcttcaaagagaataaactacctaggaatccaacttacaagggacatgaaggaactcttcaagaagaactacaaagcactgctcaatgaaataaaagaggatacaaacaaatggaagaacattccatgctcatgggtaggaagaatcaatatcatgaaaatggccatactgcccaaggtaatttatagattcaatgccatccccatcaagctaccaatgactttcttcacagaattggaaaaaactactttaaagttcatatggaaccaaaaaagagcctgcatcaccaagtcaatcctaagccaaaagaacaaagctggaggcatcacgctacctgacttcaaagtatactacaaggctacagtaaccaaaacagcatggtactggtaccaaaacagagatatagatcaatggaacagaacagagccctcagaaataacaccgcatatctacaactatctgatctttgacaaacttgagaaaaacaagcaatggggaaaggattccctatttaataaatggtgctgggaaaactggctagccatatgtagaaagctgaaactggatcccttccttacaccttatacaaaaattaattcaagatggattaaagacttaaacgttggacctaaaaccataacaacctagaagaaaacctaggtattaccattcaggacataggcatgggcaaggacttcatgtctaaaacaccaaaaacaatggcaacagaagccaaaattgacaaatgggatctaattaaactaaagagcttctacacagcaaaagaaactaccatcagagtgaacaggcaacctacaaaatgggagaaaattttcgcaacctactcatctgacaaagggctaatatccagaagctacaatgaactcaaacaaatttacaagaaaaaaacaaacaaccccatcgaaaagtgggcgaaggacatgaacagatacttctcaaaagaagacatttatgcagccaaaaaccacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttagtgggactataaactagttcaacccttgtggaagtcagtgtggcgattcctcggggatctagaactagaaataccatttgacccagccatcccattactgggtatatacccaaaggactataaatcatgctgctataaagacacatgcacacgtatgtttattgtggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaactggaaatcatcattctcagtaaactatcgcaagaacaaaaaaccaaacaccgcatattctcactcataggttggaattgaacaatgagaacacatggacacaggaaggggaacatcacactctggggactgttgtggggtggcgggagcggggagggatagctttagtagttatacctaatgctaaatgacgagttaatgggtgcagcacaccagcatggcacatgtatacatatgtaactagcctgcacattgtgcacatgtaccctaaaacttaaagtataataataataaaataaaataaaaaaacaaaaacaaacaaacaaaacaaatactgcaggttctcacttgtaagtgggagctaaatggcatgtacacatggacatacagtggggaataatagatattggagattcagaaacataggagggtggcagaggatgagggatgagaaattacttaatgggtacaatgtaccttattaggtgatagttacactaaaagcccagacttcactacacaatatatccatgtaaaaatgcacttatatcctttaaattgaacaaattaaaaaactaaagaaagagaagtcttatgccaaaagcttgattgtaataaattcagtgatttttgtacagactatttcctgtaaatgcatgtgttggagggattgttgcaaccctagcaggcagtttgttaaagacctggagccagagtttctgttgtatcaactttcacatgcatcaactcatgagtgctgatatttctccatatacttattttaatttattttatttatttatttattttgagacagagtctcactctgttgccaggctggagtgcagtggcgtaatctcggctcactgcaacctccgcctcccggattcaagtgattctcctgcctcagcctcctgtgtagctgagattacaggcatgcgccaccacgcccggctaatttttgtatttttagtagagatggagtttcaccatgttggccaggatggtctcaatctcttgaccttgtgatccacccgccttggcctcccaaactgctgggattacaggtgtgagccaccacgcacggcccgtatacttattaaaaacagaaaatattgatttttaatatgttaaatgttggtttccaaaaaatagagcagtttaaccatcttcatagctttactaatacaaagcaaaaagaaatttcaatgcaaatggaacggtattgatttgactatgaatcttcactcttctaatcaagcattcttttaaaaattctaaagacttagagagtatgtcttatggttaatgttttgtcttctccttccttttgttctcagtgattagcacataatatatactcaataatgttttctcagtaagggaacccatcaatctcatgaataaatatatctctctgacgtttttcccctaattgacaattacctgaacttttgggtgtaggaatcttccctttatttttttccttgacactgacatattaaatttctgatcaaggcttctatttctataactagctttgatactctgccccagatctctagggtcagactcttccagaggcagctgtcaagtgctgccaatagcactggaaaggaagataataattcaaatcccaattctgcatctactagtggcatggcattgaacaatttgcttcatccctttggacctcagttttctcatctgcacaatgtaaagaaaaaactttgtggttcttaactagaagtgctcaccaaaatcatctatggacctctattaaacatacacaagccaagattcatacaaagagattctgattcagtaggtccacagggaggaggagagcaagaaaatgtctgtttttctaaaatgatccataaatttcacagtctgtagtttcagaaattccaggaattctcaatcatttatttgcaagaatttattaaagatatggtgtgttctttttattttaaatcctctggaagaaatacactagatgtttcaacattgacttaattcattttaattattccattaatcatcaattttaatggtcaatttaattattaacaaatgagttcgaattcctttggtttctgcctatagttaatcaagttctagaggcaagaaagtaatatagaatattttaggcagttgatctcaactgtgaaaataactagctttcaagaattgactaatgctagagaggatagctctgtggctgacaatactgaggttactttacatggggctagatttatacctaattatggagtagatcaagctcatctctggtgctttttattcccttcaacaccctcatcctgggaatcatgtgggcatacagtattttaggattttttttggtatcctgtgaaactttccccatctttttatacttgtattctttcaatgtgttaaggttctaatacactaattgatccccagatagtattgttacctctccacatcttcatttctttacccctaaactgtaagatattgcttaaattttaaaagagaacttcaagacaatgattatcttcttttaagacttgattcaaatattgcttcttctgtgaagtcttccctaacttgcccaggcaaaacaaggttttactttccctaggctgtatttgcattttattttatgttgtacaaattatctgttgacatggatttctcactggactctacatctcttaatggtaaaggcattgcctttttacctctatatctgcattttctgccataaaccttgacatagacagttttaaaaaatgcttattgaacacatgaatgggtggaaaatgtcagaatttcaaaaaatgtttaaaagctgtcttaaaccttcaggcaaccttagaaaggggatctttggaatcctctcaaatgaagcatattactgaatttgtaccctacctacaaacctatactagactcaactctgtccctagcctgtaatgtccattcaataaaatcttgtcactttattttattttagaaagcttatcctatctacaataggagtgttattttaaaatctgaagagaaaagaaaaagagaaactggttaggagacttttgctcaaatgggaagcaattaagattgaaactagattggtgtcagtgggagaataagaaaaggacccacttggtaagcacttactgctgggccctgtgagtcgagcaattgatggtatgccatctttttgagaaaccttctaactacaagttatcattggtaatcagtctgttaagcaagtctgtcaccaaaagagagatctgatattcaaattgcatttagtgtttcaaaaaacagagtgcaggcagattttcttcatataaactacttttttttaggcatctgaaattaatgaattgcaaaattcaaataacatgttttatacaatttgaataaaaatgtgctaagagaaactgagttatacgtattagtcaattaacaagctgcttctcatttgccatgtagtttttataacactttagaacatttctttctcagtatttgttatcatttatagaataattttaatccccaaaataggcatattagacattttatagcatatgttttcatagaatattcatttataaatttctagatactggttaatctataatagggtgtttactgattactatataatatctactattcaataattgtgtatgtgatggtatatatattacatactggcaattatttatagaagagacattttacatagtatatatatggaatgcacagacatgtgtatttaagccttgttacttgctatctcatatttgaattttccactagaatataagttttgaaatgactttattttctaatctctaatagcaagatataagaaaatctggctgtccttagatactgtatatatgtactttacagccatagaattttagttgcagcatgcagggtatgtatttaccatgtaaactgtatagttaaaataatttacagatggtcagataaataaatagaaagaatattaaacaatgtgtttgcatttagattatcatttttaatgtttccactatacaggaacagataagcagagaatggcatggatctttatagttaaatagcatggatttgtgaaaaaccactttagtgaagtgaaaaagtatatttccacagacattattaagaggtgagaatttctcaaagccacattgtaacatagtgaccataacatatgacacttctcagtgtcatcatgttatattggaatgtaaaatattattgcaagaaagataataaaaatggcatcaaaattagctaccttaacagcttctctttttcaatctcttagtcttcctagatgaactcctggcttggcagaaatctctgaattctgctcgttccatgttcatgaatactaataatgtacctcgaaatatgatcccttaacatgaattaattctgcttcccaggatatatttttatttttcacatttcacaaagatttatgagaaataattgtttggcatttatcggcatccatgttccactaattaacatccttgtatatccatggggaagaatagacagaatctaacaatccacttcctttatcttttaacaacgtgtttgtttctgtttggagactgttaattagtttaaccttagactctttaaaagcattttatttcttttttaattcacaagttactgagaaaaagcatagagcaactgattcaaattaagaacaaagcattatctcatatatttcttataagggaggaattaattgaaaaataatctcatcgtggagagagggaaatatccagctggaggagaggaggtgataagtcactgtattttcttatgtttcatcagacttctttcccctctaaggggcaagttagaggcttattctaataagctcttaactgtagccagtttattcaagtttaagctctcagcttcatcatatattggcttttcaatcttaagcaagccaattaggatggtggcagaggagtgtagaggttatatagattcatttggtcatttgtttcctttggtcagccaggcactttgctttatgtagttcatctcatttaatctttgtaaagattattatttttactgttcatcaaagtaggcatgattaactttgctatattctagaaaatggaaacccagtgatattaaacaaccaagttaatgactggtaaagataataaacatacacttgggcaatttggggaaagaaataaaataatatatgtactttgaaaacaaggcagcattaaagacatgtaagatatgacatcatatagggacattcaatcaagatgaactgagaccaggtataatgcagttaatatgtcaaaaaaaaaaagttgaggagattcttcaggaatatggttgccagatttagcaaataaaaatatcaaatatctgttaaatttgaattttagaaaactagttaatttagcataaatatatcccatgcaatcttagggatagctgatactaaacaaatgtgtttcttaaacctgatatttgaatttaattgtgtgtcttgtattttatctaactgccctactcagggactttcctttataagaaataaaggctagagaggcctctactactgaggacaggaactgggaaagctgttacagtaggacctctgtgctttgattatgcatctaatatgatgactttcattattggagattaggccccaagtatgagaaagactgaagagtaaaatggtttggaaaaactgcagcctagattagcaagtttgagataatggaagggtgctatgtatggcagtaacactgagatccataaaagccagtaataattaggtttggatagctgagtaaagctttggttaaaaaaacttgggctggctcttgaaaaatgagtatatgaagaggaataaaagaggattagtctctggtggcattagtaaaaataaaacatgggaatgagtccttttcaaatatcaattctgtacaaacatctgtagctacacaaatattacatgaagaaacagctgagaaaaaagtaaatgctcatatataagattagcaaggtatggtggggcccagcaagacagggattaaattaggaagagagtagatactgaagatcggtcagggagctgttagagtaagcatcctgaagaaggcataaacaggcagaatgaatcctgttcgttgctcctacaaacatgcagcataggaggaagggaaacagcttttactgagaagctgtatttgtgtcagtcattgatattttatcatattaaatattcaaagttaaattaattgtgaagtataaatatgtatgtcagtatgaagatgaccaatgccaaccaggatcattgaataaaaaagagttttgtttaatctatttattgccatctatgtccaaagaggaagtcaatattggcagatagtctccttgtgctcaaagagttcaaaaaactatgtcacaacttaagagaaacagaactggaattaggaaatctggttgtgctattaacaagttaacagagtttattcatctgtaaaacgggaacaagactatctcagagaaaaagtataaagattctattagataagttttgggcaaagattatctcagctctaatattctaagttccctcctatggaaaagccattattctagaaacacctttttttgttttttttccattctcaagatgctatgccttaacaacactggggggtggatcacttagaaggacaacaattcaagtattcaaatacgtgtttccagcaggacagagactaagctggtgcctttgaggacaaataacagaagattttttttggaaaacattctgaacacattttgatagactttgtgacagtttggagaaaaaagatacagagcattaaaagcgggatatgaaatctaaaatataaggaaacaaggactttgggaatctgaaccaggaaacagaaactcagtttgaatattttataacaaagacctgttgtagaatccacagtattctctactattctgtgctgtagaaaaattatgaccctgggttcttttagatacagaaagaagaaaatattccagcaggtctctcttagaagtagagaagaacatttgctttttggtctgatatcagccttagagcatttttgcagattgggctcactctgtagaatgaaagtagaatgaattctcaaaattagggagaacggtctctataatttaatacctataggacaaactatatgtatgacaagatgagaagtaatgatacaaaattatgtactgttttatgtattaagtgagatatcttacataaagcataccacaggcacacaatatatggtgatttccttccctctccaatcacaccctgccccttccagatccaatgcatatcctcttccaggggtaccatgcgccaacttacccagagctcagtggtacaaatttacagcacctatcagtgataacagccagaaatgacatactcttcccaaaaaaggcttttctctgcagcgtagagggtagaattaggtcagttatgtaagactcatattaaacgagtacactttgggccactttggtgatattgttaatgtttctgccttcaagtggttacaaaaggaaggtgaagttaatttcccttgcttcggaagttctgttttataagtctgaagggtacaatattgaaatgataacctacattcaatattaaccatttgctgccaaagtaaatactatatttcgataatttcataaatatccaagagaaattgtcccaatattcacatatattgaagttagctcatcaggaaaagtcattttagtgatgaggctctgaagaggcccccaaaaattgagataattatagtgatacgtcaactgcaaaaaccatatttgtgagagatgctcagttatgtctgaataagaatcttagaattatagaatgttccaactggagaggatcttgtctaacacatttatcatagagataaagcaattaagacctggaaatgttaaattatttgcttaggattgcccaagaaatggaagagatggttctgaaccaggtcttttgacttaatttttttctaatgcatttgttatagagataaagcaactaagacaaggagatgttatttgttctgcattgttcagtaagtggaagagacaaaaatatttttcaatcaacaaactcttactgttgatgttaatatggctgacactgcctctctgccttaaagtgtattacaataaaatgcaaagacacctatgaaaacctttcatcataaaagacgaaatttcatttttttcccaaaacccaggttttaacacagaaaactttgagctccaagaattaaaatactctttttgaagctagaatactaaacatccaattttgcatgtagggaaatagaaacaaatattttaaatgttttgaacatagttttcacagctagaaaattacttaaaaaaaggcctctcaatctctgtctatgcttgtttcattcatattttatagcttttctcacctgaattctggtaaatccttatctttctgtcttacctccctatcactcatcctgaatttcatatatttatatttgatttttgttttaactccggggaagattagtatttatctcattttaatattttctctttgtgcatttcagtacattgctttagtattctaatgtcctccaaaatttagatttcttgcaaaagaaactgctgattcttaccaggtttgtatcacaaataaatcttttaaataccgtcttttagtcttccaacaagttgctgacattttattcatgtttgtatccctgtgacttgcaggtagggggtactaaatgctgtctgctaagtgcatgaatgattaatggaacagcacaaaggggagcaccccaggctggggattttttagttctctcactaggtttgccaagatgtttcaatcagtattccttgagtaccacttcagagtcagcctgagtgtgacttattctaccaccatctactttacttcaattttctataactcatttaaaaaaagaatgccaatgaaaattctgtcatatgcttgaaacattttggggctcatgttagtggaatgacttctagttttcccagcttcttccagtgcaagttttctaaacatatctcaaaaagccccagttttatatcacaacagtttcatgagaaagtgaaacagtttcatgagaaagtgaaacagactatgaaccttttgtactgatccatagtatctctagaaattaagcaaagtagatacacagatgagtatgcatatatttttacatataacatataaagattcatataaaatgttgaatcatctggagaatttcaggcttgggtaggaatatacaatactgaataaagtggctcataacgttttataaaagaaatattatctttttatttcatctcatttgactccacctatatatcctaaaaatttttacaataatactttccctgattaaccattaattcaaaagataaaaaaaaacaagacttagccttctaaattccagttgcttattggatgtaatagtacttttaattactaaatgattccaaaattaatactattggactctgacttctgaccataatgttttaacagaaatcagatataccatcctatgtgaaacaattaaaaaactggacaagatatacaaaacaatagttttcaagaaatacaatattgaacaatgtaggagagtaatccctgagaaatgagaaacaaacaagatgaaccctacaattgccctagcccatagccacaagggaatttccaggccattgcaacaggagtctgaggacacaaaggcttctaacatctacaagatagaggactagagaagaggactctgacaatccacagagggccttttttgggtatttagcaaataatttatcagtacctgaatgtgagttagccattacagcctgcaaaacatacagtctgaaagtattgaatcgaacagtactcaggatacacagaagacctggaatagtgcctgtacccataaatctaagtaggaagtcttataattcacagacacagtagaatactcagaagactattgcctctgcagtggagaatatttctatatatatactaaacacagctgtagtcctacctaacaaattataaaatagtagcagtaaagaacaagctgcttccaactaactgaactgcatcccagaacaaaattgaagagatttataaagataaaaagaatacaacaatcacaaaagtaaaatttacaatatctgaattgcaatttaaacaagctatcaggcatacagaatagtgggaaaaaaacaaccaataatgaaaaaaaataacaagtaattgaaactttcccagaattgaaataaacattaccatggatcaaagtgtcaattcattaagtagtagaataatcctaatcatgtaagcacctaataataggtctgtaaaatacataaagcaaaaatgaatgaaactgtaaaaataaaaagaattcacaagcacagtcataatttaaatgtccctctctcaataacttgacaaaacaagtcaactgaaaaataagaatatagtagacttgaacaacccatcactcaacaagggctaactgaaatttatagaatattccaccaaacaatggcagcatatacattattttcaaggacacacaaaacacttaccaatatggaccatattctaagccataaatcaagctttaataaatttaaaacaattcaagtcatacaaagtatacttttgaccacaatagaattaaattatatatcagtaccagaaggatatctgaaaaatcttcaatatttgggaactaaataaaacatttataataactcatgtgtcaaggacaaaaatcaaaatgaaaatcagaagatattttgaagtatatacaaataaaacacaacatattaaaatttgtgagttatcaatttagggcattatatgctatattagaaaagaaagaaggttcttaattgagtttgtgttgctataacagaataccagagactgggtagtttataaagcaaaaagcttaatttggcccataattttgatgtatagaaggttcaagattggtcatctgcatctggtcagagtctcaggctgatttcacttattgtggaaaataacagaagggaagcttgtatgtgcagagatcacaaggtgatagaggaaacaaagaaagaggcgaggtgttagcctctttttaacaaccactgcttgtgggaactaacagagtgagaactcactcatctctgacagtgggcattaatctattcatgaggaatcggttcccatacccacatacctgtcattaggccccacctccaacattgaaatcaaatttcaacattaaatgtttgggggacaagcatgcaaaccagagaaaaacgtcacaaatcagaggcttcagcccctgccttaagaaattggaaacagaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcgatggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaagaaattggaaacaggctgggtgcagtggctcatgcctgtaatcccagcactctgggaggcctaggcaggtggatcatgagattaggaatttgagaccagcctggccaacatagtgaagccccatctctactaaaaatacaaaaattagccagacatggtggcacgtgcctgtagtcccagctactcaggaggctaaggcaggagaattacttgaacctgggaggcagaggttgtggtgagccgagatcatgccactgcactccagcgtgggcaacagagcaagactccatctcaaaaaaaaaaaaaaaagaaaagaaaagaaaaagaaattggaaacagaacaaatgaagataaaaataagcagaaaatagcaaataaaaatcaaagcaaaaaatcaatgaaagagaacacagaaaaacaatttaaaaaatcagtgaatcaaaaaagctagttatttgagaaaaatcaataaaactgataaatctctatccagattggtccaaaaaaaaaaaaaaaggaaagaaaaggcacgaataaccaatatgagtttttagagaagttatattgctacaaattatataatattaaatggatcataaaaaaacagtgtaaacaattttatgcccacaattttgacaatttaaataaaatagaaaagttccttcataattaattctggaagaaacagataactctaacagatctatctatctgtctgtcggtctgtctatctatctacataaatttgaaaaatcaatgtgtacctttttaccaaacaaatgaacaagcaaaaaacttcaaattttattgttgagtttattttaataatttgagattggtttattaaatacataattaaactaaagaaccaaaatatcactccatgaagagaacaaaatttggctcatatagttgattagtggtaaaatatcttcaaattggtttggaattttttagtagaaacacatatggatattttacacaaataattttggatacgtttgcttattttgccactgtttacacgtaaacagtacataaaatgctcttttgatttaggaaattctaatattagataccacagaatttaaatttctctttttttttctattgattatttttccaccagacttctttgtttgaacttgtggacctatccaattttcagctgtacttgatacaattcccaaaccctgaaaaattattttccagtttcatgtcatcatgtgatatcaactcaaaaagtgttaatatttaaccatacttaaatttttgcattgatttctaatttctttgactaatgtttataaaaataccatcaactagtgtaaggtatttttattacctaccaaccaatcaacatacaaaaattcaaaatcactctgaatgtgttagaaaacaaactgaatgctccttgagggaaatataataacactgagttatttattaaattattggatgctaacattgtggtagccaggtactaagtcctttaaatatcttttctgtttcctacaaaaatgtgagattaatttataataatcattatgcataagaaaaatgaggtttaaataaattaagtaacttggctgagatctcatgctgataatccacagtgttaagaactgaacgagctctgttaaactttgaagtctatatttttagccaacatgttacactgcttccctaagtctgtttctttcatttctatagtcattgtaacttagaagcagtaagtactcacagaatgcttattacatgctgagaaagttgattgctaacattttcattacttaaactaatctaaacctcagttcctttttggtatgaaaagatagtttataaaatataaacataaaaaactataaatctacctctattataaaaaaagaaaaaataaaaatgaatgaactggctaaaggatctatgaaagcttgatttttataatgccttggaggacagatgaaattttatatgtcttagttgggacaccacatttggtttacttgccaccattattgctggctttattcagcaatatgttgtatcatgattatgacagaaaaataatcagcctgtgacattcctcaaatgcctccattctgtacaaaagtattacccaacctgtatcttaaaactatatacatgatgatatgctgacttttggctccataaaaataagaaaaattattttattcagtaaacttggagaagcagaatgatgaatacatcttcaagatgtgaataagtcatgttctttctagtagcaagattagatttataaatgtaggactgctttgatacttgtataattttcttattatttttaaacacttattacatagaaattattgctttgcaagtgatagtagaccaatatatttattatatttgcagaaggcattattcatgcctgtcattcaaattattattctgaaagtagctctaataaagtagttcatttgcacaacaaagctgactaataaacatatgtctctaaatcacagtttatataaatattcaatgaaatcagcagaagacactaaaagtaaatgcagatttcaattttatgcaaagggaaattaaaaaaagacagcattattgtatagactcaaaaagttgttatggttggacagaacccccaaagtcattgaatccattaattgaatctattatgagagtttacatttgtccttgataaatttcaactttctagaatatgtccagtttttccatcagaaaggatttttttccttccaattcttattctataattagtcacattggtttaaacttccagctctaggtgaaggacaaatttcaaaagcaacattttcaagacttcatacaaatcactaacaagaatgcttccaaagagagagaggcagtcctaatagagtggaaagagcataggtcttggaatcaaaataaataggtttgaggcttgatgccataatttctgagcttatgaccttggccacatcacataacactgtgaactccagctttctcctctgaagcagagaaaatgtatcaaaatatgaagatactttatcaactgaaaatgactatatacatttacatatttgtctagattgtgcagtagatatgctactgaagaatatttttcagttgctattaataaacattatttaaataatgaatcagtctaaattaacatgtagctattaattcatctaaactcacatatttatataaccttagacaataactgcacagatttttcccagatatcttgctaagtttgttatctcaatagtcattttttgaaacaaaaatgaaagaattcatgttgttaatggcaatagcatgatttgtcattaattcttgttaaaaatgaaaataagtttactttttcttaaatcatctttagcaaatatttgtgggttactgtggctcacttaattcctttttaaggacttcgtcttagttaattttgtgttgctataacagaatacctgaaaatgggtggtttaataagaacacagatttgtttcttacagttctggaggctgggcagtccaaggttcaaggacccatatctggcaagcactttcttgctgctttatcccatgttggcagacaaaaaggcgagcaaatatgtgtgcgagagagaaaggaaaggggctgaactcatcttttttactagaagcccactcctgccataagtaacccatttccattataatataattaatctattcatgagctcaaagcccttatgacctaatcacctcttaaagtcctccctctcaacactgttgtactggggattaagtttcccacacatgaactttgggggacatattcaaatcatagcagattaatttttaaaaataagccagtgtacatgcctgtaatcccagcactttgggaggccaaggcaggcagatcatgaggacaggagatcgagaccattctgggtaacacagtgaaaccccatctctactaaaaaatacaaaaaaaaaaaaattagctgggcttggtggcgcacacctgtaatccaagctactcaggagaatggtgtgaacccgggaggcagaacttgcagtgagctgagatggcatcacagcactccagcctgggcaacagagcaaaactccatctcaaaaaaaaaaaaaaaaaaagccaatataatcagtaatatcagtaatattatttttccattattgctattctttctcgagccctgtaccttttgaaataaggtgttcactggtttgctggtctttgcagagaagtattagataaaagcactttataatttgaaaaactatgatgaacctggcttttacagttattaaccctgcaatcttgggcaaatagctttgcctctcagagcactgaattgctaactgatagaaatgcagaaaacattttttaatttgttaatttgtgatgaaaattaaaggaaataatgtatacaaaatatttcgtaaatgtctaactccaaatgttacctctctatgtcttgttttgttatcatctcactttcctctgtgaaacagaatgaagtatttctaagtgtgtcctttggaggcatggattcctaaacatataatacaagtagaaaatacagtgagcactaaaaaatagtttttctaaaatttgcataagcgaacaaaagcacaaaaattattcctgatgaaagtgattttctttaggggcactggaaaatatagcctcatacaaggaaagaaaaattatttttattctgatgtataagacatcatttcagaaatatatacaaatggagggtgttgcctacagatacacatcactgaagccaggaagtttttaagccaaggtaacaatcaatgacctcagttgaattcccgaaagggctctacatcagtgttaaaatggccatagataagaagataattaactatctgtcctgagaatctatttgaaagagctgttctaagtttctgagagcaaaccattaaaaacagaaaagtgaaagcagagaatttgggcttattccattcactggcctcctgttttctattaaaagggttgatcgtaactcccttattttttgttctctgcatctttgaacacttgcttgaggggccaaaaaaaaaaaaaaaaaagaaaaaagaaaaaaaaaaaagcagggggcataaagtaggaggaggaagggtcatagttccaaaatatttccagaccatccccagacaaagagcagctcaggtttcgatgtcaccttcctccatgatttgtaagccatatccttagtttctctgttccttctccaatactactttgctttcaatcctgagcagttcttctctggactattgcaatgataggtcatttgatattcccaagctctagtctgattttcattttgattcacttccatattactcctggagtgatcctttcgatacaaaatttgctcctgaattccccctgcttgaaatcttctataattctactgctttcaggataaagtttagtctggaaaataaatcacttcaaattttgaacctatgtttccagagtcttctctagccacaaaaaattaaaacttgaaaaacacccttaactcatgaacaccatgaactcatttgtccctgttagatgagagacaagagctaggccctcaatacattcttggtgaagaatgaattattgaatactggagttcccaatttcctacttacattttatcatgaagcggcttatgcttaattctttttgatgactctttcatggaaaatcatttcagtggaagtttttatacattattttttgaattgagaagagatgattactttcccagattattgtttagatcaaatcgtttaagtgacttcatataccacatattttgtgagcaactgccaagtgccagacactgagaatacaatggtaaagaaatagatataatatatgtcctctggaatttatatcttagttggaaagagaattaattaaatgaataatttctgtacaggatgacgcatactttgatattgacctattgtgttatagccactgtgctatacatagttgagcttatgatcttgccaataagagatatatagataaaaatgccgaataatatttaatcacaaattacataaaggcaatgattttaagatgcaggataataagcaatcatgcaaaagaggtgaagttattttaggtagcaagggaagacttcactgaggaagtgacatctacactgatatttgatggatgagtaggaattagctgagctaaaactgtaagaagatcattccaattaaaagaatagcatgtgcaaatacggaggcagagaagagcttggcatattttaagaactcaaacaaattcagttcagctgataaaagatgtgaaagtgtggcagcacacagggctggaatacaattatcttcttaagaatattgactcttccggttcctgaatgtggtacatctttccctttaagtctttatttcttctcggtgacattgcttgccaaacttttcaacctttcaatccatattctttctctctctctttctctctctccttccctcccttcctccttctctccctccccttttgtcgcccaatttctctctggaaatttgaggtatcttttctttctctccagttttttgaagtgtgactaaaacgcagctcaatagttttcaaccatccaggaattaaaagggtaatttcaatcttgaaattcatgttcttcagttctgaggatttttcttaaaacatgattttaataatttattcaattcattttctctattcttttgcaagtttttcttattctaatgctgggaaatcccagagcagttctccagttttcttgtgttttctctcctctattctattcctttgcctttttgttttacatttttagatatttcctcgatttgtttcttcatacccttctattagatgttttatttgttacatatgctttcattttaagaccttattatattcctttgtggaatataataatgtaaatattatttataattacattatttataataatgtaaataatgtaaaatgcttcctttgtggaagcatttcctgccacttttaaggatgctgtatattttgttttgtgtttaaggatattattattagttctttaactttccacctccctgaagagtttctatatccttcagtattttaagtttactggttttgtgctctgtcttcagtgttagaagttttcctcagatgtactagtgatgtgaaatggtctcttcataattaatgttaggggatttcaaaaaaaaaaagactagagactgtgtctgtgagtgggacctgtctattgtagattttacatcaggaagtactactgactaggatgctctctggctgatcacccatgttgagctggtttcatgggtctcagggaaggagatactcccactttcctgcatagagagaaacttctggctacctgcattctaggatcccaactggagaagagaacttgggctatcaacatttagtttgtaaaagttttcttatttccacatttcagtatagtgccttgcctctcacctgatgttgggaccttcaatccagagatcctctttttcaccctgtactctggatacgtttcaactctttggctaactagataggattctggggatgcttattgcttaaacaaactttttattattcttgcttcttttggtcctacgatcattccatcttccagaagtaactgctatcacagatttccgagcttttggaaggttctatactgcatattggtttactccttggctgagaatttggctttctttgtaatttagttactacttgtccattttaaaatttgtgttgctatcatctcttcttgcattccttcggtctttgtaagatttaagggcaatgtttctttattctatttggaagcattaagaaaaaaaaaccctgaaattaaatgtcagtgttcaatctgctgtcagtattggaagttgttctgattggcttttgtggacttcacagaattttctggtggcgggggagaaggactgaggatattagcagtcttcgatgaacatacaaggaactaccagagctagattacatggaaagattcttttattccttggaatcgctatatgaattgctctcctccccaccatcctgtacacaagcactgtggcttatttagaaagctgtaaatcagtagcctccaactttactggcaccagggaccagtttcatggaagacaatttttccacaggacagtggggcggggcaggggggtggtttcagggcaaaactgttccacctcagattattaggcattacattctcataagtagtatgcaacctagatttcttgcatctagagttaataataggggttttacgctcctatgagaatctaatgctaccactgatctgacaggagtcacagttcaagtagaatgctcacttgcccactgctcacttcctgctgtgttgcctggttcctaacaggccacagacctgtactggcccttggcctggcggttggggacccctgctctaaataatttaccagtacctacatatggatatgtgtgtgtgtgtagacgggtatgcatatgtatatggcaaactgaggtttcttaactaccatcatcttttatgagtcatatttcatattgcatgttcattttcagagtaacatatactacatgcatagtcatatttataaatctaaacatgttttaattttagatatataacacagatgagttaatatttatgagctcatgtgaaaacttcactaagcacgaagtttgcaactaagtaccctgcacatttcttagtgccttggtctgccgtgttttcttttttttagtttttcatgtgcaagtctttatttttattacctatctgatggctatttaacttatgctaaggatcatctcagttatttcagttaacaggataaaatcaactacactggatcctgaacttttttttttttgagttaaggtttgttattttcttaagtactgctgaattttttctttgttgatgtatattgtttttgtgaacacccctcaaataagattgaaacagttttgctatttcatccatattatcagttgccttcagtttttcctctaggggtactatatttacattagcccaatctgctcagaaataccagagacagtctttactttccttacttgccactctaccatcttcattatattgagaaatgagttatgtcttaaatcagcaaatcaacattttctatgacttttatcaagatgagggaatagatatttgacatacagtgtgggtgtctcttgtaaaagaaattgacaacacaaatcacaagtgggatgcaactaatgctagagagctgctttatgttttaaatatgaataaatctctcaaaatatgaaagtggaaagacaagctggactcaaatgattacagcttttagaattaaaataaattagggcaaatactggctctaaccacaagagagattatcactgtttgcctatttctgaaggaaccctcaaggaaattaaggtggcttgggttttagtgcaaataacactacatgttttctttaatatttccatttctccttaattcatttcacctgttaacacaaggcatgcccaaacattactctaaacattaaccaaactccatgttctaagtaagaaataaaatgcattatatttttttggacagtcactgggttatgtaggaagaagtaattatttttatataaaagaaaatgatgaatctcactctaggtgttaagctggtgttaagaggtgttttcttctagaataatatccttaaaggtatatgaacaaatgcgggaggtcttgaatggtagttcgcagagaccattatgatgtcaaaataatgtaaggccaacagagtattgacagttcaattttcagttttagcaatttttaagcaaaacaaattaccataaattactgtcatctaatacaagaaagagtattttacttaccaaaataaaaaagatggtttcttcattgtacttaccaaaattaagtattaaatatttagtacatatttgctgtttttcttagaccctaagttctgtaggaattagtgatgaaaaataatttttaaaataaaggccattatcaactacaaatacacagacacacatgtatgtacaaataattatatatataattattttatttatttatttttcttttattttggacctttgaaaatttcattaaagccttccaagggccaatggaccagcatctggtagccactagtccaatgggtattaggtaactgatgtccgttttccaccatctggacatattgtcactggtgactgtcatatatgtactggacaagaaggattaaatggcataatgcccataaaaagcattttgtaatctttaaagcactaaataaatataaggaattagtactgttatggttatgatattgcctcagaatgcatggtaacaaattctaacctgaaaaaaaatccctttatctacttaaaaatcacaagactatgtagacttttaggaataaaattttcccataggagtggtaatcaccaactttttcaattgttttgctacataatccagcctgctatagaaacttcaaaaatggaaaagtggaagtgtcaggctataacaatctcttgagatgtcatattaaatgtaaatacatcttgaaagtttcttggcatatcattagagcaagattctactgtaggaagcaagaggtttatttgtaatggagtattttttttaaacagcaccgtcttctctggctaaataagcaatttgtacaaatgacaaatgtgtttattttgcttgagaaatgaggacatctgaacgccagttatttacaaacctctatgtaaataacttcaaatgcaagacctatgtaagtaatttaatcaatgtgctaagggcagtgccattcacctctcctgtaattgcatcaccctcacctactgacctcatctggcactactccacatcagcaatgttacattttcctcccttaatcttccagcacacttcatctttctggatgtctagtcacacatccttacatgcatactcatatttcacagagatttctagacctcatatttcatggagatttctagatcttttagtttttagttttctacaaatatgttatgctcttcttgctatgtaaactttgctttaggacaaatgaagagtcagctagttcccctgcttacgccattttcatttcaccctaacactctttgaacagctgactgtgcttattttgtaccagaacataaaactactcacttggttggttgtttgaatcctgctgcttcttccagacctgctattttgatctcagatgattccaggattctaaatgagaaactttaaaaaatcctatctgctaaaatatggattaaggtttcttcagcttatttatttcattaggtgcttattttgtaccaggtattctttatagtgacataggatagagcagtaaacaaaatccctttcctcatggagcttaccttctagcatagactagagagacaataaaccaaataaataagaaattttgtagcaaatgtgctacatgttataaggcaatacatattattgacaaaaataaagtgggtggggggtaaagactatcaatggtagggtatgtttcatgtttaaatgtgatggtcagagatgtttcagtgagaaggtaacatctgagtgaagattttacgtgacaaatctattgatgttgatatctgggggaaggttgtttcaggcaaagagaacagtaagtgcaaaagccctgaggtggaagtgagactaggaacagcaagaagaccactgtggctaaagtgaattgggacaggggaggagcaacaggacatggatgagaaaggcagaagaggtatgtgttaatctggtaacatagtgtaagactgtgggttttactgtaaataaatggcaagtaaattagatggattgttagaggagaaaaaagataaactcgtatactttagttaccatctaaaccagaatccagatataattgttttgtgttccttgagatataggtaattgtacattcacaacttaggatcctaattctcatccaatcttatttgttctaatttgggcatatatatatttttctttaaagtgtttacttggaactggagatatgaggacccaggatcatgacaggacaatataagaagaagaaaataagtaaattgataaagacaaaaatataaaatgttatttctaaatagtaaaataacaaaccaatcccataaaaagtaaagaaaaggatacttgttatcacaattattatacaccagtgattaaaaaattttagtgaatgtaataaatcaagaaaatagtatcattagtataaggattggagataaattgactcagatactttgtgttaataaaattattgtgcatgtttaaaatccaaaacttctggagaaaactacaaatattaaataagaattttgaattatacaaacattaagtggcttttctcattattagcaacaattagttggaaatcaaaaatatactaacgaaattacaaagggtggtaataattcaagaaaacacaaaatatttataaagcaatctgtctttatggcagaatgtaaaaataggaattaaatgtcttctcttttttattagaatatttaatatcattaaaatttcagccctctaaatattaatatttaaaaacttaattttataattagaaaaaaatcttaaaaaattcttaaagaccaacaatatttaagagaaaaacaaaattagtatacgaaaactaaaaataattagagtggcatgacttacaagtattaagtataatagaaaaacaatgtaatcaaaacactatgttggcatgcttggtggctcatgcctataattccaacgctttgggaggacaaggcaggcagatcatttgaggccaggagtctgagaccagcctggccaatgtggcaaaaccctgtctctactaaaaatacaaaatttggtgggtcgcggaagcacatgcctataatcccagctgctagggaggctgaggcgagagaattgcttgaatctgggaggtggaggtttcagtgagctgagattgtgctactgcactccaacctgggcaacagagtgagacttggtctcaaaaacaaacaaacaaacatccacctactatgctgctacaaaagaaagataaataaaacaatagtaccaaagagagtatctaaaatgatataatagtatacagaaaatatataatttaaaatatgtataattctaatgaaatatgaagaagtgttgttatttcaatgggaaagaattctttatttactaaatcatgcaggcacatctgatcatctatctcaaggacctcgcaatgcaccaattttaatttaaaaaattgtagttggattaaatgaataaagatacaaaacaagaaaacaaaactttgccagttttcagagaaattttttggatcaaaaagaggagtgaagaagctataaaataacttttaaatatgtatttgattatgtacaagcaaaaaacggcaaatttagcataatcaatatcctagaaccaaagtatatattgaggggaaatctgtatgtcaatgattataaagccaaagagaaatgtgaggaagagaatgtccatattcacattggttacctggggagaaagtaagaagagacaggaagaagggagaggagaaggtagacaaaaggaaaaacaaacaaacaaacaaaaccacaaaaaccaaaagagataatggaaagaagaaaacaaaacaaataatggaaaaataaaaaatatatatgcactagcataatgtctacttatattaatgctacatgttaaaaaggatgaatggacatattgcaaagcatcaaagaggaaaaggcaaatgaaaacaaagatttgatttggggattggattttggaaagtattcttctgacattctgttatagcaatatagtaaaaatatatttaaataaaatatatttaaaatatatttaaaataaaagtgagagagagaggcttcaaaatggctgactgaaggtatctggtacttgcctcctccgcaaaacaaaaacaaaagtaaaaaatctccaagcaaatggataatcacactttgaatgtattgccttagaaagaatgctgaaattcaacagagaagtaacagaaaacacctaaggcagaaaggaaagggaagtgaggcatccttctctgccaggagccaggagagacttcccaatgtggggaaagagtaagtgagtgacccctaatggtccatatccccaccacggattcctgcaatacttgccagagccgttctacccacactggctgtgagactaacagagagagctacgtgaagacagctctgacagcatggctcaagaaagggaggtcacgctgtgtattcgtctgtttttatgctgctgataaagacatacccaagactgggcaatttacaaaaggaagaggtttaattggattttgcagttccacgtgcctggggagacctcacaatcacgaaggtaggcaaggaagagcaagtcaggtctcacatggatggcagcaggcaaagaaagagcttgtgcaggaaagctccccattatagtaaccagatctcatgagacttagcatcatgagaacagcatgggaaagacctgacccccatgattcaattaccccccaccgaggccctcccacaacacatgggaattcaagatgagttctgagtggggacacagccaaaccatatcacgctggatcctgcacacatctcaagccctaaacaactacagtgaggtaccattttgagagcccagtcaccaccagtctgtatcctgaatctccttattcctggagtaaaactgacatcccctgatcacagatggatgctgctgtcagatgctatggccaatgccaagtacaagccattggcagcaaccccaactgccacaagtagcagggccatcatgcatttaaaagtgccatgaagaaaggctatctcacttgtagccaccacttggggctaaagattgaactcccagcctcctgcctatggcttttgccactgaaagcaactccaccattcccagaagcagggccacagtgcagccgctgcctccctaaccaagcattctgccaggaatctgggcatcattcagcccatgcctaccacagccagcatcagcatgtacctatttgggacctcatgacagtcacaccccattcaagtatccctcacccagtgcctgaacatgtcacttggcatctgggagtttggcaatcgctctgccccatccaccacctctcatggtgctgaggatgagcccacccaaattgccactaccaccacagctggcatctatccacacacaccaactgtgggccagcgattgcagccactgataacaccagcttggactgcttgggatccaaaggattgttctgccactgctactcccatcaccaacacaacacccactgctcagggacctgagtatctacctacctgcccaatgcaaagctgccactaccagcacctgagcaagctgtctggaggccaaagaatcagctagcctgagcccgttaacattggtgccagtgaatgctgtgcttggtgagacccaggcacatttagcctgccattgccaccactggggcctgaggactatctcagtggatgttcctgtctccagcaaaacatcactacagacttcactaccaattgtaccataagctactaaggaaatcacagacaatactgacactgcctatacccaaagaaatcatacaaaaactacactactgcacacactcagagccaaagtgccctatccaatcaataccacagatactaatttgtagatgacatgatcttacatatctagaagaatttaaagactataccaaaaaccttttagatctaataaatttagtaaagttgcaggatgcaaaattaaaactaaaataccagtagtatttctatacaccaataatgaactggctgaggagaaaataaagaaggcaatcccaattacaatggctattaaaaaaatctataagtatacttagccaaggaagcaaaagacctttacaaagaaaactacaaaattctgatgaaagaaatttaagagaacttaattgaatatgaagacatcccgtattcatagattgaaagaattaacattgttacaatgaccatactgctcaaagcaatctacagattccatgtaattcctttaaaaataccaataatattcttcacagaaaaagaaaaaaaaatcttaaaatttatatggaatcaaaaaagagcttgaaaaaccaaagcaatcctaagtaataacaacaaagctggagacatcacactacctgactttaaaatatattacaagaatatagtgaccaaaacaatatggtatgataggaaaaatggtacatagaccaacagaacagaatagagaacccagaaataaatccatgcgttttttatccaaatgatttttggaaaagttgtcaagaatattcaatgaggaaagaacatccttttcaataaatagtgctgggagtatttgatatccatatgcagaagacagaaacaggacccctaactctcatgatatataaaaacatcttaaatggattaaagactcaaagtaagaccccaaactataaaactactaaaagaaaacatagaggaaacacttgaggacattgggctaggcaaagattttatagctaagacctaaaaaacacagacaacaaaaacaaaaataaacaaatgggattgttttaaaccaaaaagcttctgtacagtgaagaacataatcaacagagtgaagagataacctgttgaatggaagaaaatatttgcacaatgtttcatctgacaagagagtaatatttagtatatacaaggaacttaacagcttaaaaaaaaaactaactcccgctgcccccccaaaatacaaataattgcatgaaaaattgggcaaaagacatgaacagacatttctcaaagacgtataaatggccgacaggtacatgaaggaatgctccacatcaataagcaccagggaaatgtaagtcaaaaccacagtgaggtatcatcaccccagttagaatggctattattaaaaagacaaaaaataaaagatgctggccagaatgcaaagaaaagggaaagacaatattggtaaaattatacagacactatggaaaacagtataaaggtttctcaaaaaagaaaaaataaaactatcgtatgatcagcaattctaatactaggtatgtatctgaagaaaaggaaatcagtaggtcaaagagacatttgcacctccatgtttattacagcactattcacaaaagcaagatatgaaataaatctaagtatccatcaatggattaattgttaagaaatgtggtatatgtaaacacaatgaaatactattagcgcataacaaataatgaaatcatgtcatttttagcaacatggatgaaactggtgttcattatgttaagttaaataagccaggcacagaaagacaaatattacatgttctcactcacatatgtgggaccaaaaaaaaggttttcgcatggaagtggataccagaggctgagaagggtgtgtacatgggtagggcgtaaataagagaggttggttaatgggtaaaaacaattgtacaattagatagaagaaaaacattctaatgtttgttagctgagtagactatcattaacaaaaatatattgtttgttctaaaatatctataagagagaacttgatatgttcccaacacatagaaatgataaatacgtgaggtgatggatactgtaaataccctaaccctaacatgatcattactcattctgactgtaaaaaaaaatcatgtgtaccccatacatatgtacaaatatgtatccatgacaaaagcaatttaaaaaattactttttgtaaaaaaattgccaaatatttttttaaagtaaaattaagtaagaaaacagattttggcatgtacaaaaaggtaaattgagagaatctctataaatcatcttgaagcataaagacttgtattcatgacttgctaagctattagaaaacaataaagctttaaaatattctgaactaatgactgaatgatatctaatcaatattcactttatcacctggcaagtctaataatatgaagtcagagtactgaagaaactacatctattttccctgcctttgaaaggaaataaaacctacgaaggcttcctttaaaacagcacgtgtccaagaatgtatctggtcttccttgtctcaccactttactaataatttgacttttcctaatccaagtgattgattagttgaatgcatgtttaagcctcatagaaagtgctcatttcttcagacgtgatttgcaaaggccagaaattcaccattcagtaagaaaagctatgaaatagacctgtcataaactcatggggagggtgtcctagggagtcacctctgttctccaccaggagacttttagctggcttacttgcagagaaacatatatttagtctactttttcgattttagggtgtgagaatcctgccttttacttaggctgactgagttgaagagaaccgtttttctgcctctctattactgccatttttccccccctgcagtttcagccactctaaaatatctacaatgtgttaggtatgaaaggtatgaagatttataaacctttacccacactttcaaggagcttatattctagtgtaagagggaaaagaagaaaacagaaaaataaaaatgaaaagttccagggatatttaaggggtctgtggaagtcttactggagttcaggatatcttccaaactgcctggaaatgtcttacgtgataaacctgatacataaacctgagtatataggtaaaagacagggaagtaattccagggacaaaacagtgtaggttacactgtaagctagatatgttcagagaattgtaatcattttgagatagaataggtgaagatacagcagtgggaaggtgcagaagtgtgtcaattctgatattcggctggtatgcatcagcataaattaacccattggttatgacttgcatctgttttgattggatccacatcttactagttgttacatattttaaatctcacctctgagtatcataggaagtgactggcagattttaggccatgtagtgtatgccaaattacggagtggaatatgatggcaaaggggagtcaactaagatcattttgcaaaaggatgacacaattacacttgttttacagaaaaaacaactctgaggaaactggggatgatgggatgaggaaaaaagaaaagaagcatttttaatccatgttattgatacaatttagcaaatgagaggtgtaaaaataactgtattaaaaagactaatatctatatccaaagagtacatttcttattaaacttagcacattcttttattttaggtaaaattaaatcactttgggttgaatgaggaggtagttcaaatgcattgcctgttgcaattgctttgaacattatgttccaggatgttgaagtcaaaaaaagctcctttgttctggttctcctctccactgagaatcacggcattcaagcctgtaccctcaactccaaccaacactcctaagactctccgatctcataacccatcagaagcccttaaacctcaagaaggattgaaaaaaaaagtggagtttatgtgcaaaccatgactacttttgagtaatattgaaaacttaatactgctatgtaagtaggcatattcatcttcacagatgaaaaaactctggatcaggaagcaaacctctcctgtaaagggtcagatagtaaatatttaaggatctatgggacatatgacttctattaaaactgttcaattctgctattatagccccaaagcagccatagacattatgtcaatgaatgcgactatgttccagtgaaactatcgtacaaaaatagaattcagctgatgggcctcagttaatcagtcactgtttttagtatgatttatcacaatgcctgtcaacaaatagaaatatacatatgtatatatgtgtgtatataaatctgtgtgtgtgtgtatatatatgtatgatagttcacatcttctgttaattccaccaaatcatgtcaatcttctagaaaacaggccaggcgcggtggcttatgcctgtaatctcagcactttgggaagatgaggtcactggaaatcaggagtttgagaccaacgtggccaagatggcaaaagcttgtctctaataaaaaatatacaaaaattagctgggcatggtggtgcatgtctgtaatcacagctacttgggaggctaaggatggagaatcgcttgaactcaggagacagagactgcagtgacttgacataccgccactgcactccagcttgggtgatagagtgagtgagattctgtctcaaaacaaaaaacaaaaaacaaaaacaaacaaaaacaaacaaacaaaaaaacaaatctagaaaacaataaagagcaaatgtttttgactggaattcagcacagaataatattcagtttgcctttgtttctctgtagatgtttacacacatttataaagcaacttcaaacttttctgtttactaaaaactaaagtttcatcaaaaagtttagtttcctgagaaaatggaagtgcagtttgaatagtccatctaattattaaattttcttgattacagaaagtgtaattgctcctggtttgttaatcttattttttttaaaaaagaaacattttcagaatcacctttaactctacattttcctttgtttaaattatctatcttgaaaatagagaaaaacatattatcttatactgtaaggacaaaatttattactgaaattgaggattatcaaagatccagagatggttttccagaatggtttaggatacaggttatcttctaatatcctcactgccatttactgcctgtgggaccttgagcaaattagttgtctctctgtgtctcagtttcttcagctataaaatgaagttaataataatagcttacaaatagaattgctataaaaagtcaataaattaatacatgaagatcaaccacttagaacagtgcttgttaaataaagatcactctataaaaagtgattattatcaaaatgttttaaatatttatctaaacaaatgttcgcagtgtaatcaatctcaaagccaccagcgcactttgagatgcagattactttaaagcacaagctctagtattagaagagggcttcaaagtcctgggttggtttcatcctggacataggaatacttcttcatccaataacatcaaaagcccctgttcattttcagttgtcagacctacagcacctcccacgtcaactggtattatttacatttcagcttatatctagcaagcagagttgcctttaaagacataagttacgtcggccgggcgcggtggctcacgcctgtaatcccagcactttgggaggcagaggcgggtggatcacgaggtcaggagatggagaccatcctggctaacacggtgaaaccccgtttctactaaaaatacaaaaaaattagccaggcgtggtggcgggtgcctgtagtcccagctacttgggaggctgaggcaggagaatgtcgtgaacccgggaggcggagcttgcagtgagaccagatcgcgccactgcactccagcctgggtgacagagcgagactccatctcaaaaaaaaaaaaaaaaaaaaaaaaagatataagtaacgtctctgagtttcagattcttcatctataaagttaggttaatattactcacttcagaagggacttgtgagaaataaaagaaatatctcattctttacattttaataggggtgtttgaggggaacttttatgctccaggagagaaaagcatggaaagaaaacacacagcttcattccactatcttcctactatcccttctggggatagtgactcatctgtctggtgaaactggagaaggggttaagtgtgtacgactccatctcttctttttatggagcagtctgttctctgaacctgagtttttctgttgtccttctgaaagctacctattaaagcaagcaagtcctgtgattgttcagtcctgtctgtgactgtggggatggagaagaatatttggtcacagatcaaagatttggttttcatttagctaatatatactaattccatgacttcttgctggtatttaatttgaggaaagggctattatttaatgaacctttaaatccctaacagtgagaaattaatataatactttatgtgactctacagttacaaatgttaaatttggccttactttaaaaatatcttgcattatagtttaacaaaatctttctctcctcattgtttataacagatggagtaatacctttcaaaaataataaatgaaaccacttattaacagtataggtttcctggtttccaatctccactgactgtttctcaacccactgccacaccccttatgctacacacacacacacacacacacacacacacacacacatacacacacaaacttccttctccacttgcctccaaatttaggaagaaaggccatcaagtgatttttctatttctaaacttttaagctatatctgccccaacacatttttaaatttctgttctagttctgtagtacatcttctcagttggtttcctccacctggactttaaatgccaccccttcccacatttttatgcattttatactattcgtaaccctcttttcattaattaaatcacctatcctacctggataccaaaattaaccaattaaataaacaactgacctttgcatgcaagatacagatactatatatcataaaattttaaaaatctaaaaattatgaagcttggcattgtctgaagatcataaagcccaaattaaatgacaagagtaaaaatattttcaacatattccaatgagctaccttccttaatttataaagtttttagaaatcaataaggaaaaataaacaaaaaatggttttagtacatggataggtagcttttaggaaatattgacataagataatatttactatcttactcataattttaaaactacaaattaaaacattgtgatgccattttcattcataatattatcaaagtgcaaatgatttaataatgccatgagttgacacagaaatacaagtgcttttcactatacattttgttcaccacttaaactatttttcatgattataaattacatctttggagagaaataaaatgttaatgttaaaaaatctctctttacctcattttcccttaaaatatacagttgacccttgaacaatgcaggagttagatgcaacatcatgttacacagtcaaatatctatatataacttttgactctcctaaatcttaactactaatggcctactgttgacccaaatccttacaaataacataatcagttgattaacacatatttttgtatgtggtatgcattatatactgtattcttataataaagtaagcaagaggaagaaatgttatcaagaaaatcatagggaagaaaaatatatatttactattcattaagtagatgtggatcatcataaaggttttcatcctaattgtcttcatactgtaggctgatggggaagaggaagggaaggggttggtcttgctgtttcaggggtggcagtggtggaagaggcagatgaggtggaaggggaagcaggagaggcaggcacacttagtttaacttaacacatttaaggaaatgcatttttgcctttttttttcatttctctaaaaatgtttctatacagtaccaatccttcttccactgttagctttaatttcagtccctgtatcatagaaaggatcatgtcataaaagaagtcaaaagcagtcttgaataactgaaaccctcctgccagattatctaatgtcaatttgctttctgttactacttcttcaacatcatcttcctcctcatctggcactggtccaaaagcactcatctccatcaaagtcatcttctgttaattcttgtagtgtgatgtctgttagctcttgaatttctccaagatccatattctgaaaccctttacccccacctttttttttcccatacccatgatctcatgatttccttgattggctctatcataaatattgtgaagtgatacacaagatctggaaacagttttcttcagcaggaatttattgtatcaggcttgagggctttcagggctttttccataacaacaattgtatcttcagtggtataatttttccagactttcatgatgttgtctctatttggatcctcttcaaccagttgatgatcctttccatagagtactgtgtgtaatgagcctttatggtccttatgacccctaatctagaggctgaattagagactttgtgtctggaggcaagtagatactttccatgttgaactcatgaggttctgggcggtaagaggcattgctcaatagcaaaggaactttataaggtagtccttcctagccaggtacttcatgaattcagggacaaagtgccgatggaaacaatcaaggaaaatagctctaaatgtccaggtcttcttcttgtacaaccaaaagactggtagctgatgtttatcttttcccttcaatgctagaagattagcaactgtgtagataagaaaagtcatgatcataataaacctgactgtattgtcaaaaaacaggagggttagcttactccttcctgccttaaatcctagagctcacttctattctttactaataaatgttctttgtggtatttttctgtacagaatagaggactttgacacacattaaaaacctgttacagcaaatattccttctcctcagtggttttcttaatggtgtcttggaacttgtctgctgcttcttgggcaacagaagctgtttttctcattatcttgacaatttttaagccaaatatctttgtaaaattatcaaaccatcctttgctaacactaaattctccagctttagatccttcaccttccttttgagtaagtcatcctttaatgactttgctttttcttgaataatattagactctaaatgtatgcctttcttatacccaatcatacacctacataaaagctgcattttcaaaattacagaaaaaggtatttccccagaagagcaaggttttcacatctgctggtgtagccacagggatggcttcatacgtttccttttctttcgttatgttggtctttccttatgctggatttgtttatcttgaaatgaagggcatctgcagctgcagaccggaatccacagtacatattaagcaactcaactttttcttgtgatatcatgacttttctcttcttcttgggagcagtttcagcatcactactgacacttttgttcccatggtgttatttaaggttcacagtattgcaaaagacatgataaaaaaatgtgcaataatcaggaacaatcacttttcactgtaatgcatgatttagtggtgaaatgcacagttcacagggagatgattagcctcatactgtgatttaagcagatactcataatacttgagatcattgcaatatcaataggaggtggctttgaaattacttcagtagtacaacatgtactgcagttaattttatgcagttatgatttaatagtaaatctttgttttctcttaatcaggaatggctcacaagtgtgcacaaaagttttgataaattttaacttcttataatagattggtgtagattttatggtagtaaatgataaaatagtatatgtaaatattacattcatttatcacacatattttcttatttttaaaaaaatattcctagtcaacatggtttgtgtgtgagtttgtccaaattattgcaaatctcaaaaataaatttcaacctatcaactgaaaaaaatatgtaaatggagacctgcacagttcaaactcatgttgttcaagggtgaactgtagatttcattcttcattccttattagttcaacttcccaaaatactggcttatatgtcatgggttcatttactcaccatctactcacttcttagctacttcattgttaatctgcttttattactctattcagccatgtcttgttaaattgccaattctctccacctcaataaatccaaatggccatttcagtgttattttcacttgatctcctaaattcagttgacactggtggtcttgcctgtaaatactctcttccattggcttggatgacacaacactcttggtttcccatcaacatctctggatttgcctgttcctgtctccaatttagagttcatctttttttttcaacctaaatgctgaggtccctcaaagataatttcttagaattcctctcttaattttaacaaacacgtccttgatttgctattatcctgatgagtctctcaattctatttacagcctatatatctcttctgagctctcaacttacatattctcctacctagtagactactttatctttgaaatgtacctgaactccacttatccaaaactgaactcatgatctgctctttacttcatatctgacatttcccaaagacctcagtaaaggtactatcattcctattgttaacttttatcccacattacaaattaatgacactgaatagcccagtagaagaaaattatggacatgcctttttattgcacttgattttattgtaactccacagatattgcattttttacaaattgaaggtttgtggcaactctgtcctacacatctgttggcactatttttccaatggcatggtctcattttgtgtaattttgttaattctcacaatatttcaaactttttcattattattatatctgttatggtgatctgtaatcagcgatctttttcgcttatattattatttcaatttacatgataattgtacacatttatggcatacagtgtgatatttccataaatgtatacaatatataaggatcaaatcagggtaataaacgtatccgtcacctcagacatttattatttctttgtgttaggaacatgctactgttgtaattggtttggggcatcacaaactgtgcctatataagaccgtaatgagggtggtatgttctgattgtcctacccactggctgtacttccgtctctctccctctcctcaggcctccctaaccctagagacacaacagtattgaaattaggctaattaatagccctacaatggctaaatgctcaagtgaaaggaagaattgtaagtctctaactttaaatcaaaagctagaaatgattatacttaatgaggaaggtaaggtggaagcaaatataggccaaaaattaggcctgttgcaaaaaacagccaagttgtgaatatagagaaatgataagaaagagaaacagccttattgctgatgtggagaaagttttcatggtcttgatagaagatcaagtcagccacaacattcttgtaaaccaaaattctaatcaagagcaagatcttaactctctttaatcctataaaggctgagagaggggaggaagttacagaagatgtgtaaagctagcagaggttatttcacgaggttgaagacaggaaactgtctctgtaacatcaaagtgctgggtgaagcagcaggtgcagactgatagagaagtttcaacaacatattttcaatgcagacaaaacagcctttttttggaagaagatgccatctaacactttctcagctagagaggagaagtcaaggccttgcttcagattgtcaaaggacagactaactcttctatgaggagataataaaactggtgacttgaagtggaagccaacaatcatttccattctgagaagactaggaaacttatgaattatgttacatgtattactgtgttccaaaaatgaaaaaaacaaagcctgggtgacaacacatctctttaaagcatggtttactgaatattttaagtctacttttcagaattactacacacacacacacacacacacacacacacacatatatatatatacaaaaatcctttcaaaatactactgctaataattgacaatgtgcccggccagccaggaggtctgatggagacatacatggagtttagtgttgtttacatgcctgctaacacaatatccattcttcagcctatgaatcaacaagtaattttgactttcatgtcttattatttctaaaatacatttcataaagccataactgtcatagatggtaatccctcagatggatatgggcaaagtaagttggaaaccttctggaaaggattcaccattctaggtgtcattaagaacattcatgagtcatgagagaaggtaaaaatatcagcaacaggagtttggaagaagtgattccaaccctcatggatgactttgagatgttccaatacttccagtcaaggaaataactgaagatgtagtgaaaagagcaggagaactagaattagaaagtgagttcaaagatgggactgaactcctacaatctcatgataaatcttaaatggatgaggaattgcttcttatagatcagcaaagaaagtggtttcttgaggcggaatatactctggtgaagttgctataagcattgttgaaatgacaacaaagaatttagaatattacctaaacttagtagataaagcagtgatagaatttgaaaggactgactccaattttaagagcagttctaacgcgggtaaaatgccatcaaacaacatttcatgctacagataaataccacttccttttgtgaaaggaagactcatttgatgtggcaaacttcattgttgtcttattttaagaaattgccacagccactgccaccttcagcaattgccaccctaatcagtcagcagccatcaacattgaggcaagaccctcaactagcaaaaagaatctaacccactgaaggctcagatgatcacttgctttttttttttagcaataaagtatatttgaattaagatttatatatttttagacataattctattgtgcacttattaggctacagtacagtataaacataacttttttttttttttttttttttttttttgagacagagtctcgctctgtcgcccaggctgcaggacagtggcgcaatctgagttcactgcaacctctgcctcccgggtttgcgccattctcctgcctcagcctccagagtagctgggactacaggcgcacgccgcgacacccggctacttttttgtatttttagtagagacggggtttcaccgtgttagccaggatggtcttgatctcctgacttcatgatccacccgcctctgcctcccaaagtgctgggattacaggcatgaaccaccgcgcccccccccactttttatatgaattgggaaaacaaaacatttgtgtgatttttattgtgatactgttttattgtggtggtctgaaatcaaacgcacattttctccaaggaatgcctgtatacttgtttgaaaatgactgaatttggaatagacattcttgctacatgtaaagataaagaataatatctacctctggggaatagccactatcatagtttgactagaaaaactgtaatttcattggcaaggatatttcttacagtaagttcttatcatttccattttgaaaaatattgatgtagattgacctctaagaaatgcttcttataatcctcaagtacttttgaaatttaagtacatttcctttttgtggctttgtaataatcatcgtagtaaagaatattctcaaattattcaaataaagttaattatagatcaaatgaaactatcttttcagttgttaatttgctaaaaactagttgtttccaagtcttatttaaatttctaacttttaaataatgtatttcaagtaattctttcccagatctagaacaagacagtgtattcattctagaaaataagccccttaagaaatgccattactgttcagattattgatctcagcctgctgtcagagccaaagtgtttagcaagactatttcagggacctgaacaggatatttttattggcaatgagacagcagattacccacagctcaaatggaaagacctagtggtgaggtgtgtatcattctaacattctattgatgtgcagcacagatggtgagatgtgctgatggatgaggttgtctcagcagcagagttgtcttagtcctgccaagcacttaagttgaacgacctattaaacatggttgacctaaggcagttggagatatttataagtaactacagctattaaatgtggaccttctagtaggctctaaatatagcctttttttttttccacatagctttgacttctagttcctaaagccattcattcaagttgaattggggaagagaaggagcaaaaagagagattttcagaatatctgtaaacaaaataacactagaatactgaaagaagttatagcgtgaactaaataaaaattttcaggaggtagcactgatataaaatactaattaaaattaaaaatttgaattatctaaaattttaaaaaaataaactcaggttctatgtagaacctagggtttgctatcaaataataacttcccctctgtttctactctacagaagacaagttagtagaaaagtacactggattataagttatggtagttgggtaattgtgtcatccaaattttggaggtatcagtttcctcatttgtaaaattagagttagtagatgtaaactttttcttacaaactattaacttttgcttttctgttccatttcacacatcaatatttattgagtcttacttagaactcctgtgtataaaatagaatagtacttaatatttaggttgttcttagatatgggttttttcataacacttatatgaccttctatctaacttatctgtaagtatcataagggcaataattattgtttttttgctcattgatttatttcaagcacttttacatatagtaaacactcaacatttgtcaaataatgattaaatgaaacaatacatgtaaagtgcttagcacagtaattggcacaaagtatttgataaatggtcctataaatggttctgataagtggttttattaacacccacagtgccatctcactaagatagttggaagaagttaggatatttcaaagagaagttggagagtactgaggaccacactgttgttcccaaatatttgaaagagcatcacgttacttttaaagaaaaaaaaacatgggccaagaggcagaaactgcagggagacagttttaaaatttggagtaaggaagacctaacaaaactgctcaaaaatgaaatgaactgatgttcaagtaaatgtcaaattactaaatagccagttaatgtggggataaaaaaaatctaactagaggctataaatttagtattccatgaattaaatgatatggaaagaactctatgtttatcatatacaaaatagattttaaaatacccaaaatataaaattttgcaatgcttctggaaataaaatcatacatggaaaatggcaaatattataaaagccaatctatttacttagtgtacatgggatcaaagaacatttgctttttggcaaatacaccatatgactgaaaacaaatgctgctgatttttcttattaatgctggcaaatggagcagataggaatcgtggaattctttattccctatcagaaaaacagaactacttaaagctagattttttttcttttctgttatttttactgcagtggtaacactgcacttcagaatacagtataagaatattggcagttggcatgtttgtgggttgtatgaaactaactggtacatcattcctgccaactagcgacgattttgacaaaatatatgacattgataaaaaaggaatctcactcaatatcatttttattgaaggatgtgtggcctcataccaaaatagccccatcaatctattgccatcagatcggacagaaaagaattgggtacataaaatggctgtcataaaatgtatcccagctggagctaagtctgatcacagacggtcagttaagcatttggaaaatgaaggaagtacatttcccttaataagccatcaaaagttaataacaagtgacttggctctctatttggggcagaaatcctgagaaagatgcagtggattctaaggtttttgctgttctttacactggctacgtgttaataaaaagatatatggtacataatgttttaaaggtatgcaatgaagaagcagcttccctaccacttataagttccagtgttaccatctcagaagtgcacctcattcacacattcaaaactacgatgttgtcttactaattatgatagttaattttatgtgtctagtgcctgggctatgagtgcccagacattttaacagacattaatctgcctgtgtctgtgagagtgttctggatgaaattaacatttgaagcagtagactgagtaaagcagattgccctctctaatatggatggacttcaaacaatcaactgaagacctgaatagtattaaaaggctaagaggtaatgttttttgcctgatagcatgagatggacatcggtctttttcagtcttcagacttggactgaaacattggctcatcttgaattgcaagcctaccaactttcagactgcaaattaatattatcaactttcatagttctaagacctttggacttggattgaaactacatattggctctcttgggtctttaatcacatgaaccaattccttgtagtaaatatcatatgtgtatatatatatatacacacacacatatgtatatacacacacacacaaatttatacatacacatatatatgtgtgcaggacacatatatgcatattttttattatatatgtatatacttttggttttatttctctggagaatttgactaatacactgattcagccacaacaacagggaatgtgctgagttgtgtcaatcaagtgaattatccagataattaaagtcaatctctgtagaagctggtattttggtatcttgtctagaaacaatgtaggtcaccaggcacctacatttttgtgatataaaataacaagccaattttctaatgctttaaaaatgtgctctgaaagcaatccctcattttcaaacccaaaattctatgattcaacattataaaccaagctcatgtagtcattctcaaaatcagctttaaaagcaactatgagtttgagtcatgtttactttccaagtgaattactcaagcatataaaaatccatttcattaccttacagtcatggtttttaggacttaaagatgcatcatcttcatttgttgattcctgttactattaatcagcacatggcggatctacttattttccatgattttctccaggcacaggtgcgttatgaaatttaagctctatttccactgcacagattaagctttgaaagaattttttatcatacactaaaagctacccttcagtgctgccaaattcctggtattaactccatgtaaattttcttattatcactcacctgcccagaagcagaaattctcccgctagacccaggcgcctcatggccatcagcagacctctcaccgtcatgccctcacagaagcaggccaccacccgggccttgggcaagtgacttgtgagcttcttcagcagcttatcaaagctctgctcccctgcattactgtagattttgtaagagtgggcgatgcaaatcccttccttcgctgacatatctttgaaggcttccatcccactttctccatagttgcctgtgtgaaaacatagataagcagagggatagtgaaatgagagtgttgcattaattgggtataatcagaatgcaggtgttaggagcatgaaagtcattggtatgggacttgcaacctgaagacctgaattttggtttttgctcttttgccgaattgcttattttgggcaaattacaattgaaccacattatatatgcattgatcatttatattttcactgtgatggagagaataatataaaaagtgtaagcaattcatcatccttttatgactcaaaatagctcttattctaaatatgagctgatggaaatatttatctgctatttttttgcattctatctcacttccctttacttctcattaatgacaatttcatcccactgagatttttgtatttaaagatatagtacatataagtaatacatgtagtttatatagtatagatgttgccatataaatattttataaagtattatattatatataatattcagtatattatatacttataatcatgagaatttatggtttggtcttaattgaaaaactgagatccttgcttaagatttagtcttgtcgcaggtgaatgtgtaaacttatgaaaaacatttacagttttatcctatacaaccatggggaagttattgataaggaaaaaaagttcaaagtcttttgcaaaatttggggactaaggacaaatgttagtctttaaaaattaatgaaaaggggattaatattgacagtcagctatatgccaggacacaaggacctttatatatgtgatctaatttagcactcacaataaaatattgatgtagctattatgggctccattcaatacatagatcagaaaacagagcagttaggtccatatttaccttgagttacactagcagtaagtggagggctgaactcattcacagatctaatagcataggttctgctccctctacttgtctaaggctgactcttgggagtctcagaattctaattacatccgcatttctctttcccatttcagagtgacaattctccaattttagatatttttggaacattttaaggctctatattttatacagggctcatattctgaattttcaaaatattagatatataagggggattgctttgaagaatacaagaggctattacaagataaccaagctgtagaacatataaggatgtgactgacttaaaaatcaacttgacctaggaactggaatctcatcaggaggagtagatatcaaattaataaggagcactgtgggcattcagttgcatagggttcactacatgtctataactgcaataaatacaactccacaacaatttgattttgggaaagtcagtttatatatgttagctcactgctccttacaacaactctgtgataaaggttaatgttctcttcccttggctgataaaactgaagttcaaatacagatagtaggtgtcaggatcttagtttgaacacaaatctctgattcctgtcctgatgtgggtgctaccataccacaggtaccttgctgcaaatgaaatctgttaactttgagggtggattttggtgaagttttatctccatgaacaaactgcaaagggcagagcagagcaggtcagcttgaatctcagccaaaaatactggtgggccagctgcatcttttccctccttctccagaattaaaagcaacaagaagcctctgtcatgatggcaggtgggcaatctagttattttgcaattaacaaagtttaaagggcactttctgaaaaatgtgccaaagggcctaaattaccagttttacactaatgtgagtaatctattattctttcatttatttttagctaactctgtttttcaacagactgtcttgcatttcatgttttgatttaaggcagaggcatttgcataaataatttgaaattaggtaagtgattgtgatgtgaatttatcgagaatttcacatcatttatttacttttattctcaatacattcactgttaaacaagaaaagacatctaaaaaattcagattatttagcattttgttcctaacagctttaacactgtttatgtttatataatatgttgtagagaagcagcttgaaatagtggagagaactttgttattagagaaacctgagttcaacttcaatttatatagtctttttaatctcagctttctgaagtaacactgcttaatatccagatattttaatattatatttaatgtatgtaaactatctggtaggtcacctgaacccaattaattgaacctactgaaattataaagaatattctagacagagtttagctactctttactggagcatccaaaacaaaacagtggagaaaatggcactattactgtacactagactaaaaaattaagcttacactagcagaataaagtattattttcccagagcaaatcccaagctgtactctttaaaattaaaaaaggcagggggtatatgaaaaattttcactcaattttgcagtgaatcaaaaactgctctaagaaagaaagtttacttgaaacatttaaataagaaacagttttaacacatgtgtgacataaaaattttacagaatataattttgatttaacaaaagaaatcctttgtaagctgggagacaaagagaatatgtcttccaataaaatggaaaagactgaagtgttgagactttctggtagttgatagaaacactgtattctataattatacattttaaaataatgaaaaaatgcagcaaaaaaaagtctacaggcttctcaaataaaaatagaacacatttcaagtaatatgtagaatgaggaaaaagctaaggaagtaactattactttttccaatagagggaaacaagtaactgagaaagaaagctgtggtataaaatatgaaactaacatgtgacttcattttaaataaatagaagtaagacagaatccatagaacgttcttctttaggtagcagagggtttacaacttggaattatgtggagaaaatgtaatcatagcccaatgtcttcactcgtagctcacgctacttacaggtataacgatgcaaatgtcaatcattgattttcaaccttaagaatccacctatagacaaatggaaaaactcattatgcaataaaatatatttgttatcaacttttacaatgacaattaaagagaaagatgatgaagtctgagaggtagatgcagggaaagttgttgggaagaggaaggccattaaagtcactcactcccaatttggaagtcaagatatacagaaaataaaatgtatgtgattaagggaattatttgatgctaaaataatcaggaggcagctaatgtagtgagataattatattaaaagaaggaataagaagatgtacaaggtaagagataatgtctatagtcatttaaaagtagttactttttaaaaagacatattcatattagagatatggaggtgaaaataaaaggatgaaaaactaaaacactttttttcactttaagctctgctgtactatttgacttttgaaaatatgaaaatatacatttaataaaaaaataaactagcatacttaaaagtcattgaaaggagagagttgatgcagataatttttaaagtaattgtcttctctctgctttatcattttatcctgttttagggataaaattcacagaagttctttatatgctactcttggtggaaatgtaaattagtacacccattaatagaaaacttcacggaagttcctcaacaaaactaaaaacagaattatcatatgataatcacccctacccctggctacctttccagctaattttaactgcactctcatgttcatggcagcattatttacaaaagccaagttatatccatcaacagataaatgaattaaaaaatgtggtgtatatatatatatatatatacacaatgaaatactagtcagcctaaaaaccctaaaaaatgggtttaaaaagaaaaatttctgccatttgcaacatcagcatattattcatttttgtaccgctaatgggacctgttagataactaacacatgttgaataaagaaataaattattgaatgagcagtacaaaataatcaatgtctatttccagattaaaataattgcccaactatgtgaccagcaatcaggattgccatattgtgtctagggggcgtcactctaataagctattataaaatatttcacttaaaacatgaacagagttgcacaataatcaaaatatttaccctgaggaccccagttttttcctcagatcgtaacagattttaataattcaacctcaaatactgtttaaagctagtgctttcactaatactatttgacctgaatttcatcagctgggatctggaagtatctgcctacattgaccctataaagcacacattggaaacaggatttgttaaagagtaactataaaactttcttctgtaacagagactggggaccccaaaagggaagaggtcaggaagggagtaagggttgaaaaattatttattgggtacaatgttcacatctggctgatgggtacactacaagcctcaaatccaacaaagggcaatatacccatgtaacaaacctgcacatgaacaccctggatataaaataaaattaaattaaattaaattataaaataaaaaactttctgctaacctaggaaaaatgttttatttgaactgtatattaaaaggcaccaaatcatactttagtaagtaatttgtaatcataggtaaatgctatttcagatggtacaaattcaatatcattaacaactgtgttacattggccactttaagataaagataataaagtataacagcatagacaaggtgtacctagtgagattttcatttttctggcaaaatagccattaaatatattgtttcaatttatcaatctcgtgtggtagggaaaactatcattagaatcaaaaccaaactattataataatagtaaagatacaagtaattttgttttctttgatacttttctttttttcatagtatctttacttctctttccataaatcagaccctgattcactgcatagaagcttgtatactattttatctatcatctcttatttttcattttcccaaaccctaccaaccactattttttgtttggtactttttactattctctttcatatgtatcacagacaccccacatattctcatttatttatttttactaatgctgttctttctacatggaatacatttttccatgttgtacaaattcaattccctagattcctttaggctggagactacatcttctccatagttccattatttaattacggtatttgtataatctctgtaatttgtaattgctaaaaaagtttataattgtggatccttcacctttataacaaggctgattatactcatgatttatttgatgctgaaaacttggttaaaaatataaacaacgatgctgaattttttcttaggaaacatagctcactttaaataatgtgttttatcatgggatttctaaaatgcctcagagtcaggaaatgagttaaggtactaagtattataataaattaaaatagatttctgtattatatatgttgcctattgcatatattcattatattttggatgtatttacatatccttcttttcaaaactgtgagcccatagagggtagttaatgctttatttaactacatatcatcacatggtaggtacttacgtatttcttgtacagaaaagtagtacagaaaaataggcaaaaaaaattttggaagagtaaatacatttttctaagcagaacaccaagcagatgctaaaagaatgtggaaaatactttttcagaaagtattcacttcaggaaatactaaatctttgcaaagaaaaggaataagtgtaaccttctacaatagaactttattttccatcttagttggtccaaattatcttttcctcacaaggaaattaagattcccaatataaacaattattttaaagtatatttcaagtggctttaactactaatatcctgttgctactgtaaacacagttcattttactgacaactactagtgaagtaaaattttctttccttatgtccttattctatgagctttttactatttaatgttgttgtttttgtttttcttactttttaaacttttttcttaaaagtaaagacacaaacaaacatattaacctaggcctacacaggccaggattgtcaatatcactgcctttcacgtccacttccacatattgcccactggaaggcctttaggggcaataacatgcatgaagctgtcatcccctatgataacaatgccttcttctggaatacctcctgaaagatctgcctgaagctaatttatggtgaattttttaaatgtatataagtagaaaaagtacactctaaaataatgataaaaatatagtatagttaatacataaatcagtaacatggtcatttatcattgttatcaagtatgatgtcctgtatataattgtatgtgcggtatctttgtacaacggacatcacagtaggtttgtttacatttgcatcaccacaaacacatgtgtaatacattctgctatgacatgatgatagctatgacatcactagatgagaggaagtttttagatccatatataatcttatgggaccactgtggcatatgcagtctgtcattaactaaaacatcattatatggcatgtaacttttaatttgttaaaatttgcaagtagggaatgagctaacaacaaagactgattgtgtaacacgcatactgatctttttcactccaatggtctttttcatatctgtatgtgtatagatgatacttaagttgtgcatagtttttcatgattttgaacactgttacaagaaacaaatttcctccatttttgattgttttcatttccataaagtaaaatcctgaaataaaaatgaaatttcttggtcaaaatttgaaatattggtcaaacagtgtaactatttagtattttagcaaacttgctctccaacaagttcccaccaatttatactttgattagaagcatatgagaatgcctgtttctccataccttcaccattactggttattgtcatgttattaaatttttgtcaccatattgcttgaataaatgagagttgttttaattttcaaaaaaataaaaaataaaactcagtcatctctcatgtgagttgtgacattagtctggcatgatatcatcccctaaatatacatataagcagtgtccagtctccacttcgtgtcctttaatgtgaattagaagtgttcatcaagagatcttagcccaaactgcccatattgacagggttgtggcttaaactagtgattaaccaaaatggccaggagtgggaaaagcttgacagtgaagcacctcttcttattttattaacagtttcataaagatgttcttttgtttgatgccatttttcccactacagccatatgtgcaatggatgtggcattctaaactctgtattacactcatttgtttatatttatctcctgttactagacagtgtcctttaatgcagatatttctttcacaacaaaacattgtatatacttatttttatgcaaataaagaaggaagttaaatgatgcaagaaatgtgtatacatatttttatggaaagaaagaaggaagttaaatgatccaagaaatattcctaaaaattcctatataattgagatttaggtgtttaggaacctggacatatgattaatgtgaaagttttaaagccaaaggactggaataaaaagttatcattatcatgcaccttcatcaaggtacctgaattataaatgtcatggatacgaaaactttgttaacaaacagttttccaagttttgaacaatggcccaattatttctcatcctgccctggagtctttctataacacgacccatataccacagcattaagcataaggcatggcattattgaatctcatccaaggtgtttattattggaagtaccagaaggatctcatttagaaaatttgctttagttattactctaggaatggattatgtcgtaacatttgatgaactcttcaacagtaaattaagcagaaaacaaattgctagtataattatgtaacaaatgtagataagttataagtttataactatgcatcgccccactcgtggattttaaactatatgtataaaacattatttaaaggaatactaaccagggctactgaatattgccataaaagtacatgccaagtggtttgctgagtggtatgctgagttggtgaattttcttctggctatcaagtatggagttagagaaagaagtttgatcttaagagcaaaggtacatgttgaccaaataaatttagatatggtagaaaacaggaaatcagattatttaaagaagaatacgtgacagttttaactgccatacatgttgaggacaacaagtttgagtgtcatatttggtttggtagattcctgagccctggaatcgaaagttgattctcaacatgtatctactccctccagcaactctagttcatataactgggttgaatgaactgatacaaacataattgaaagaaaaccaaatttggaaagaaatttttaaatttctgtgaaatagccaagtagaaatgccaagtaggaaattaaataagaacattctggctaagagaatagaagtctgaattggaactatttgggagtcctcagtatatggatagcaacaataatagataaaagtgtaggaagtgaaggaaagagagctctgagttataccctaaagaattcaaatatgtgtgcattaactgagaaggaatagctcacaaagacaatgaagaagaagagaaaccaagataatatattcttatggaaatcaggaaaagaaactgtttttacactcttttttttaaaacactctgttgaaaactaaagtaagatgtgtagtgaaaaaaatccactaattctggcaacatagtagaagatatataggagtaggcttgtgtgaatgggagtaaaaaaagtgaagacaatatatttatacaacttttttgagacacttggcactgaacaagagctaagagtatggtggtgattagaagagaatctggaaactcaagaagttttctttgctcatattaagaaggggttattttaggtaaagtacttagcccagagcatggaacagagtaagcactgaatacaggatttttttataatcatcatcatcaccatcctcaacatttatctagatcctgtaaaattatttggtaaaaggttaataataatatgaacaaattattgcactattcactccaaatgtgttattattaaaaccaaccaacctaatgaagttgctattatttcccacatttctaaagaaggtgttgatgctgaaacaatttgccaaataattgacagctagtaaatagaagagctgaaatttcaaccctcattctgtcaaatttcaaagcccatgctctttgccctccatatattgttactcttaagacactgggtaaaaattgttcaatttagtcctgtggttcttccaaaggcctgctactaaatgtttcatttgaaactaattccaaatactactgaattgaatttgtctcagcaaacataatatttaatatataagtattttgcttaatttccaaaagattacagatgtatgtgatttagcactaaatgattcagtccccatgttgctgatagttggtgtttaaatctcagagcctttctacaaaatacacaacgcttaatcatagcttttctatggacaaagtcctgtaaaataagagggggctcttgaaaatagacataccatattatcttgtattagttacttaactacatcattgctgaagagggagaaacttcagagagaccatagaaaatgacaaaaacagtgattttggtgttaaattttttggaatattccaagcttttattattttttaaaatggtttgagatttccataatgaaaaaatcacttttttaatcttcttaaaaatattggagtcttcctcatttttttcctctggctattcttcctagaggaaaataaaaacttgagacagaagctatgacccagattcccactctaagcttccagaattcaacttctttctgctttctttgtaagctgtcaaattcacagctgaagacttcggtgcatgtctcattaaaagtaattccatttccacagaaaggagaaaactctatacggagctgtgtgtcaatgggtcgggtggatcggtgagttatttattttgcctgttttagctcactagccaccaatgatccttgattctaactggatctaatgacaatgcagaaattctcccatcaccagctgaaggcagaaaatcctctacagcgcagccaaaactcttcatgcttgacagcttttgctgaaaaaaagtcgcttctttgacagcagctccctggcctgccgctaccttctccagtttagatctgtgctgtctgggttctgttgtagccagattccctttggaaggacttggtgtctaaacaaagtactgagaggaggaactcaatttggattcagaaatgagaaggaagaattaaaatgtagtataatggctgcactgtcattgttgccaaattttgagcctcatttaagagtgggtaactatgctgtgttcaggcattagagccttggtgactttcctctataatttagacttgtgctgtccagttaatagccacttgccacattgagatgttcagtgtaaaccacaaaatacatttcaaagacttaatacaaaagaaagaatgcaaaatatcccattaatatgtggattacatgttaaaatgatagaagtttagatatattgggttaaataaaatgtattattaaatttaatatcatttatttttactttttcttaaaattataaatatagctagcattacatttctattagacagtaccactttaggcatgcaaagaaatttagatcctatacatttcagggtagaattcaaacttcttaggatatttaatggcatccaaacttttcatgatctgctgcttgactcttctctccagtctcactgcctgccttttcctgaggcacagcacatgctccagccataacaaaggatatgtagatcaaatacactaggcttttttacatctctaaatttcacacaatctctcttattcctggaatacccttctatttagctaattcctacccatccttcaagagttggctgaaagtgacagaattctctaaattaagtttttattgttgttgttgttgctttttctgagacaaggtttcacccctgtcaccaaggctggagtgcagtggtacaatcacggctcactgcagcctcaactttccaggctcaagtgatcctcccacctcagcctcccggttagctgggactacaggcacacactaccacacccagataatttttgtatttttttgtagagactaaatttctccatgttgcccaggctggtcttgaactcctgggctcaagcaatcccaggaggctttgggaagcctcagcctcccagagtgagtgctgggattacaggcatgagctaccacacctggcccacagttctaaacagatatcttccactgtgctgtcattgctcaactcccctccaatgtcataggatattgtttatgttttattgtaattacatatttgtcttactccataaaagactgtgagacagttaaacaaaggggttaattaccctctttatctcaagggcctaggcaacctaagtatttgttgaataaataaattttagaaaatgagcagcaatttttcataagtaaattactgagcatccactatgaatcattgtgtatagcagcttctgttactgaagctactctgcattcattgtgatataaaagcactaaactgggctaagataagatatattatcaaggacagcacagcttagtcacaagtgccctcgacagagtgaggagacagtgattgaaaatctatttgtttgatttatcacttacatggtttttgggaaatggcttaccttttttatgtaaatttgtctcctcaattacaaaattatatgtattctaagaaaccttagagagtggatttttagacctgcttcctacattgttttgttatatatatattttttctttttgtgactagtttatttcacttagcaaactttattgttttttggggaaatatagtcattttcataaaaacattatttatgttaacatgcagagtaaatgaataacaaacacttaaaaatcctcagttttaaattcaaatagaataaatgtcaatagatatatccactgcatatttctatggtgccaatagttgcattactctaattataaaatttaatgtttgtctttttactatatggtgactagtgtgacaaggactgtgtagtattgatattgtatctacagggaagattttattttttcattttttttaagttctgggacacatgtgcaggatgtgcaggtttgttacataggtaaacctgtgccatgggtatttgctgcacctatcaactcatcacctaggtattaagcccagcatgcattagctatttttcctgatgctcttcctaattatcatcagagcaaacagaccatctacagaatagggaaaaatgtttacaatctatccatctgacaatggtctaatatccagagtctacatgaaacttaaataaatttacaagaaaaaaacaaccctattaaaaagtgggcaaaggccatgaacaaacacttctcaaaagaagatatttatgcagccaacaaagatatgaaaaaaagctcaacatcactgatcattagagaaatgcaaatcaaaaccacaatgagacaccaattcatgccagtcagatggtgatttttaaaaagtaaagaaataacagatgctggtgaggttgtggagaaatgggaacacgtttacactcttggtgggaatgtaaattatttcaaccattgtagaagatagtatggcaattcctcaaaggtctagagtcgaaatgtcatttgacccagcaatcccattactgagtatatacccaaaggaatataaatcattctattataaatatacaagcatgtgtatgttcattgcagcactattcacaatagtaaagacatggaatcaacccaaatgtccatcaatgatagaccagatttaaaaaaaaatgatacatatacaccatggaatattatgcagctataaaaatgaatgagatcatgtcctttgcagggacatggactaagctggaagccattatccttagcaaatgaattgggaaacagaaaaccaaacaccacatgttctcacttataagtgggagctgaatgatgagaacacatgaacacagggaggggaacaacacactcatatatattatgttgaccacatagacagtagagctgaaaatagcctaaagagcataaaaaactgtaaaatatgttaaaaggaattatgtttaattagaattgtctgatatttaacttttatttttttatagcttaattattgtttatagaatttaatttttaataatggctgtgtttaacaagagacacttaaaaatttaacatttctcttacaattgcctagatgagctggttccagcacaacactggactatgccaataaaatatcctaaaattcttctagtcaatgatctctgtcatattttcagttactccatgactttgaagggaccactgacttaactggctataatagagactccctttttataaagatccagtacaataaaggtgaacgtttaatgatgtagaatggaaaatactgtcatttctgttttgctgtactaggaaaaggtctgttcataaagtataatttaaatgtgaccctgcagaaggagttgactttggcattctagatggagtaaacagagcataggcaggttaaagtgggtagtatgtggtcaaaatccagtctgcctacagttgaggctatatgatgggagggcaagtaggctaagattacaagggggaggcccaaacttgatacataaagaggtgcaatagaagaggtttctgaaggcaggtaacatgaattaaactgcaagtaagactacactggcaataataggttaagagagtacagtggcgctccagaaggatacaatagagtattacaatgacagagtttaaaatgaacaaaggtgtattcttaggtattttattccctttgtagcaattgtgaatgggagttcactcatgatttggctctctgtttgtctattattgttgtgtaggaatgcttgtgatttttgcacattgattttgtatcttgagactttgctgaagttgcttattagcataaggagattttgggctgagatgatagggtttactaaaaatacaatcatgtcaactgcaaagagacaatttgacttcctttcttcttatgtgaatgccctttctttctttctcttggctgattaccctggccagaacttccaatactatgttaaatatggtgagagagggcatccttgtcttgtgcaggatttcaaatggaatgttgccagtttttgaccattaagtatgatattggctgtgggtttctcataaatagctctcattattttgagatactttccatcaatacctagtttattgagagtttttagcgtaaaggggtgttgaatttcatcgaaggccttttctgcatctattgagatagtcatgtggtttttgtcattggttttatttatgtgatggattacatttattgatttgcatatgttgaaccagccttacaagggatgtgagggaactcttcaaggagaactacaaaccactgctcaaacaaataagagaggacacaaataggaaaacattccatgctcatgaataagaagaatcaatactgtgaaaatggccatactgcccaaagtaatttgtagattcaatgctatccccatcaagctatagtaaccaaaacagcatggtactcatatcaaaacaaatatatatagaccaatggaacagaacagaggcctcagaaataacaccacaaatctgcaaccacctgatgtttgacaaacctgacaaaaacaagcaatggggaaaggatcccctatttaataaatggtgttgggaaaactggctagccttatgcagaaaacgaaaactggatcctttccttacaccttttacaaaaattaattcaagatggattaaagacttaaaagtaatacctaaaaccataaaaactctagaagaaaacctaggcaataccattcaggacataggcatgggcaaagacttcatgactaaaacaccaaaagcaatggcaacaaaagacaaaattgacaaatgggatctaatcaaactaaagaccttctgcacagcaaaagaaattagcatcagagtgaaaaggcaacctacagaatgggagaaaagttttgcaatctatccatctgacaaaggactaatatcgagaatctacaaggaacttaaacaaattacaagaaaaaaaaacaaccccatgaaaaagtgggtgaaggatatgaacagacatttcgcaaaagaagacatttatgcagccaacaaacatatgaaaaaaactcatcgtcactggtcgttagggtaatgcaaatcaaaaccacaatgagatgccatctcaggccagttagaatggtgatcattaaaaagtcaggaaacaacagaagctggagaggatgtggagaaataggaacacttttacactgttggtggaagtgtaaattagttcaaccattgtggaagacagtgtggcgattcctcaaggatctagaaccagaaataccatttaatccagcaatcccattactgagtatatacccaaaagattataaatcatcctactataaagacacattcacacatatgttgcagcactattcacaatatcaaagacttggaaccaatccaaatgtccatcagtgatagactggataaagaaaatgtggcacttatataccatggaatactatgcagccataaaaaaggatgagttcatgtcctttgcaggcacatggatgaagctggaaaccatcattctcagcaaactaacataggaacagaaaaccaaacactgcatgttctcgctcataaatgggagttgaacaatgagaacacatagacacagggaggggatcaccacacactggggcctgtcaggggattggggtctagggatggatagcattaggagaaatacctaatgtagatgacaggttgatggttgcagcagactaccatggcatgtgtatacctatgtaacaaacctgcacattctgcacatgtatcccagaatttagagtataataaaaaataaatacataaaaataaaagcacataaaatgaacaaaggcctgattttggatgtttaccatgaaatgaagcattgacaatatgcaaggccactttttaacataatttgttagagtttgacattctcctggaatacaaagtaaataatgatctttggaattatgctatacaatcttggcttttgttgcctttgctgttggtgctttagtcatgaagtctttgcccatgcctatgtcctgaatggtattgcctaggttttcgtctagagtttttatggttttaggtattagtttaagtctttaatccatcatgaattaatttctgtaaaaggtgtaaggaagggatccagttttagttttctgcataaggctagccagttttcccaatgccatttattaaatagggaatcctctccccattgcttgtttttgtcaggtttgtcaaagatcaggtggttgtaggtttgtggtgttatttctgaggcctctattctgttccactggtctatatatttgttttgatatgagtaccacgctgttttggttactgtagccttgtcgtatagcttaaagtcaggtggcgtgatgcctccagcgttgttctttttgcttaggattgtcttggccctacaggctcttttttggttccatatgaaatttaaagtagttttttttctaattctatgaataaagtcaatggtagcttgatggggatagcattaaatctacaaattactggcaaactgttacttcatttggggttgaatatgagaaaattcaagaagcttagtttagaggctaatgtagtaaggagtccagatgagaaacaacagtaacttgaaagaaagtgatgaaagcaaagactataccatacataggctgttcagttttaggatgttttattgcgtcttttttcataagaagtttatattaacttcttagtgtcatgtcagagcactgctggcttttgttataggccaaactgtgtcttatagaaaattcctatgttgtaatcctaaccccaagtacctcagaatgtgactgtgtttgtatacaaggtctttaaaaaggaaactaaggcaaaaaaatcatatgggtggtccctaatctagctgaatggggtccttataggaagagattaagaaatagacatgcacattatcgtgtgaagatgcaaggagaagatggcatctacaagccaaggagacagatcctcagaaggaacacagcctattgagaccttgttcttggacttccagcctctaaactataaggaaatacatttctgttgtttacgaaccactgagtctattggtttgttgttatagtatctcaagctaactaatatagtcctctgcagctgaccaaaactttcagtcacaaaaagtacccaaatccttaggctacatgaaattaattttattgtcatagagatcataatacttggaaagggcattggcctttgccatatatagactgagtttgattcctgtatccacaatttcctagatacatgaccttagacaagttatttaaatgtctctgagcttcagtttctttaatcatatcagatatagtaggccaatcaccagaccaaagtctggcacaggatagacactcaacaaaatttagtttctgtcttagctctcataatttcttcttctcagtaggcaatcataaagagctcttatgagaatggctctgaaattagatgaaatttgaacttcacttgaattaatcaaagctgatttcaaatcccggctctgacatctactagtttggatgtttgagcaagttattaatctttctaagtcttttttttctcatctataacattttcataaggtggttatgaggattaaatgcgattttgcatggaaagtgcttatatcagagcctgacatataaataaggctagagtagtattttttaatattaattacacacatttttatgagttcttattttgctactaacttcttagttgttggtgtttgtcacaactatgacacattcctgaatgaaaaccatctattctccatgtttcactaatacctatggctcctaacttatattctcagttagatacctggcaaatgttaattcaactattgccaagcattctttctagaaatttaaaactaaaactgctcattagatatgcactgagtattcagtagtttttccaaagtaacagcgtcttagtacttcttaaaaacatggtccttgtctctattgcctatgtgggcacctcacaaagcaaattggaacagatataacccctgtaatcagggatcttaatagctaaagcaccttgattggattcccctagtgttttaacaaaatcacttatggtctaattctcctgtcctcattttgctgctgatgaaatcccacgatagtaccaaagtattggcttttttcaactctgctgcactaatgtctgctgttttccttccacactaatcctttaatcatacctttgagataccagaatgtaaaaaccacttgggattacctaacacacaggaatagcaagttttgctctgaagcagatggaagcagccaatgtggctcctttttttcctttaatctcaagatatctgtaattctgcccaagcctccaggggacacttctggctaagaaaaatcctggaaatggaagtcctatctattcctatttcactgaaagggtgaatcacttttagaaacatttcaaggactcaggattacactgggtcatgagtttatgaaattgtgtaggtagctatggaaaaaaggaaataatcatggatatgctttaattttaattaaaaactcattattattgatacaaaaaatggtacctgtccagtttccaagaactccagcaatgcaatgactgttcataatcccttttcctggaaatagatccctgtttctctgtttatttgatgtgtgtacatgatccactttacttaataaattgtaaggcataaatttttaaaagtgttataataatttatattaataaagtataattttattttagatttataactcttcaacccccaacctcagttattggcttaaaggactgagatgttacctaaactgctcatcgggccttttgcttatgtttttcaaactcaagctaatagagaatcactttattccttgaaaaatatttttattctcttcaaaaatgtgagccaacagcagtcattagtcatggttccaacctcatgaagaaatgaaaagagagaacaatgcctctataaaaaagaggggaaattaataggtgtaaggaggtaaatctgtcagtataaaatccctggttatatttttttagtggcccctactatatccctgttttttcacaattacataaacaagtagattctttttgcttgattttaatttccataacttacagtgatagcatcctgtctttctaatagaagtaagaaaaaatataagggaagaaataattctagggagaggttagaactttagttaggccacaaagaacgggtagaaaagaagaaatacttcactatatgagaggatattctagatatgggacagagctttatagggagtggagtgacagatatggacataaagtatgtttttggttgtcattagatttttctgaatcatagggcccatatgggtgaacaatgggagaaagcactaaaataaagagaagtccccaagacagacagagttgcaacctagtaatacactaggcaatgcagatagtttatgtctcaagcatgaaagttatagaatgaaaataatatttaaaaatatttttctggcaaaggttcataagggtgactggaggcaaaaatggtgtgtgagagagatccattgagaagctactgaaaaaaatccaattgtgacatgacaagaactttaataggtcacagacaacagaaagcaaagaaagagttaatcataaagccacttctacaaagaaatcatggtgtttggtaccatattttgtctagggctaagtaatgcataaaaagaaagaattaagaatgatttcatagtttgtagtctgatagaccaactaacagataggatagccaggcagtagaagctgatgtttgaaagggaatcttgtgttccattgtggacacatggattaccacaaggaatctacaaaacgacattttggactcaaaaattaacctaataatggagctctcatgagaggtctgggcagtgggggatatgggtgtacgtgtaaaaatgagaggtaaagccaagaaactgagtgaagagaaagaacagagagcttacgccagagcttttgctcagaattaaataaacgattaaagggaagaaaggttgtttgaaaataataataataatagattgaatactcccactcaatacaaagaaatgctaaatgtttggatggtggatatgctaaattagtgtgatgtgaccactgtacattatatgtatgaaaacaccactatgtactccatgaatacgtacaattattattgtcagttaaaaataaaatttaaaaatgttgaaaaaatgtatcaatgacatctaacattattgagagttagagttgggtaagcttttatgcacataatctcaatgaatgttcaaaacaacccagtgagactggaatgaaatattatcctcatttcccagatgaagaaactacagcagagagattaaacaacttactcaaggtcaaataactattaaagggacacagaataagaacttaaaatcagttctaatatcaaagcttaggtatttatacacaagcctgttcaacctactgcaggaaagaaaagaggtcactggaaatagaggagacctacatgcatctaagaaagatgatgattccagaatggaaaggtgccctatagtgttaaatgccataatgcaaataaagataactaggactgaaagaaggcagcaagacatggtggttagtaacctgtagcagcactgtcttagtgaagcagtagagcataaatcagacttgagtgcaaagtttggatgaagaataggaggtaaaaagagtatttatggaatgcaaattctagtatatggaaatgaaagaaaggagagaatccatctaagccaggtaaatccacattagcaaggaagaccctagcatattaaggaagtttttattcatgtaatattttcattcttcagagttatttaaaatactgtgtgtactgaaaaggaatttataggtgttgaacaaattgctgtaatttcaaactacataacttattaaagttatttactagactcttaaatatcttgtaatcccataacaaaaaggagataataggttagaaataattataccctataaacagatgaaaaaaaaagttcaatagaattcattaacatactgaaggtcacaaaattaataaatgttaggaaaaaaaacaggctgctgaattttatcaagtactgtttccattatatcacacagaaacctgtaaatctaattatcattcaactaacagaaaaacctacatttttagtgagaaacaaaatgagatggacagagaggaacaaattaacattattaagcattgttaaggtattcctggaaatttttgtgagactaatgaaagctacatgtttcagaagatatcatattatcataaatgcacagagtaatgaaatataaaattaatcaccaaggaagaagcatattaagatgcaggaaacaaggcactaacacagtgtaataagataaattcaatcatctaaaaattataatacaaagaagtgatgcaaattagtaatcatttaaattttacattttattaaagtgagccttctaaaagataaattcattataacttaaggtgaggctgcaattatttctccttcaagacctttatatttttatatattagctattattattaagagataggcaatatttaaaaatatataaattgtgagggaggcagaagaagatggcaaatagaaagctacaaagatcttccctctcccactgcaaggaagggatgaaaaatatatttcacacaaatagaaactagaataagagattttaataaacagacctgaatcactgacaccaccccttcctcaccctggcagtgacagagagcatctctgggaatttagagagggaaaacacagcaattgtgaggtattgaataaaaaacaaggaatcaaagcatattactagaaaaaatcacttaatcacaaagaacaaatgtaaaagaagaaatgaaaaaaggatcaacaaatcaactggaaaacaagtaacaaaatgacagtagtaaccccttacctatcatttaccttatatgtaaatgaaattcttcaatcaaaataaaacagaaaggctgaatgaattaaaaaaaaaaagacccaactatatgctcatacaagaaactcatttcatctataaagatacacgaagactgaaagtgaagtaaggaatgaaaaagatattccacacaaatggaaactaaaataaagcaggagtagctatacttacattaggcaaaatagagcttaagccaaaaactgtagaaagataaagacactcacaatgataaaagagtcaatagagcaacaggatataacaaatataaatatacatgcactcaacataggagtgcctaaatatataaagaaaacattaatagacttaaagaaagagattgcactgcagtacaataatagcggtgggtttcaacaccccacttttagcaatagacagatcatccagatatagtgaaatatagtttatttacatagttaagccacactgtagaccaaataaacctaataaatgtttacagaaatattcacgtaacagcctcagaatatgtatttttctcagcagcacatggaacattctccaggatagaccatatgtgaagtaaaaaaaatactcttatcacatttaaaaatgttaaaattatatcagataacttttctaaccaaaatataataaaactaggaatcaataacatgaagaaccttgggaaatgtacaaataaatgaaaattaaacaacatgctcctgggcaactaatgagtaatgaagaaattgtgaagaaacatttttgaagaatattgatacaaatgaaaatggaaacccaacataccaaatcctatgggatgttgaaaaagaagttacaataggaaagtttatagcaaaaacacttatatcagaaatgtagaaagattccaaagaaataagcaaaagttgcatttctaaaacctagaaaaatgagaacaaaataaaccccaaactagtaacagagtgaagaaataataaagatcagagcataaacagaacatagactaaaaataaacataccacagaaatacaaaggatcattacagactcttataaacaactatacccctaacaaattagaaaacctagaataaatggataaatttatggatatgtacaacctaccaagattgaataatgaagacacagaaaaactgaacacctgaacagaccagtaatgagcaatgatattgattcagaaaggaaagttcaacactggatatattcactgccaaataattctatcaagcttttaaagaaagaaataataccaatctttctgagatgatttaaaaaaaaaggaagtacaaggaatccttgtaaattcatgcttgcatggtatttgcataaaaaacagacatatagatcaatggaacagaatagagaacccagaaataaatccatgcatttccagccaattgctttttgacaaagtatcagaacacacattagggaagggacagtctccttaataaagggtgatgataaaactggatactcatatgttgaagaatgacactataaccgtatctcttatcacttacaaaaatcaactcaaattggattaaagacttaaatgtaagacctgaaactatgagatactagaagaaaacacaggaaaaaaatgctttatgacgtggatctgaacaaaggtttttgcaataaaacctgaaaagcagaggcaacaaaataaaaagtaaacaaataagagaattatatcaaactaaaaagcttctgcacagcaaaggaaaaaatcaagagtgaagagacaacctgcagaatgggagaatatatttgcaaactatgcacctgaaaaggggttaatattaagaatatataggtatacaagggaaatattgctgttttgatttcagaccattacaataaagcaaatatcacagtaaagtgagtcacaaaattttttgcttttccagtgcatataaaagttataataccacactgtagtttatgaagtgtgctataacattaggtttaaaaaatggacatactttaattttaaaatatgctgaaacatgctaatgaatatctgtgccttcagcaaggcataatgtttttgctgatagaggatcttgtcttgatactgatggctactgattgatcagggcggtggctgctgaatgtttgggtggctgtggcaatttcttaaaataacaatgaagtctgccacatgaattgactgttttttttttttcatgaaagatttcttggtagcatataatgctgttggataacattgtgcccacagtagaactgcttttaaaattggagtcaatacactaaaaccctgctgctgctttattaactagatttaggtaattttctaaatcattctcatttcatcaaggctcacagcatctttgctgtagcagattccatctcaaaaaagcacattctttgcttatctattagaagcaacttctcatccactcaagttttaccataagattgtataaattcacattgtgaggctcaccttctaactctggttctcttactcttctaccacatctgtagttaattcttctacttgaagtcttgaacccctcaaaatcatccatgagggttggaatcaactttttccaaattcctgttaatattgatattctgacccactcccatgaatcactaatgttattaatggtaattaaaatgttgaatcctttcccagagattttcaatttactttgcatagattaatctgaagaatcacaatctgtggcagctatagcattatgaaatatatttctgaagtaataagaattgaaatccaaaatttctccctgatccatgagcttcaggatagatgttgtcttagcaggcatgaaaacaacattaatctccttataatttttcatcagagctcttgggtgcattgtcataaagcagtaatattttgaaaggaagcttttcttcttaagagtagttcttaactgtgggcttaaaatattcagcagagcattctataaacagatatgctgtcatccaggctttgctgttccatttttagagcacaggcagagtagatttagcatagctcttaagggccttggggtttttggaacaataaaagaacactggcttcaacttaaggtcaccagccgcattatctctaacaagagagtcagccgtcctttgaagccttgaagcaggcactcacctctcctctctaggatggaagtcttagatagcatcttcttccaatacaagtctgctttgtctacattgaaactgtattgtttcgtgtaaccacctttatcaattatcttatatctggatgacttgctgcaacctctacaatagtatttgctactttaccttgcacttttaggttatagagatggctactttccttacactccattaaccaaactctgctagctgcaatctttccttctgaagcttcctcaccattctcagccttgagccagttgaaaagattcaaggccttgctattaattagactttggcttaagtgaatgtggtggctggtttgatccaggccactaaaactttctctgtatctgcaataaggctatatcagattcttataatttgtgtgttcactggagtagcatttttaaatttttcttcaaaaattttttatttgcattcacaacttgactaagtggcacaaaaggcctagactggttagtgtatcggggcttttgacacaccttcctcattaagcttaatcatttctagctttcatttaaagtgagaggcatgtgactctttcttccagttgaaaatttagaggccattgtagatgattaattggcctaacttcaatattgttctgtctctgacaacagggaagccccaaggagcaggacacaaaagggagagtggcccattggtggagcagtcagaacacaaacgtttattgattaagttcaccaacatagataggcatgatttgggattccctaaacacagataaaaaatgtggtatataaacacaatggagtactactcagccataaaaaaagaatgaaatggtgttatttgtgacagcatggatgaaactggaagacattatgttaagttaaagaagtcacgcacctaaggcctaataatgcatgataccaatcataattggaatcttaacaagttgagctcattgaagtagagagtaggatagtggttaccagatgctggaaagagtagcagggaagaggggaggggagaagtcagtcaaatggaacaaaattacagttagataggaggaatgagttctggtgttttattgcacagtagtgtgactatagccaagaataaggtattatatacttcaaagtagcaagaagagatgattttgacaagtatttgaggtgaataatatgctaattaccctggtaaattagcacatgaaaatatttccatcattagacattagaagaatgcaaattagaaacaattagataatttcacacaagtattagaaagactacagtgaaaaaaagaaactaaatgctggcaaagatgtgaagcaagggcgactcatacattattggtgagaatatgaaatggtatagatatttggggaagagaaatatttatctttttcattaagcagtttattattattattattaaggcagtttatcattaagaaatataacatatcaacctggcccagtggctcatgactgtaatcccagcactttgggaggccaaagcagatgtatggatgtatggcttgggcacaggaatttgagaccagcctgggcaacatggcaaaaccctgtttctacaaaaaaaatatgaaaattagctgggcatggtggcacatgcctgtagtctcagctacttggaacttgggaggctgaggtaggaggatcacttgagccctggaagcagagattgcaatgagccaatatgctgctgctgcactttagcctaggcaacagagagactctgtggaagaaaaaaaaaaaagcagaaagaaagaaagaaagaagtaaagagggagggacagcattgggagagatatctaatgctagatgacgagttagtgggtgcagcgcaccagcatggcacatgtatacatatgtaactaacctgcacattgtgctcatgtaccctaaaacttaaagtataataataaaaaaagaaggaaagaaagagaaggaaagtaaaatataccatatgactcagcaatcttattgtaatcatccaagagaaatagcaatttatgttcacagaaaatctacacaaggtttatttatttactccaggtatataaaattgccaaatttggaaaaagcaaaaaagcacagatgttcttcgataggtgaattattaagcagaacaccatgcaccagttgccaatccctggagaagactccaaatatttctgcccattgcattttggtattgcagttatcatgggaatcacaacacagtcaagcactggatggaacaactctttattcacatagagaggaaacagagaaaaattcattctgagagtatttttcaataccccatggccagggggtctctcccagcaatgaatgcagggtaattgtccatgcacactccttgagtaccacagaaggtccctattccctccccacagtggagctggccaagtgccaagggatacacttgcttaaacagaacaaagggacatatactaggctggcaacggagaaagatattctcacacaaggcaataggccctgcacaggtggtgtgcactctttttatcttggtaagaaagtattccaggcccaaaatccattaggtggctaagtaggagaaagactgtactcatgagactgtcttttccaacatgaatgaattaacgaagtgtagttcatccatacaatggaatactcatcatcaataaagagaaacaaactagtagttcatgcaatggcttggaaaaattccaaatgtattatgctaagagaaagaaattagactcaaaaggtttcatactgtatcattccatttagggctttctggaaaagacaaaactataggaataaaaatcagatcagcaattgcagaagataaaagagactggcacaaattacgtttaggcaatttggcggaggggttgatgaaaattttctgtacctagttctggtgataaaaatgtgtatatttgtcaaaagcaataaagagagaattttttcaaaaagtggattttgttgtatataaatttagatgtcagttataggataagaaatactatggaaattgtaaataaaatataaaatgtgaggaaaaattttgtataaatatttaactgagaaggactctaaatataaatgtaataaaaggggttatgagtgcaaattgaatagattaaatagattaaaatgtaacattttcctctcttaaaaataacaaactgggaggaagtatctggtaatcacagatctgacttgtatccagaatatagaaagtaatcttagtactcaacaacaagaaaataaacaattcaattttttacattgggaaaattttaaatagagataccataaaagagcttaagtctttaagttagatattaatattatattaataattaataaaaaatggcaatgctagtagaaaaatgaataatggacaatagcaaatttcaaaagagaaatttagagtaataaataaatgtaagaaaaatacacacattaaaaaagctggtgagaaatctacctgtaaccagtctccttccctttctttattttataatgtcagccatatgtttccaagattttcatcacctttctgtatttatatgagcatatttttccttgattaatatgaaataattcctgagtaaatattttttacctgtttattttatctaactttcatctaccttggtagatgaaatgatcagtatggcaagcattatcagataatctgcttttagtactatgaggctctcagcagattgcctatagagctgaaatcacagctctttctttgcagcaaattttcagtctttattaaatattacttaatatttccattaggatggaaggtggggtgggaggaaacaaaactaaacactagccttattatagagaaatagatgcatgtatttaatgaataaaatgaataagcctttaatgaagtggtttgggtacacagggaatttctggagaaatgcttgagatttcaatatgaaagactggagaggagatggtatgagaattttgacatgagccagccaagtcttagacaagaatagaagcatcttttgctaggcatgaaatagacagcatgcaatttttggctgtttgattgccaacaaagaacgctatgaggcagggaagagagagaaaaggagcatgaaataaaggaaaaagaaggtcttaacagaaacaaaaatgtgaagagcaagcaatgcgtaaatattaggtagagcacatgaataaataaaatggaattgcaaatatgcattgaagagattatggcaataggaaaaaagtgagtaaaaactgtacattttgtatatttctctaactcatattattcattcattctaccaatatgtattagtcagctcttttgtgaataggaccccaaattggcatagttctatataagaataacatacactgaattaaccttataaaaagccttccttatatttacatttaaacaacaaccctggaatacaattctttcctcattttaaatttgaaatttctgaattactttaaagttatttctgagcaagaacttggtaggaggtctcctgaccctggtccattgtgtttcccacaaaaccatttgacttatatcatgacaagacatgtggcttcaaaaatttgttatcctatcgggaaatcttaagcaaatagaatgttttaaaggaagcaagatttactgacaaaggagaggtacgaacaattaagtgtgttgggaagtgtctagactttaaagtcttattggattgggttcaattctatttctgcacatactatttgtgtaactttacacaaattactttaacactcagtgtactgtctggggaaaaaattgcaatacctatcttatagaattgttgtgaaattaaatagttaatataggtcaagaaggacacaacactgaccctaaataaatgacaggaattatggtaaaaggtaataacattgtatattacagaagtccaggaaagcctaaatgaaggtggtgttttctttgatcccttagtaggatttatatagtcaggggaaggacattaagtgacatgtatttttcagtgtaagcttcaaatttaaaaaaaaaatattattaaaaataagactgtgttaactccatctcattttcttttaaaggaatcctcttaaaaactttaatttttaatggatttgagactttaaaagtttgagactgtcataatgattttaaacaatttctttaaaaatgttaccatgctcaaccataataggcctaaaaaaaaaaaaactgtcaccttgatttcttcaactatgatgatcaacaagagatgaacttgatggatttaataactgtagaaagttacttggcagagggcaaaagataaacatcttctgcgataaaataatgatattaaactataagatatcaaaagaatctgaaaacttaaaaagcaagttagtttggtttcagttatatggaatagcaagcaagcacgtatttattttctcttcactagaagaaaagcagtaactcttcaaaaagatgaaaccgagttcaagtataaatggagactgtagtaacaaaggatgaaaaccatgtgaactcagttctcttagacttttctagttctcatttaaatagtggccatttgttttgctcttgctaacttcagcttcaatactccaatttcctatgggagactttcaggttttgtgaaacacaaaacagaaaaaaaaatccttattgttctgtgaaaattacaaactaattatttaaaaattttgaatacaaatcatatcctacttaagaaagaatccaatggcataataagtacttatataaaactgaggctttggagttcttagaaatttttcattttctatacaaaatacaaatcagaattgatggaatgctgggcacgttggctcacacctgtaattccagcaccttgggatgccaaggtgggcagatcacttgagctcaggactttgagaccagcctggtcaacacagggaaaccccatctctactaaatatacacaattagctgggtggggtagcatctgtaatcccagctatgcaggaggctgaggaaagagaatcgcttgaacccaggaggtggaggttgccatgagctaagattctgccactgcactccagcctgaacaacagagtgacactctgaatcaaaataagtaagtaaataaataaataaataaataataaaaagaaaaatatcatgcctgtaatcccagcactttgggaggccaaggcgggtagatcacgaggtcaggagatcgagaccatcctggctaacacggtgaaaccccatctctactaaaaatacaaaaaaaaaaaaaaaattagctgggcgtggtggcatgtacctgtagtcccagctactcgggaggctggggcaggagaatggcatgaacccaggaggtggagctcgcagtgagccgagatagtgccactgcagtccggtctgggcaaaagagcgagactctgtctcaaaaaaaaaaaaaagaattgatagaatgaaattcacctctcattcagccccttgtaaaattgtgtggagactacaatttatttattatattaataaatatgtcaggctatcaatagctaataatttcaataatttcattgaattcaagatcaaacagctgatgttatgtttattattattattaattatttgtatttccatatgacaaggtttggctgtgttcccacccaaatctcaaattgtagcccaaataattcccacgtgtcatgggaaggacccagtgggaggtaactgaatcatgagggtgggtctttcccatgcttctcatgaccgtgaataagtctcacaagatctgatggttttgtaaaggggagtttccctgcctatgctctctctcctgcctgccaacacgtaagacatgactttgctcctcttatgccttctgctatgatttttgaggcctccccagccacatgcaactgtgaatccattaaacctctttcctttatagattaaccagtcttgggtatgtctttaatagcagtgtgagaacagactaatacagtaaactggtactggttgagtgaggtacttctgtaaagataccccaaaatgtggaagcaactttggaagtgactaactgggagacaatggaacagtttggatggctcagaagaggacagaaagatgtgggaaagtttggaacttcctaaagacttgttgaatggctttgaccaaaatgctgatcatgatatggacaatgaagtcccattcaggtgatctcagatgtagatgaggaacttgttgggaactaggtcactctttctatgcaaaaagactgtgggcattttgtccctgctttagagatctgtggaactttcaacttgagagagataatttggggtatctggtggaagaaatttctaagcagcaaagaattcaagaggtgacagggcataaaagtttggaaaattttcagcctgatgatgcagtaggaaagaaaaaccaattttctggggagaaattcaaaccagctgaagaaatttgcataagtaacaagaagtcaaatactaatcaccaagacagtggggaaaatgtctccagggcatatcagagaccatcatggcagtccctcccatcacaggcctggaggcttaggaggaaaaaaatggtttaatgggcagaccccagggcccacttgctgtaggcggcctcaggacatggtgccttgcatcccagctgtttcatctgcagccccaagccttggcaacttacacatggtgttgggactgtgggtgcacagaagtcaagaattgaggtttggaaacttccatatacattttaaaggatgtatggaaatgcctgagtgtccaggcagaagtttgctatggggtcagggccctcatggagaacctctgctacagcactatggaagggaaatgtgggactggaggccccacacagagtccccactagggcactgcctagtggaattgtgagaagaaggccactgtcctccagaaacccagaatggtagatacacctatagcttgcactgtatgcctggaaaagccacagatactcaatgccagctcatgacaagagctggagccctacactgcaaagtcacaggggcagagttgccccaagacataggaacccacctcttgcatcagcatgacttggatgtgagacatggagtcaagggagatcattttcgaactttaatgactgttctattggattttggacttgcatggagcctgaagcccctttgttttggccaatttcttccattttgaatgtgtatatatacccaatgcctgtaccccactgtgtctaggaagtaagtaacttgcttttgattttacaggctcataggaggaaggaacatgccttgtctcagatgagactttggactgtgggctttttagttaatgctgaaatgagttaaaccttttggggactgttgggaaagtatgattgtgttttgaaatgtgaaagggacatgagacttgggaggggtaagaggtagaatgacacagtttggctgtgtctctacccaaatcttgaatgatagctcccataattcccatgtgtcatgagagggacccagtgggaggtaactgaatgatgagggtgggtcttccctatgctattcttgcggtagtgaataaatcttatgagagctgatggttttataaaggggagttcccctgcacatgctctctctcttgcctgctgccacataagacatgactttgctcctcctctgctttccgccatgattctgaggcctccccagccatgtggatttgtgagttcattaaacctttttccttataaattacccagtcttggatatgtctttattaccagcatgagatcagactaatataccatatttgtccttaaaattgaataatatttccacatttcaaaatttccacattactgccttaactgaattactcattcctaagatctgaaaagaagccattttttaaaataatattttatttatatatgtttataaatgtttctgaatttatatatattataaaatgaggtacatcccattcttgttttatcctattttttaggctctagtttaaatcagtttaaatatataattgttatgttttagatcttccatctactgaaccacaactcaatgtgcagaaaggaaaaaaatacaaaccaagattaaatcctctgaagcatatgttttataaagacacaagtggcaactcaataaaagtattatgattattccacttaaatttcattataattagaaatccttctatagaaaaatccattgagaactttgatttttaaattacagtcatcattagtaaaatttctgaattctatagtaggtaccatgttttttttttttttttttttttttttttttttttttggtaaaccagctgtgtttgaagctgggagttaggggactttagaaaggtatttaaatagtacagtatccctccttaaaaagtttttcagctccagtaagagaaacaaattaatatataaataaggtttccacagataacctgcctttaaaacaaaccaaaccaaagaggcaatatgcagttctcataaaaaaaaatctccagtctctttgatatagaagttaaaaagaaatcacttagggagatagcaagggtttgggaatcctcagtcacactttttacctcatgaaaagcagccccaaatcatttactaacaaagagcagcctggaaagttgagctgcagaggtagacaagtgagctgagagcttgcacaggtgaatgttggcaggaactgaggactagacattttcaagatggcagctccattcttcccttctctgccagccatgtatactgtaaagagcagacgagatggtgccgatcaactggaaagcctatttgcataataagattaaggtggggtgaccagccttctctgcactctatgtaaacatcatacctgatcaaaccaatctatgagccctgtataaatcagacactgcctcctcaaactggactatatattttggtgcatttgcagccagccagtcctttccactcagagacctgtatctctatagagaaagctgtttctctttctcttctcttcggcctattaaacctttgctcgtaaacttctcatatgtgtctgtgtcctaaattttcctggtgcgtgatgacaaaccctgggtttacaccccagacatagctgctttataatgggggctcgtccgggataacaacatacaacattcatcgagatggtgagtagaggagcagactccaactctgtccttttattctgaggcccttggcttccattttagaaccagatcaaaccaaatacggggcccctttcagccatttaaaaataattagcatggctgccagccttacaagacttgggggacaggattgctagggagaacatggagcatcccccagtacccatgggtcactgggcatactggccctgtttgaaccagcttcctttcactgaggacttagctgtcatgtggggctggaagaagtcctggtgtacctgaggatttccggccagggttaccaccattgttatccaaaggtatttggacggaccccagcctctgactaccctgatgagatgtcggcaacagaatctccaactttttatcataatttcctcctttcctgtctgcgatcatcatatctatttcatcctctctgtgtatgcaatgtatgggaaattttatagttcagggaggtaatcttgtttggcaagatcagggaatgtcatagtaaccagcgatatagctcaagggaaggcatctttgtgattttcgaggaacagagggtcaccctcaccacagggagcatctctctctgcccttggtctgaaaagcacatgacatttcaaggccaacagccccacctagtggaatagggatcttttccatgaggcacatcgttggtcctttacccaaacactctagctaaccaattctctccctttttgcatccctctactagacaccatgctttatgctgcttctgttaacaggaaaactctagcttcaacaattaggattaaaatgtcttctggaaccaaatgttagttcttgatactgtcccatcagcaggaaaattgccatttagtccatacatttttaagacacctattctgcctccaattagaatggtacttaattagtaaggggattttaagtctggaagttaaccagaaccattctctaagggaaaacgctttagtacagcccataatatcaggtatagatttcagtctagcccctccattaaagagggcttgcccaactattatgtagttttttttttgagatctatttttcagggagccagacaggtcacacaagtctaggaagtcaaagggaaatcacaggcagaggacagaggactagagccacttgggtgagtgtgacaaaccccaatctctaagtgcctctgtttccatagctggcagtcatgcctgcaactatgggtggcatgttcaacaaggtgccgggacccaggaaccatggaaggaatatagcaaggggaatgcccccactgtcttcctctccactctgtcacacgaaaaggaaggagactaaagggatacttttttgtcatttctctttctagatgggtaccatattcagcctgcactcccctggagtgcattctgaagcacagggactcctcttaaccagagactttaaagaaaaagcagctcattttcttttgcacaagggcatggcctttttactagatccttgcaagcactgcaaaatgaatccagctcttttagcaatcatatcaggcaggccaaaagagaataattccccaaaatgagaaaagcaacttccaggggaaccacccgaggcagctattgtgtgtaccagcccttccagtctgccttaaccggggccacctccaaccatgccaccagttcttctacctccaccatctctaaaattttccattccatcaccttctcacttacccctacagaaaatacataattgaggtgatgccaccaggattcaagtacccttctcattgcaggacctcaggcaattaaagggagacttaggccaattttctaatgaccctgataggcatatagaagttttccagaatttaactcaggtatttgacctctcatggagggatgttatgttgctcctaagccaaaccctaactgcagctaaaacagacagctctgcaagcagcagagaatttctgaggtgagcaataggtctcctatagtaggccaaatgggaaaagagaagatagagaaagtgaagaaacaggggaaacaccattcccagcaggaagagaggcaatacctcttgaaaccctaatgggaagccccagactcttctatggtgtttttccttttttcactgttttcaatggcccttttatgatgttcattcaacctgggagaagttaatttacccaaaccttaaaatgcttggcttacagttgagctgggggagaaagaaaacccagaagcatgacatgccggcaaaaaggtaaaagtttttttttactagttgggtttttggcttctctatccctgtgcaaaccggtaaaagaaataataaggatcactatttatattttctgaaaagttttaattaatgagaaaggatttgtgaggttggccttaagttgtagacaatctggtgtgctttgtgtgtctttctgtatggttctgtccaaagaaaagttactttaggttaggatgcagacccaggaccccctaagcctgctgttcaagccagcccaacaaaatgatcagtaacaaacttggctaaaggcctccatcttgcttcttgtccttgggaacatgacctgtaaccatgtggcgaataatttgttttagtctccaccattttacaatgtttgctgacttcttatgctaagtcagtttctgggtaatggccacaaaatcagataagccagtttgtcaataagggagctgccagctgattgatcaagggcagggtttacaaaatatcttaagcactaatcttgagggctaagttaagagatggtcaaaatcttgtagcctccagctgtgtgactcctaagccatggattttaatcttgtggctagtttcttggtctagtacccaggcaagaggaaagtatattttaagaaagggctgatatcatctttgttttagagtctaaactgtaaaccaggtgcctcccaaagttggttcagcctacacccagggatggacaaggacagctcgcaggcttgaaaaaaaatagagttctttgggtcagatctctttcactgtctcagtcacaattttgcaatgacagtttcaaaagctgcttatcacccctttaaaaacaccttgtacactcactgttacatcgtaacataattaaggcttgttggtttcacctgtgaggttactttttgtaaagttcagaagctgaaaatcttaactgcttggcatagctaaagttgagtaacagtggatttaaagggattttgttaaagagtgctcagcttaattaaaactgggtattcaagtaataaatatatttaaaaggcctttatatttttctcttcttggatcttgttttctggaaaaaaatttttatttttctcagttgactaaatcatctttctccattttatttcttgacactcttaatgcatgtgtgagaggccctaagataacttctggtagtccttgggaaaaacagaggaggtgccacagaccccattgtggggaaaaaagcaaacaaacaaacaaaaaaaaccctttcttttcctcatgaaaccccaggaattaagagcagatagtgccctctctaaattaaaggttctgttcagttttgctttgtgtgttctgaccattttgagttttgggtgtatcaaaatacttcacattaggagagagctttgatgtgtaataagtaggcaggaaatacactttaagggatggcaaatagtagttataaatcagagaagcatgctcttggccacctgaaagatatggaaacatccccacatccccacatccccacccccgactgagagatgatactcccatgggggataaagctgattagctttgggttgccttacaatgaaatacatggtagaagcaatgcactgttttctcccatagtatctccctcctttaggggaccaaaaatctagtataaaatggcacacttaattttagggatctgcctttgccttcagctgtgcctacttattaggccctaaaaatgcatgctacctggcccagttccaccaaaggctccaccctgaagccagtaatccaattaagaaactgacaaatgaaaactcttacaagtgctgaatattctgtttgtgttgctatatatgtgttgtgtgtaatgtctacaataagagctctaattaattggcttaaaaaatagtgcttaaatcaaatatgttttagttcatgtgactttaatttttaagaaataaaaataatcttaaggattattggtaaaatgcaagggtcatcaaaatccaaataggtggtctaaatcgtaaaacagatactaggtttgctaaatgttcaaaggttgtatactgcctgattttcagataagtaaggcctgggacacatggagttagatgctagaaagagtcagatcttatatgcatttctgcctgggtcctaggctccacgcctggtacataattaaaattgcttactaaccaggtttctcaacaaatgtaaaacttgctaagagttaacagtgcagcatgtatttgagatcactgaacagttttaaaggcaaggtgtataaaaacagtaaaatgtgttttttagtaaaggattataagaaaccatagaaatataaatattgcccagggatgaggaattatcttaaatttgataagataaagctacaggtttaagcatgttgtggaaagatggtcttttcataaactgagcattgaaataaaagcactgtaaggctgtcttaagccactaatctgccctttagcaaaatgggttataaaaaaggtttgtaaggatttcatctcatggtcaaattggttaagattagatggaattgtctttagggtggcatttaatcaaattggggttaacattaataaattaacgcaaaggtaaaatttggctttgagcaggatttttatgtaatagtaaaggcttatgaaaggtttttgccttttgagtcatcattttggcaaaataagtaatttatgactatctggaattctatttcataacatcaactgttttaaacctctaacatttaacagacataccaaaatcaaacttcaagtttcgaaattgtctttcctgatgcgtggctttctagattgttcagggggcccctgaaacattcagaaaataggtgaacaggattatttgacatgtttaatcacattgggattgccaaaatgatgtccagtcttaacttatatttttgtgaataataccaatatatgttccaaaattgtatgggatttctaaaattctaatgtctcataattaattttaaaattattgtaaaccacggagataactaaacttctttgtcagtcatgtttttaactgtaactaccctgaaaattttgtcacttacagacaattgttatcttgctatgttccttctcaaaagatgggatataatcaagctataagactttaacagctgttctcaaatgcagatttccaatagctttgaagattgtaacattggaaaaaatgtacaggactcatgaagaactgaaatgtttatgaatatcaagtgaaacaagagttgtcttaaatggattgtgctcagaaagctaaagcaatctttttgacttttgcttagaatattgctgatccttattttgtttttcagagtcaaggaaacttattttgaactatgtgcagcctttaataattaagtaagttatactcttgtgaacaaaattcggagcaggtttgtttctctgtacctggttcctctagaatttggaaaccatctgtgagtaaccttaacttacggcaatatagttgtttgcatcagtgccacaagaagtcttttttttttttttttttcaataagacacaattagaaaaactggttattttatcaaagctttgacaggaagtgtatgcttccccctttaaagagtcaatctcagcttgcagagctgataaaagcaccttggggaagactggcctcataccttgtctacacagtccctggacaggtttcttaatctgtagtcagtaaagaatgtcactttttaacatgtccaggacctccaagtttatcttgggaccttaagtgtaaagtatttggggataaaaacccattgctgaacttggcttgaagaggtattatctgagattccttatggaacagagttccatcaaagccaacccaaaaggcctatgtagggataattattcttgctgcactttatgcaaatattcacgccaagtataaggctaaagtttattctacaaagaacacagtcctatcataatttgtttttaccaaaaatgagcaatggagagagaaattgtgctccaaagcttatcatacatttgtcattaaatcctagtcacaataattgtttttaagctttttacctacattttagactaaccctgcttatttctgtgaatcaagtggtgatctcctgcagcttggaagaaacaaagagagatgggtaatgtgaaaatctggataaatatgctagttctgggcaattattctgcaaattctgccaggtaatgaaagtgagtagggtgcccataacccagaggtttatttgtttgggaaaataaagccaagaaacttcatagactccccaaagggaaattctgtatcttggcaggtaaaactttagatgaaaattatctactacaccacacttgcagaaattgctatactccctctactattcacagtagggctatacacagtagcaccttctaactggaatatcagacagagagtttccactgctgtagtattttgcttaattattatccttacaggagggataatagtcaccaaaaaaaaaaaaagaaaagaaaaaagaagtatgaaagttttactatcactgaatctgctagaacttcttattgggtttggtaatgtcacaccctggctatatacaaaggatataaaggaaaaaatattttacataagaaaggatcttgtatgataaatacttctcctaaagagaacagttggttgtttaaaagagggatgtttaggagaagtcagaagatttgagcatgttatagatggttgtggaagtcatgaaaagattacaaggatggtaaatacctgtcctaaaaagaatagttggtcgtttaaaaagaaggatgttaggacaagtttaagcacgtcttagatggtctgttgaagtaatgagggaattaatacttacaggaaagatttagccaaggttaacactaaagttactctagctacccaaatccaataccacttattcaaaaaagaatgttacttgtatattaatatttcagcagcacctggtggaggaaaaccagtatcacaacccattggaatgactgacagcaattaaactccaaatggagctttagactgaacaacacatggatgcatctttcttccaggaacccttagatcgaaccaagaggagccctagctgctgttccccacatgacgtcccttttcagcaggaagtagccagaaagagtcatcatccaacaccccttaacagcagttagggttaccactccagagaggggaatgatagaggagttaagaagaaatcacttaggcagatagcaagggtgtaacagtctttggtaatgcttttctttttaatgaaacacagccccaaatcatttactaacaaagagtagcctgtaaagttgacctgcagacatagacaagcaagctgggagtttgcatcggtgaatgctggcagaaactaagcactagacattttcaagatggtggctccatcttctcttctctgttagctatgtgtactctaaggagcagacaagatggtgctgatcaactggacagcccatttgcataataacattagggtggggagaccagacttccctgtgcattatgtaaacatcatacatgatcgaaccaatctataagccctgtgtaaatcagacaccgccacctcaaactggactacaaaatttggtgcatttgctgtcagccagtcccttctgctcagaaacccctttctctataaagaaagctgtttatctttctcttctcttctgcctattaaacctcagctcctgtactgcttgtgtttgtccgtgtcctaaattttcctggcgattgacaacaaaccctgggtttataccacagacaatgtagctgcttcatcttgaggtctgcctatggcactaaggtactttctctttggtcccaccactgcaattttctaacctgtgttctagtgcctcccaggcactaatcttcagaatttcagaacttttttctggctgtgtgcttgaacttggaacttaatggcagaatcggttttatcttcactgcttgtttgttcctattcctgtttgtgttctcctcaaaaaatcatatgttaaaatcctatccccaaagtgagagtattaagaaacggggatttggggacaatattaggtaatgaagacagaatccttatgaatgaattagtaccctcataaaaacagaaatgaaagaacacattttttgtctctctgctctccccaacatgagaatacaatgtgaagattgtcatcaacaaaccaggaagtgaagcctttccaaacaacagatttgctgccaccttgatcttggacttcccagcctccagcctgtgagaaaaaataatatctgtttttgaagccacctggtgctatttttgttatagtagcctgaactgactaagagagtagacaacagtggtaactctggattaaaatatacatattactggaattaagttagtgtaaatttgaagcagactgataaattgagatatatattgtaagccctattgaaacaattaagaaaataactaaaaaagtaaactaattaaaaaaagactgagctgatttttcattgtagaattcaattgttttggatgggggaaagtgatttgtaacacataattaaataattacaatctttttgaaatagtttcctcatcagtaaagtggaggtaaccctacatcctagttaggctataaagaatgatgaatataagtttggcagtagacaagttggaatttttaacctcaacttgtagctttgtgacttcaagtgcatcactaaaccttaggctgtctctttaactgtaaagagggaacaataaccatgatcatatcttaaaccattataattgaataatatagtaaaaattttgcacaatcaacgatgagtattaactatcataattggattgtgaaaatatttataaactctgaagaatttattactattggtattcattatttttccccacaagctaatctgattatttgtaaaggcaaaaatggaaaaaaacaagtccaccatataattatcacttggtttcttaacatctatgctacttttaaacaataatgtcaatatgtgaactattttaaattggtttttctatgaaaacatttgctgcttattgacatacactgtgcaataatatgcctctcacatctattatagaattaaggtctgtgtgatcaaatgtaattcaacaaatgtttattgcaccttctaagtgttagtcactatgttatgtgcttgtgatgtagaagtttaaaaacgtatgtttactagtaaaaaacattagtttttataatattttagaagaaacagcactagaattgagaaaagtaacattaggatgaaattagaattttgaaggaggttctccaggcaaagaaatggacaaggcatttcaaattgtattattaactgcctattagagagaaggtaatatgtattgaaagttttgcaacaaacatatcacttacacaataactactccatttcatagatgaatttaatgaatttgatgaggtaactacatctagtagagggtaggccaaggctcaaatctaagtttgcctgtttccaacacttgtgcatctaatcactgacatacataaataaggcaattgtcagagaagcatttcaaactttcctgaacattccaaaagggaaaggcatcgtatcataaataagaagataacaacaaagatttccaaaggaagatatgtagaaagggatacgaaaaaaaggaggaaataaaacaatagcaagtatcaaaaacaagagttgagatggggcagagtgggaaatgagagtattttagggttcaacagagaatcagaagcaataggagaatctattatctatctatctgtctatctattaatatagagaggtttatttattgtaaggcatttgcttacacaattatggaagcaaaaaaatcccataatctgcaagcttgagactgaagaagaccagtggtgcagttctgaggaccagagggccaatgatgtgagtcctagtctgagaaaatagaaagaatggtgtcccaaatcaaacagagagagtgaatcctcccttcctatcttttgttctattggacatcataaaagattagatgatggccacatacattgggaaagtcagtctgcttttcttagactactgattcaactgtttctggagattagcctgattcttagactaatctccagaaacaacctcagagatataaccaaaaacaatattcagccaaatgtctgagcaccctgcaatccagtcaagttgacacataaaattaaccatcataaagtgcaaaatttgttaaatgtctgagcttgcagatccttttagggcaacatcacagaccctgaactccaggacaaaataccctaatcaaacgaactgcccaactagtgttctgaaacacaggatgaatcatcagttcaatcatggatggctaaacctaaaaaattattccttaataataaccgtatgtctggaagaaatcaaccttctaaaaaagacaaagttgaggaactgcaaaaggaaattcaaactcctctgaaactcttaacaggcaagaaaaaatatgcagttggataaactgacattcaccaaacttaaaattttgatataaatattcatagggttcatcccttttcttctgtctagcactactagctagaagtcagaatttataaaggacagcccaatatttcccctcctgggcccacagcagacacaaaaaattcataatgaaacgttttttctttaatctgcaaaaagtctattattccttcttaataccatgttttgggcaactactcttaatcaggtaagatgcatgaaataaatttgcttgcaatactgttgctgggtgaacatcagcaagttactgatggtagtcgttctctgcaggatcatttttgcctcctgagggacatttggtaattggggacattttttactgtcttagctgaaagaggtgctgctgacatctagtaggttgaggtcagagatgatgtcaaacattctacaatgcataggaaagaccacctgaaaatatatgtatattcagttcaaactgtcaatactgctaaggttgagggcctttagagttagcctgaactcacaaaattttccgataaaaggcactttcctttcccttccaccttataagctttaattcatccttaaaaggttttggtgaagataattttctttgtaaaggagaaaacatgtaagctttggaaccaggaaaggatgattgtgcatcactacttactagccccatgtttgaccaactttgtttccttgggcgctataacaaaatacaataaaacaggtgccttagaacaacagaaatactgtctcacagttctggaggctagaagaacaaattgcaggaccatgctccctctaaaacttgtagggaaattcttccttgcctctttccagcttctgagggtttgacagcaatctttggtgttccttggcctatggatgcatcactccaatcctccatcttcacatgaccttctctctgtgtatgtctgtctctgtatccaaatttccctcttttgtaaggaaaccagttatattgaataagggcccacactagtaatgtttaactcgattaataataataattaataataatgtttaactcagaatatgtttaacttgattgactctgtaaaggccctattaaaaataaggtcacattctgtagtaatgggcatttggactttcacatcccttttttggaggcgggaacataattcaaccaaaacaccagtttgcttaatttcccaaaacttcagtttccttatatgaaaaatgcaaataatactgactgtctgtagcattaattgaaagattaaaataaatggactaagaaataaactatggaaaaccaactagtatagcagctgctgtatcacaggtgctcaaatatatatacggtcaccctgttatccagtcatatgtgtcatatatacacacacacacacacataaacacacagatttgtgtatgtgtatgtataaaactttcccttttctcccaggtatttatgtctctttggtgttcacacaaaacatgatgtatttttctttccattcgttacattatatttgaactatatatctatttatctatctggcttgctactactttgatattagaaactgttgcagtaatttttagattgatacctaactttgtttactaattaataatttacttatcaagtaaaggactaaatggaaaaatggatggatgaacatgactacagcttaccaaaaatgccctttatacctgaatttctcttagtgggtcagagtttaggtggtattcgaacgaatcaaagggatatacgtattttgcttttggtatgtgtttgtgtacattctcattattgttacttgtcagtttcctaggtttccgattgtgatctttagatttttttgactagcctacaaacttagatttttaaaatcctaatgacatctacagcagtttcccaggagctttctttcagaatatctgccaaaataatttattgctgtcttaggttatttcatcttgagcaacatgaacattccatcaagcagagggtatagggagaagtctcatcagtaaataagctggctaaaatttagacgtccatcaatctctgttaaattttatctcatataccctgagataggagagtaatataaccattttaaaataaaacttatttcttgcccatttactgtatttggaagaaaaaaatagtggataattaggaagtggataattctggaagaaaataattagtagacttactaattatttatgagggaaagaactgagaacagtaattttaaaatatatccatgttcttgaatatttccacccttaagtaactacagaggaaatggactgatttaccaccaaagattactttataataataacctacagtttgaaatttaagctccatttaggagccagaaccaattatttataatactagaatggcctgaaataatcttgtattatcctgaaaaaaaaatctgaagtgggaataagcccacacctcatttatgtgtgtaaaacaatctcagctttacatcttttaagaaaagtctgaataactgccttatttccacatttctttgcataaataaggcagtgcaaaagctttgtcagctgattaaatttatatgcaattttggtaagacattgttttctagttccacaatatatttttgtccagtccaccgaaatttgagtttgattcactcacaaagctgatcctcccaacttcatttaataaaatgtaagaagactttaaaagatatattaggaataactagttagatatggagaccgtctcatattaattatttattttatgagtgtctgctaaatatataaacaactctgctggtaattatttatgggtacccaggtggcataaaaaatgaagcagagacagaaaattagatgtagcttctaccgtagattgataaaaaccataaatgcagaactacacagactagagtggatagtattaaaaactatatgtatagtgatgtactggtaaatgtataacaacctggtttctgaggaagaaaaaatctctgctttctaacattagttgatttccatggcacaagcactcctatcatgaccagtttcaagccacaaatgtgaaatcactgaacacagatttgggaagagatggacacaactcttgaaagtcagtgtgacaaactgaaacacagcactgcttacatatagatatataaagtggatgactattttaacagatacaaaagcaaagaatctatgtgaatttttaactaaaactgaaaatattatatacctaaaagcatgttggttaaaatgatcattttgaatatctaaatctacacagtcataattatactgatgctattaaaacatggtataatggccttctgtatggaactcatattaattgtaataaatattcaattatataaaattttagagatcatctactgtatattagacattgtgctatgaacaggagttacacagatggctaggacttagtttctatttttaaattataaaaagggccaccaaatggataattccagtagataaaataataaatactaagatagaggtaagcatctgtcccgcagtacagagaagagccatttagcccagtcttgtttgggatggttttctgggaaaatgatgttgtcaaaaccaccttatgaaatgcaggctctgtcactttacagttattcctagtattgccaactacaacttcgatcccatatttgaagtgatctctgtaaattttgttaaaggtaaagcaggtccatgattttgtggggatagtaaacagaggcttaaaataagacagaacttttaggccagttatcagatctttaatggaacttaaacatattacctgacgtggacaggtagggagagccctagaggaatgctgatggattgggtaacttgtgagatccgtgtgtgagcttagtcaagtcattttctggtatgtcggtttccttatcaatggaaaaataatggtttggggtggataataataataaaatcatagctaatatctattgattgactttgatgttgttatatcccttgacatatattaattcacttagttctcacaacaatcctataaagttgatatccttctttctctttttatattagataaatctgagataattgtaagctatatacaatttcaatgttaggaaagacctgaggtagaattccaacctagttctttctgactctaatctcttagacattccctgaagtcgtttccagccttcatgttctttgaccccagaagtatcttggaatgtttccctaattgctgtgatggcaacacagcagagctagggaaatcaaagacctaggctatgccccttcatgtttgtgcattatggtgaatgagctctgaaagtgccagggaattttgccaccaagtcttcacattaacttttcagcaatattcctcagtttaggagggaggcctatccactccttgtcctttgaaaagtgatcatttgcttgattgctctcaacagaagtcttcccatagcctctgatattttcttttcatttcttctgagttgtttatttttaattacttaacatttttgacgataccttttccgaatgcatctcaaacttagggctaaaaagccaaatgcttcaactttgttttcccatctcttaggcaaacagccaaaataagttccatagttgagcgaggtttttccataactctggaattatacaagtagttcccatttcagggcgtggttgccatccttttctacatttcttagcatggctaaattctctttattctttatggtttagacgatcccctgagaaggtcccaaaatgccgtgtgttaactttatatgctgcttttctctttctggcttaggctgcagactgcctaagggcagagaaaagtttttttgttttttttttgtttgtttgtttttttaatgagtttatcttttgaacctgatgcaatgccagtataacttagggtggaagaacttgggatctgtagttaggatgtctaggtttaaatcttacctttgctacttaatagtcatgtggacttgggaacatttaaaaatttcccccagactcacattctatctgggaagagaagatccaacaacttacttcaaaaggcttttgtgaggattaagtggtccatgtaaagcacttggcatggtatctagcacatactgagtattcaaaaaccattatattgttattaggtactcaaatgttaaatgaagagtaagaaaatgaatgtacttattcattcagaaaatatttattggtgctagacccatttctaagacctggaagggtagcagagagcacatccaagttgctccctggtttttctagagcttacattctctcaaagggagaaagacaccaaacagaaaaataaatatgtgtgaaaataaagcagagaggccgggtgcagtagttcacgcctgtaatctcagcactttgggaggccgaagcaggcggatcatgaggtctggatttccaggccagcctggccaatgtgaaaccctgtctctactaaaaatacaaaaattagccaggcatggtggtatgcgcctgtggtaccagctactagggaggttgaggcagaagaatcgcttgaatccaggaggcggaggttgcagttagccgagatcgtgccactgcactccagcctgggcgacagaccaagactccatctcaaaaaaaaaaaaaaaaaaaaaaaaaaaaagcaaagaaaaggaaagaaaagaaagcagagtaagaggacaagcaacagcaggggaaatgttactttagataaggtagccagagatagactcctgtttatgataatatttatttgtgcacctgagtgaaaagagggatagatctgtaattctgtgggttggggcaggggcgaagcaaatgcgaaggccctgaggctagagggtttctgtcatcatcaaagaaaagcaagagaaaggactgatttggtagaagaggagatatgagaggatgtttaagagggagaatgttaggagaagagggtgagcatcaaagtgtgacacatttttaaactagtacaactgctatggaaaacagtatggagatttctcaaagaactaaaaatagaattaccatttgattcagcaatcccactactggctatctgcccaagggaaaagaattcattataccacaaagatgcctgctcgcatatgtttatcacagcattattcacaatagaaacaatatggaatcaacctaagtgtctatcaagagatgattggataaagaaaatgtggcatatatacacaatggaatactattcagccattaaaaagaacaaatcatgtcttttgcagcaatgaggatggaacaggaggccattatcttaagtaaaacaaatcagacacagaaatacaaattcaacattctcacttacaagtaggaactaaaataacatgtttgcatgaatgtagaatgtgtaatgatggataatagagattaggaagattgagtagtggagaggagcacagattatgagcaattacttaataggtacaacgtacattatttgggtgatgaacaccctaaaagatctgactttaccgctgtgcaatttagggatataacaaaattatacttgcattccatatatttattaaaaaagatgtgacagatttttagggattgttggccaagtaaaaactatagatttcatgctgagtgagatggaaggaatttcagggtttggaatagcattatgaaacgaattgaagatgctctcattgagaatgaaataaatgattaaagggtctcgagatagattcagataagtaagggtatagtagccaactgatgaagaggatgcattaaaaagataacattcggggaagggcagagagttgacaaatgaggtgttaagaagtaaaactagactgacctcacaaaagagaaaattaagacaaaggcattgtgatttatgcataattgtcaatttgtatgtgtacatatatgggtccacttgtcaagctttcattgcctacagctcttttgactatttattttccttcaggagcccatactttaaaaacattttctcaaccaaagataatttatttataattaattcatgccatcatattttttcaaagccataagtaacctcaatctcaacttccaatgggtgacagcaaaccaatgtcatcctctcctggagtcaccattctagccaagagcaaatgaacctatgatttccatcaacctgtactgccttattgcaattaatatattctatcccttagtttcttttaaacactggaaatagctttagcttgtatactcccttttctttttcggtggaatcccaggagtctctgaaccataagtgtggtattcaaattactcatgtaaacctacagatacaatgtgtatcttacataaccattatatacatattccatcctatatgtgcatgtattacacacaatgcattttatctctagaatatatgtatatattgtgtatatagtgctttcaaataaggtcatattcacaggtttacacagttagaatgtgtacttatcattgtagggaataccattcaattcaccgcagaggtatttattggaaaaatgtgtattggaaaggagaactatcaggctgcattatttgttaaccatctaagattattatgttaatataaaagatctcataaacagaagctcttattacctagtcaatagttgttttatttcttattgatatatgattatgctgccgaattgtgaatttaatttggggcatgaatgtgtcatacatcttcatccaatcagaagattcagttcagatgtgtctatataatatatgtgtttatctttcagaaactttgtaagtaaagaatattacccttacagataagtcactctcactggagagaagatcgtgaggtagggaagaatgtggaaattaacatctctgagtacatgttcccaacgatagggccatattgatgaggggtcggaaagcaggagcctgccaaagagcaaaagataggcccgtgtggacaagaggttactttattatttatttattcattaattcattcatttattcatttacttattttgagacggagtcttgctctgtcacccagactggagtgcagtggtgcaatttcagctcactgcagcctctgcctcccgggttcaagtgattctcgtgtcagcctcccgagtagctggaattatgggtgcccatcattacacctggctaatttttgtatttttagtagagacggggtttcgccaggtttgtcaggctggtctggaattcctgacctcaagtaatctgtctgcctcggcctcccaaagtgttgggattacatgcatgagccaccatgcctggacaaggttactttattaaacggggtaggacctcttattagattggttcacctggaggatggtcttagtgatacctgactttgagtctctttcagtctctctgcaaagctcattttgaaagacatttctgagtctcctactaaatgccagacactgagatgagcaaatgaacaaaataaaagtctctgactctagagaacatcaaccccggagtgtggcaaggcaggaggcagtggtgggggacaaggaagagaaacatatgcattctctacattcaaatcttattatactttaatattttagagaataaaacaggaggggaagtcagaacaaataaaggacaagatctgaaaactgttaaggactttaaaattatattcaaatttatttaagtacccttaaatttacttagtgtataacagaagagaaagctgagttatattggttaccttctgttttgtaaacgcaaattaattttacagtgtctctcttagccagataaaaccattgatatttattgacaagtaaatcaaaagcatttatggttactggcttcttaatttcatctactcttgtttctgtcactggggagttttcagcacttatattggtctattttgatgaaagactcacaacagagggcaactaaaacaagagtgttcctcaagtgatttttctaggatgtaagacatagattattactttattagccctccccaaattttgaggacattcgtacataaatctgagagttattttcatgagattatctcaccagatggcttacttaaatatttgtaccattgtagaagtaattacttcatctgggagaaaaaaaaaagttcaaaagccctggattatttttgtctgttttcatttgtttcatttctattttactttctagacaggagtaaacttacatttctatgataaatagatgttggtaaggttttggaaaatacatatatgtcaaaatataggaaattctctgtgtcagaaataaccacaattatggtgtaatgaatgcaatactcaacagagagttggaaaataaggcataaattttgagttttagtaaatatgagctatgtaaccttgtgcaagtcacttaatcttactaacatcatattcatctgctaaaaattgagtaaataatggaaactccattgagccattatatgaattaaaacataatgccacatttgaaagtgctaaggaatccacgccagaaaaggctaattaaggagttaatcaattaccattatcaattttttaaatactaaataattactagtttgaacatctagtactgctagtaacaggttatattttgcctagctatttgaagcagttaaaaagagttcctttgaggatttgaggcagtttggctaacagggaaagaatcctggcctggaagcagatacccaagttcaatttctcggtgttctatttgcctgaagtgacaccttgggtagattatttgacttttcagggccacatgtcctcatctatataatgaggatggttatgaaaaataaattactacttgtaaagtacttagaggcttgtctggaatgttatgtcagccctgtggatgttagctagtagcgatcatcactgagttttcctgaaagccttccaacagctgggaggccacagctggccacactctagtgtcccacagagggaccacaggagtctcctcctcttgccttccatgcccccactctgtccaaaactgctagtagtgccacacaaggacatagaaactgagagcaagactgagagaataagactaagagagagagaattctgaaaatagaacaaaatgctattttatcaaaacagagcagagtttggaaggcttctagtgctctatcttctcactaaatatttgtatgactttaaaatgtcacaatttctctgcagcagtatttactcatgcgaatattagaaattattataattacatggaacatttgtttagggttttaccatttacaaggtgggagagcagaataacttaatcgtgaacaccagagctttggaatcaagcaggattagatcccaggtttgttgtttactagctggtcaagtcatttaacttctctatgcctcagtgttttaatttgaaaactagtaattcagaaatgttcctcagaattattaaagatttaaataaaattgtttattctcatatatatatttatagaatctcatagcagaaaatttggcagtggtgatgcacataaatggtagctttaaaaacaattttttctgtctgttgtatgtaatttatataatttgcgtgtaatcccaccatgattagaaaaaatattatctgaggagactaaatgcagcataagtcaattttggagaaagtggttataaaacaattccacagaaaacatgggaatatgccctaaaatattgactatggttattaaaatgagggaaaatatgaggcaatatttcttatctatacttatccatattttagcattccatacaaacatcatgttttccatatttgagaaaattatatgtgccatgaaaatacttgtcaactttgtccatcttgcaaacctactctcccctgtcttctacctaggaactgtaataggaggtattgctcctaaaaatctatgatcgcatgatatattttgaaaataatggtcataattcaccatattttcttacatgatggaaaaaatttgttagtctcttttctagtaatatgaataaaaatgatcatcttgggtttggtaagtagtgactgcatgcttactaccatccctgctaggagtttctttcctctgcaccacctctttcacatatagcccccagaatatatctttctaaacccagattcggtaactatctttccacaagcttaaaaatgactgctcaaagcataaaaataagaggctattttttgcctgttttaaaaagtagtatggccttaagttctattttcagcttcttatcctattataccttattttaacaaagtatctcattttctaggtatattggaatacagtcttcaagtttggggtcattttctctctctgactgacatgaattatgatttcctcattattcgactgtgaaaatccttttaatatctcagttcaacctaaaacttcaccaaaagcagatattaaactgtttgttcagatttcagaatgcccagtgaatgagtcacatttacaaagtgtgagtttacctatatgcatatggtggtcccttctctccatactgcaaggaaacctgttattctagcattcttagttgccttatattagtactctgatggtcagaaaccctaatcactttgaacttggcagcctgttagtggtaagacttggactttgaggccgaagtcctttcttggagacgttgagtccaaatttatatattgtacttgaatccagatttttcaaaacgtttaattggcagttacaggcaatgccccaactaaaattaaagtggaacttacatttctcatttgtccttgttccttgagtatattattgccttggaaaccttgtgggaaatagatgatttataaagcatggttctattaatcttgggtttctctagccaaacaacatttaacagcaatctaaaacttatcgtacatgtagtatattagcaaaattgccatcctgttcttactcatatacttcctcgctcaaagtggctggtgtctaaggtaaaaagtgtctccagactcgttcatattattcttttctactttccactgccaaggtaaatcaatggccagactacactgccatcccttttttttctgaatttttgtctacttttttttttttcactctgaatctcatgcttctttttaataaagcaggatgttcccaaactcttcatcctcaccagtacacacacacacacacacacacacacattttctattttcatctctagcttgtttccgtgatggcacttataacttaaatttgcttatttctatgtttgcttgttgtttcttggccatcctcactggtatctccaagatgcagagggtgtgcctttcttactcatctctataaccccagttaccatagcagtgtctagcacaaatgagaaacacaataataacaaattcattctcatctaatattaatgcccaaagctctggaacatgaagcccacctactgcaataatagtcattttggggacaaatacgatttttcctgctacttgtgtttttcctctagagattatgagtatatacttttttaaattatggtaaaatacatataatcaacttttccatctgaaccattttaagggtaaaattcagtggcatcatacatattcacagtgctaagtaactatcagcactatttccaaaatcacttcacctcagatggaaactccatccccactaagcaatcactccccagttcccacttccccagtccctggtagtctttactctactttctacctccatcaacgtatctattccagatatttcatataattgaaatcatacaatatttgtcttcttgtatctagtttattttttcagtctagtgttttcagggtttatccgtgttgtggcatgtatcagacttcattccttcttaaggctaaatatgccattgtatgaatatacaggacaacattttgttcatctatttatctactgatgaacaccaagtttatttggctatcataagtaatgtttttatgaacattgatatgcaaatatttgtttgagtttctgttctcaatacttctttgagaacctaggagttctcaaatacctaggagtggaatttttgtttcatatgtaaactctacatttaactgtttgtggaaccaccaaatggtttccacagcagttacatcattttacattgtgatgggtatagttttgattggctttctttctttagctgaggctgtgaagagggagtgaattagacaaaaacctgaacaattctcaaacatatatgtttagactatatatgtctaagattgtcaaatggttagacaaagaggaatatcctatatggtttgaatcagcagcacttttaagcaagaacatgataaaccatacatttaaaatgtatttcaagcaagaatccagtaggtgaaatgtctattcacgtcaatatatagccatagaaatgggctcaatacttaaaaacacacaatgtagaacgtattttttttttgtttcagataaagtcctaaaatatgcaacccaaaatccaagaaatattttaaaattgctggtctctatcccttttcagtagctagagaatgggaacaaaaacaaatccaaagttctcctgaattttaaggtttaaatcttttattgaaatgctctaaaataacaagcgaatgcgtccagtcatgtttggaaaaaaaatgttgctttgtaaataagaatatattttttcctagtcacttcttgatttttccatgcaagtcacgtgttcccaaaagatgaaaaagattaaatatttaccatagaacatctaaaaacaataaaaaaagggactagtccccactgtatataaagctctgctccaggcagaaggataactagttggagtctctgggcactcataagagaacagattcatttttaacaagtccttcgcctacacagaactgtaattgcatagcttgtgtggtgtctgtatctttatcattttctatttattcatctatcctgtgtttcctgttcatttcctgtgaaaaatgaataattaaataagctaacaaattaaacaaatttaacaaattaaaacaaacaaatgagaaagcatatagattttttgtactcaacagtgacactttccctcactgttggaatactctaaacacctttctatccatatgatgggtagtatatttaattcgtgtaccacccaggtagcatagtgtatagaaaacagcattagggttcacagactttgtttttatcctggctctacttctaataagctgtttgactttgaatatgtcactaaacctctttaggctatgtttccttattcgtaaattgagcaagttgaaccagatcactggtttacacattgtgttgcctcagaagctaaaattggagatgagggggaagtaaattagtagggctctgtgctcactgtgcttactttaaatacagtggttttactttcatttgccttatgcatttggcatctgtgcacagttttatttgggaagaagaaaaagtccctcttttggaaatggtggtggggaacctagaaatatgaactagtcagtaacaattctttgctacccaagtacgaaattttttattgtcttaatatacaaccagtaaaaataacagcatctaaccagttggggtgttgatgagaagtcacaaataagtattgtacaatactgtaagtattggcgaagttcagaggaacgtgtatctgtataacttcctaaaatgaccaaatgaagagtattagagcattcaaaaattgagattgtgaagcaggagtattgcttcaaaaataacattgttatttttcaataggtattccgcatcaagataatacatttttaaaaatgtacatactttggtataactaaaataatgataatgcaacatttttcaatttactgccatcaaacaaattgatgtttgttactttcttaaaggggctgacttatcctaaggaactttattctctcatatttcatggaaataacattagactagaaaacaaggctctcatctggtcttggcttcctaaagtgcacaggtaaaggcttgcatttgccctctatgcatttgatttgctctctctttctctgcattgtcacacttttgccatggagatcattatatactgtgtatgtatatgcatgcatgtgtatgtgttggtgggaggggggagggctcaggctaacctgtccataatgaagaataatatctcagttcataagtttttaaaaaatgtcagatttctccatcttcagagttgaaagcatccataatagtcattttgtccaacatccttgttaatgttcaatctttctatagtatctcttaaagattttccagtaatagaaactatattccattatgaaacagctgaacttattttaaaacaaacaaacaaaagcacttgataaaattccattccttggatgtgagttttactctcttaagacacagactattctttacctattgacctgttgtcctcatgccagtcccttaaatgcctgatggaggctgacatgttcccaggtctacatacatgagcatggaacttgggattgcaaatttgagtagcaatatgcttgattcaatcctccctgttgctattttaatattcttaataacttttgaacaaatgctccctgatttttattttgcagtgggccttgcaaattatgtagccagttatgcataatccttaaatcatctatcctcaagcttaataaccccagttcctacagtatctgttcatgatcattggtattaaataggtttgtttgtcaatgaccatgttagaaggtaatggccagaattgagcacagtgctctaggtgtggtctgatcagtgagaaaatcagaggcatgattatatcccatggtgatatctcctgtgcctctctattctcacccgctcaagatccagtctctcgacaattctctgccctgctctgagcccaagaaggcaaactcatgcagagggtagcagttgagatcccttcctgtctggcatccagctgggttaatggaaggcaataggggatggcaatgtagaagagagaattcagggtatttccttcccctcccctgtctcagagctgcatccctctctgtggtaaaaactgcatccctctctgatgagaattcctactggttggtccctcttttacagttccatatcttctttttttttccttctctctctctcttttttttttttttttttaggtggagtcgtgctttgtcacccaggctggagtgcagtggcacagtctcggctcactccaacctctgcctcccaggttcaagcaatcctcctgcctcagcttcccaaatacatgagattaccagcatgtgctcccatgccaggctaatttttgtatttttagtagatatgggatatcaccatgttggccaggctggtctcgaactcctgacttcaagtgttttacatacctcggcctcccaaagtgctagaattacaggtgtgagccatgtggcctacagttccatatctcactggtcacacaatactgttttctctccttgttccttcagccctagtgggtattaatggtttcctgctgcttctgctcctttaatcctgatcacataccatatgcattcctttcgtagaaccatcttcatttgaatcatatggggtaaattctgtaccttgccaatgctctgataaatcactcagcatgttggtgtcatatgtctcttaatgtctccagttagcatacattttggacatttctctagaaggatgaagttgacattctttgcttcactgagtcactgatctagggtctccttccacacttccaatcaccttctgaagagtgacagagggtgctcaaatttctatctttgagacatcatgcttccagaatataattaattcaaaaatatgaagaaatagttcctacacatcaagcattctctctcccaagaactggagatatagtagtgaccaatcacatcaagttctctatcctaatggagtttagtgagattcttgtgagagatcaaagatataaaccagaggcctctaagaagctaaataacatgactggcctaatttagaagttttactctggttgctgtattcagaatacactgccagaatccaggagaggcagcaagaacagttagaataatacaagtgaggagacatggcagcttggactaaggcagtggcagcaggtggtaaggttattctgtgactcagcacacatccttgctgccctgtttctctgttccattgaatcccaaggtaggatccatatcttatcctgtactttaccagcttactacaaacaatttgtgaataactgcatagtgaattaaaggtcaacaatatccactttactttcaaggaaaataattttcctttttcttagcaatcataataggtatttttcttcttttctcaaacgtaaagaaaaatgttgtaatattcctggggactatgaaagaaattaaaagtcaaatgaaagtgctcattgaattattcatagaaaattatctaaaatgaaatgaaaaaggggattatcatcttcaatttgcctcaatattcaggtatgggtaagaaaatactcagaaaattaaggtttccttaacaagatttttaatggttttgttagtaacttttacaaaaacaaaaaggtcacattttccagaagatggaataatcaataactatactattttgagcactaggtttgactacttctgcctactctttgtagaataaaaaaaaatctaatttttagttatactgagagcaagagaaattcagtgaaggaggaggacagagaggaggaggaggagaaaagaaaacatcaataaatatactatgaagtagtaccccagaaataaagctgcccgatagagctttcctaatgtaacaagattggtggtttataaaacaaaatgcaaccatcttttgttgttgaattgtaagactttttttaatgtgcggcataagtttgattcaaaaaccagtgatatcgaggtcatattagaataaattagtggagagctgaaatgtaattaattgaaaataaggggaaggggataagttcttgctcccttgccccattatggagagtatctgtttctattacagctgttgtagctatccaagactaaattcaattttcttgcaaaggtcatatattctctcattatctaatcaaaaatatattattaatatataatgcattaattaatttaaaattccattaatacttatgtgacaggcttttggacctggatcttcaacagttatttgacaatccatttcttcagttcttaggaaataatctgacaatatgtatgggctgcaaacaggtttctttggaggatcttcaaagcaccactaccaacatcttctaacttcatatctgccagtcaggaagaggcttgataactagaggttttgttgtgcagacattatgttccttaagaacagttttttagtctcatggttgtctacaaaactgaaggccgaatagtcttttatcttctgaagaaaatgaagtttttacttaagtaaagaaaacaaaaactaccacagaatagtcaaacaatcctgaaaggctatggtcacaataaatttcttataagataagataataataagataaatttgagaattaggtaaataatggctgtgccatttattcttcttaattattcatttggtaggaggagaaacaagatggctgaagagaagcatccagcaattgttccccttgcaggaacaccaaattgaacaactgtctacataagaaagcatcttcataaccaaaaatcaagctagcaattacagtgtatgcctttaacctcatatcaaggaaatagatatgaaagaaggtaggaaagacagtctttacttgcgtacaccacccctcccccatcccccagttcatcacaaggcagtaggacagagaatctgtatgcttggtagaaggagagtgcattgattttgagacttcacattataactcagttctgacttgtcacaggggaaagtaatgcaaggcagaattcagccagcctccaaggaggaaggatttagaccagctctagtcaaagggaaatagcacatctgaggagtaagaacctgagccatggctagcaccaccaccatgagttaaattgccctgagatcctaaataaactagaaaggctgcctagaccacaaggactgtaattcctgggcagtcttggtgctttgctgggcttggagccagtggacttggggtgcatgtaactcagtaagaaaccagctggagcagcaaagggagtgtcatccctcccccaactctggcaacacagctcacaattctgggagaattcctccagcttgaggaaaagagagagaaaagagaactttgtcttgcaacttcggtaacagctcagccgtagtacaataaagcacaaatctaatccataaagaccccaatactaggacatagctcccagatgacatttctagactcaccctgggccagaagggaacctgcagccctgaaatgaaagacctaggcgtggcaggattcagcacctctgactaaagagcccttgagcattgaatatacagcagccatagccagacactagtcaccataggccttgggcaagacccagtactgtgctagcctcagctgtgaccaagaagagtcccagcaatggtagtcacaggagggcttgtgacaccccttctccaacttcaggcagctcagtacgaagagacatagagacactgcttgggagaaagtaagtaaagagaacaagactttacctgctaatactgggaattctcttgtatcttactgaagatcaccaaggtggcacctgtatgagtcagcaagacttaaagtgttactgggcttggggtgccccctaatgcacacagtgaccaaagatttagaacaacattcaattccctttaaatacctggaaagccctatcaagaattataggtataaataagctcagactgcaatgattagaataaactagtttttcaatgtccagacattgacaaacatccaaaagtattaagaccatctaggaaaacatgactttgccaaactaaataaggcaccaatgagcaatcccagagtgacagagatatgtgacctttcagataactcaaaatagctgttttgaagaaacgcaatgaaattcaggacattacagagaagaaattcagaattccatcagataattttaacaaagagattaaaataatcttaaaaactcaagcagaaattctggaacagccctattaactgacaaacagaaaaatgcatcagagtctctcaagagcagaatggatgaaggagaagaaaggatttgtgtgcttgaacaggctatttgaaaacacacagacagaggaaagcaataacaaaaaaaatgaagcatgcctacaagatttataaaatagcatgaaaagggaaaatctaagagttattggccttaaataggagacagaaagagagattggggtagaaagcatattgaaaaaaataacagagaactttccaaacctatagaaatatatcaatatttaagtacaacaaggttatagaacacaagcagacttaacccaaataagactaactcaggagatttaataagcaaactcccaaacatcaaaaataaagaaaggatcataaaggcagcaagaaaaaaagaaacaacatacaaaggagcaccaatacatctggcagcagacttaaagtcttgaccttacacaccaggagagagtggcatgacctatctaaaatgctgaaggaaaaaaaaaaaacaaaaacaaaccaaacaaacaaacaaaaaaatcttttatccaagaatagtatatccagtgaaaatatcctgcagacatgaaggagaaataaaaaaattcccctggcaaagaaatatacctaatgctagatgacaagttagtgggtgcagcgcaccagcatggcacatgtatacatatgtaactaacctgcacattgtgcacatgtaccctaaaacttaaagtataataataataaataaattaatttaaaaaaaaacctgagggatttcatccataccagatctttcctaaagaaagtttttaatctgaaagaaaaggacattaaggagcaataagaaatcatttgaaagtacaaaactgactggaaataagtacacagacaaatataaaatactgtaactgtaattgtggtgtgtaaactactcatatcttgagtaggaagactaaaagacaaatttatctgaaataataactccaacaacttttaaagacatacatagtataagaagatataaatagaaacaacaaaaagttaaagagcaagaagtatgaagttaaatgtagagtttttattagtttttctttgtttttgcaatcagagttaagtagtcatcaatttaaagtaatgagttatgttatttgcaagcctcatggtaacctcaaatcaaaaaacctaaaaaatataaaaacacacacacacaaaataaaaatcaaaaaattaaaacataccaccagagaaaaacactttcacaaaaagtaagacaggaaggacagaaggaagagaagactccaagacaaccagagaacaaataacaaagtggtagtagtaagtccttatttatcaataataacattaaatataataggctaaacactccaataaaaaaaatagagtggctgaatgcattaaaactaaactcaacaatatgctgccttcaagaaacacacctcacctataaagacatacactgaaaaaaaaaaagatggaaaaagatatcccacaccaatggcattcgaagaacagcaggagtagctatatatatatatatatatcggataaaatagattttaagacaataactacaaaaagaggcaaagaaagtcattatatattgataaaggggtcaattcagcaagtggatataacaattttaaatatatatgcgcctaacactagagaacacagatatataaaacaaacgttataagagctaaagagagtgatagatcccaatataataatagttggaggcttcaccatcccacttgcaggattggacagattatccagacaggaaatcaataaagaaatatcagacttaataggcactatagatcaaatggatctaatagatatttacagaatattttatttaacaactgcagaatatacattcttttcctcagcacatacatcatgctcaaggatagactatatgttaggccacaaaacaagactcacaaaattaaaagaaaatgagatcatatcaagtgttttctcagagaacaacagaataatattaaatagcaataacaagaggtactttggaaactataaaaacacgtggaaattaaacaaaatgttcctgaatgaccagtgggcccatgaataaattaaaacaaaagttttaaaaattcatgaagccaatgaaaatgaaaatgcaaaatcccaaaatctatgggatacagagaaagcaatgttaagaggaaagtttataccaataagtgcctacattaaaaaggcatataaattttagataaaaaacctaataacacatcttaaataactagaaaaataagggcaaggcacactcaaacttggtagaaaaaaagaaataatccacatcagagcagaagtaaatgaaattgaaacaggggaaaatacaaaacatcaatgaaatgaaaagatggttttctgaaaggataaaaaaatcaacaaacctttagccagactaaaaacaaaagagagaagatcaaaattttaaaatcagatgaaaaaggtgatattacaactgataccacagaaatccaaaggatcattgtagactactatgagcaactatatgccaataaattggaaaacctagaggaaacaggtaaattcctagacacatacaaattaccagtatcaaatgatgaagaaatctaaaacctaaatagaccaataacaagtaagaagattaaagtcataagaaaaattctcccagccaaaaaaaaaaaaaaaccaaaaaaaaaaaaacctcagggcccactggatttattgctaaattctaccaaacacttatgaggaactaatacaaatactactcaaagtgttccaatatatagaggaggagggaatatttccaaactcattggaagtactactaattctatgaggccagtaatatcctgataccaaaacaggacgaagacacatcaaaaaaacaaaaatgcaggacaatatctctgataaacatagaggcaaaaatcctcaacaaaatactagcaaaccaaattcaccaatgcattaaaaacatcattcattttactttaagttctgggatacatgtgccatgccagtttgttacacagatatacatgtgccatggtggtttgctgcacctatcaacccttgttctctgagagcccagtgacaatacctgcctcacctcacattacccaatggaaaataggaacaaatctactttgacaggaaaagtgctacataagtgtatggcattcttattttttaaaaacatatatgtgcaggttataatggctttcaaagctggcctccttataagtgaatgagatatcagcaaattaatagaatctattgtaccctcagtcctgaaaatatcttaatattccacacttaaaagaccactgcgtttttttttaataaagtgaaatctcactgtgttaaaaatagtgtgattaaaaacaatattgttaaaaaaaatcattcaccatgaccaagtggaatttatcccagggatacaaggatggttcaacatacacaaatcaatcaatgtgatacatcatatcaacagaatgaaggataaaacaatatgatcatcttaatcaatgctgaaaaggcatttgataaaattcagcattcttttatggtaaaaatcttcaaaatactgggcttaggccaggcgcagtggctcatgcctgtaatcctagcactttgggaggccgaggcggacagatcacaaggttaggagattgagaccatcctggctaacacggtgaaaccccgtctctagtaaaaaacaacaacaaaaaaaattagctgggcatggtggcgggcacctgtagtcccagctactctggaggctatggcaggagaatggtgggaacccgggaggctgagcttgcagtgagctgagatcatgccactgcactccagcctgggagacagagtgagactccatttaaaaaaaaaaatactgggcttagaaggaacataacaacaactgaaagccttggatctaagatttggaacaagataaggatgcctactgtccctactgttattcagcataattctggaagtcctagtaagagccatcaatagaaagaagtaaatggcttctaaattgtaaaagaaaaaatcaaattatctgcatttgtagatgataacttatatttagaaactcctaatgatgccatcaaaaaccttttagaataaattcagtaaagtttcagaataccaaataaaaatacaaaaaaaaccgtatttctatatgccaacagtgaaaaatatgaaaaagaaatcaagaaagtaatcccatttacattagctacaaataaaataaaatcccaaggaaaaaaccaaaaaagtgaaagatctctacaatgaaaactaaaaagcattgatgcaagatattgaagatgatacaaaaaaggtgaaaatattttatatttatggattggaagatttaacattgttaaaatgcccataacacccaaagcaatctgcgattcaaagaaatttctatcaaaataccatttaccttctcacataagtagaaaaagtattctaaaatttatgtggaaccacaaaagactcagaacagccaacgctatcctgagcaaaaggaacaaaactggaggaatgacattacctccagttatactacagagctataataaacaaaacagcatggtgatggcacaaaaacagacacatagaccaatgtaacaaaatagataacacagaaataaatccatatatcaacagtgaactcatttttgactaaagagtcaagaaaatacattagggaaaggacagtctctacaattaatggtgtttggaaaactgggtatccatatgcagaagaataaaactatactcttttcttgccgtatacaaaaatcaaatcaaaatggattcaagactgaaatctgagaccttaagctacaaaactactaaaagaaaacatctgggaaaggctctaaggcatgagtttgggcaaatatttattgagtaacacccaacaactacaagcaaccaaagcaaacatggacaaaggggatcatatcaagttaaaaatctccttcacagcaaaggaaatgatcaacaaagtgaagagacaacccatagaatgggaaaaatgttagcaaactctacatctgacaagggattaataaccagaatatataagaagctcaagcaactcaatggtaaaaaatctgataatccagtttaaaatgggcaaaatatctgaatacacattcctcaaaagaagttatacaaatggcaaatgagtaaatgaaaggtttctcaatatcattgatcatcagagaaatgtgaatcaaaactacaatatgatttcatctcacccatttaaaatggctcttatccaaaagacaggaaataacaaatgctggcaagtatataaaagactgggaatataaattactaccaccactatggagaacagtgtggagggtcctcagaaaactacaagtaaaaccaccatatgattcagaaattttactggtatgtacccaaaaggaaggaaaacagtacattgaagagatacctagactcccatgtttactgcaacattattgaaaataaccaagatttgtaagcaaaccgaagtgttcatcagtagatgaatggataaggcaaatgtagcgcatatacacaagatagcactattcaggcataaaaaaatgagaccctgtcatgttcaacagcgtggatggaactggaagacattatgttaagtgaaataagccaagcacagaaagacaaactcatgttctcactcatttgcaggggcaaaaaattgaaataattgaattcatagagtagacagtagaatgatggttaccagaagctgggaagtgtagtggggagtagaggaaaaggggggtggttaataagtccaaaaatatagttagatagaatgaataatatctagtatttgatagcatagcagggtgactacactcaacaatttattgtacatttttaaataacaaaaagagtatagttggaatgcccataacaccaagaaaggataaatgcctgaggtgatgaatatctcatttactctgatttgattattatgcattgtatccatgtatcaaaatatctcatgtaccccatgaatatatatattcgtatacctgaatatatatattcatatatattcgtatttatgtgagtatacatatgaatatatattcacatacatattaatatatatacctactatatacccataaaaattaaaataaaaaaattaaagggaaaaataaataaatactaaaaatgggcaaaaggtctgaatagacgtttttctaaggaagacatacaaattgtcaacagacacatgacaagatgtttaatgtcactaatcatcagggaaatgaaaatcaaagccacagtgagatatcacctcacacctgttagtatagctataatcaaaaaaaaaaaataagaaataatcattgttagccagggtgtggagaataggtaactcatgtacactgtttctgagaatgtaaattggtacaaccattttggaaaatagtttggagcttccttaaaattttaaaatataactactataaaaccagcaatacctctgctaggtatctatgtaaaggaaatgaagtcagcaccttgtagaaagatctacattcccatgtttattgcagcatcatgcacagtaacaaaggtatgaaaacaactcaagtgtccatcagtggataaataaattgttattttatatatacatacaaatgaatactattcagccttgaaaaagaaggcaatcctgccatttgcaacaatataatgaatctgaaagacattatactaagtcaaataagccagacacaggaaaatagatactgcatgatctcacttacatgtcgattgtaagaaatagtcaaatatatggaaacagaaagtagaacactagttaccagggacacagaggaagagaaaatggggagatgtaagtcaaaaatgtacaaacttgcagctacgtaaaatgaataagtttagatatctaatattataatgtacagcattataatattattaactacagttaataatattgtattatataattaaatttgctaagaaagtagattttaggaactctcaccacacataagtcacctatggaaagtgatgggtatactaatttgcttatctatagtaagcatttcactatgtatatgtttatcaaaatatcattttgtatatattaactatacacaataaaaataaatttaaaaaaatcattttgggggagggaagctgtaaatatctcacagatgttttacttcagctaggaaaaaacctgaagagttataaggatcatgtgtttttattaaaattatgtagttatatataactacacgtgttgttgaaacatagatagataccaaagcaaagaaatgatcgattggcctcaagatagacaggaaggatttaattagctcaacagtgtcatgatttaaataaaaataataatgataaaataactgacacttataaaatggccactgtgtctctatgtgattttagtgcccaagaaaagagctattactctttcagagttgaggaaaagatcagagatactgactactttttgctgctttatttttttccttttccttagaaactagcttcatctcccaaagtcccacctcatcctctgcctttactttgtactatgcttggccccattagcaacttaattgctgacccgtcatgtatttctctctgatatttgacatatcacatccttacaacataaccttattcaccatcaggggttcctaatccaaatttcaaggcatagataatagtttactgagtcaattgtaatgtattacacgggtttaaacacttacctaaaaatcaaaaagcacctcaagagtgttctaagatgtggcactggccgggtgctggggtggctcatgcccataatcccagcaatttggaaggctgaagcaagcagatcacttgaggccaagagttgaagaccagcctggccaagatgacaaaaccacaactctactaaaaatacaaaaattacctgggtgtggtacatgcctgtaatcctagctcctctggaggctgaggcatgagaatagcttgaacctgaaaggcagaggttacagtgagccgagattgtgccactgcacgctagactgggtgacagagcaacactcagtctcaaaaaaaataaaaaagtgaggcacatttcttcttttcctgcccattaaaactttcccttttactatatctggaggcagctaggtacactcttaaaggagccaggattaaatcaagcacatgaaatccaaattctggtcctgtaaatacaaatgtccagccactgattgaccagctattatatgcacaacactatgttaggtgcctcctgcaccttttcccatttgattccctaaactctcaatgaatacattacttctgtgtcttacagataaggtcacaagcagcagtctgcagagcccatattcaaaaccaaatccttctaaaatcaaaaaccaggctgactcccctggatgctattctaaagtcaaatttcaaattatactttgttttctacagtgtgagttgtgaaaagtagtacaaattcactgtgattaccactagcatgttgaaagataacattttatgggtaaaataagtacttattgctttaaaatgatagccacagatatcatccaggcattaagtttatatctacagagagtgttcatacaaaacttacgtatatatctactgatggtgttcatataaaacttgacctttccatccattcagtctttatctcttcacatatacctttgtatttgcttaaagactactttgtctatttagcaactcaacttttggttcattggagctagaattttcacctgtatctctacaaatctatattaattttatttcaaaatgactgtttttgatttgttttcccagatcttacagtatgctccattggaactagacttctaaatcatagagaaatctatttcttaaatgacatcaatctaagatccaccaaaatgttaaccctatgagggcagttctgtgttctgttcattgtttatcgcacacctagaatggctctttacatctatgggagctactcagcaaatacttgttcaatgattgagtgaatctagtccatctattttgactacataaattaattatttgataattatatttcaactatttaactaacagttaaatatttacatttcaactatttacatgtttgaactattcacaggaaaatgctatgaccaatttcttttcttgtagcctttcttttcaggagactaaaacttcaatgcatgcaatgctaatttgttgtcagcctcatgacatcttaaataaagaaaaccctctttatcctggggtggtttggatgaacttagcggaatgctcaaaaactaaaggtgaaccaaaaagaaggaagtcaatatagttcaggaagctccctcctcctgttggccttatttcgattcttctagggctatttacacgtagccaaataccccagaatttaaaattaaagcctttggaatgtctggcagaaagaatatattctagaagtaaaacctcagacttagattcttttgactgtttggcatcattattttgaatttgcaatgtgaatgagaaacaaacaaatgaaaaagataaagtaaaagaaaaccctcaatttcaaagttgcacatatttgtcattatttaaaaagaagagtacatgttaaaggcctaaatattttaaataaacattttctaccacaaaagatagcattttatcataaaattggcaatttttagaccattgaacttaatttgaatggactaaactttgtctcttggcaaccagaatccacacaaattggtaggcactttctctggaggaagatcatgcttctcaatacttatgaactccaagctaaaggctggctttactactgaaaacatcacaaagttaagccaccagtatagacaggaaggattttaagtttctattttctcttgtttgtgtgtgtgttcaattaattttaaagaaataacagtgagattcagatttcttaaaaatattttttaggacattattaatagctcaaataaagccattaatacatgcacgttatgatgatcaagtgatcctggttaaaattaagggaaaggtacactttaaaaatatgatttaaaaagcccccccagtcacttaacttcagaagcagggcccggtagcccaccctgtccttggtttttaacatagaaattaaggtggtagcttcggcaggtgttattaccaggggctcatgagtagaccctaaaaggtttgtgaaccctcttaggattatgtgcagcgtttcacatggatgggcacatatgcatttccctggggtaaaaggcatctgattctcaaaggagatatcaacaaaattgatgagaaattttggtgtagggaaaagtacgtaagaccaacatttaggaattctgggttttaattgtaataaggtgcttaccagttatataattgtaggcgaatcatttctctgggccccagttacttcatctgtggttactgtgggccccagttacttcactgtggttccacacttgtgggttgcgataactgcaactccaaagagtagttgtgggtctgtgaatccataagtgtaccaagtttcatctatggattgacaatctatcatatgtgtgtgtgtgtgtgtgtatatatatatatatatatgtatatatgtatatatatatatgtactattaattcataatgagtggtgatgttactgtgatttacaagaacacaaaagcattttaaaatatccttaaatttattgtagtttttggtcactacatgttttctgaatcaatcactgataaaatgacaattataagttttgccaaaacacattggaaggactagttcaaacaattctaagctgtgtccagctcaataagtgtaatgtttagatattttattaaatattccaaacgtgggtctgtgattttatgttttaatttataagtttctgtgtaacatataccaacatatttttaaaatgtacactgtttgttatcagtgcagtaaatggatagtaagaaatatggatgaaatttttttcccttattggtttgtacctatgtgtatgtgtatatacacacacacacacacacacacacacacacacacacactcaagagtttatttctttggtactttggctgctgaatatgagatttagttttagacaattttaagttgataacattgctctttctctcaccaaaaaagtggtcaagtaaattgacatatctaaattcaaattcatcatgtgaaattggaataataataaccaaatcatggcactactgttgctcaaaaattagagcctacaatctacctctgataggtccttggttctggcttattggtcagcctgcactcccatggataggtgtacccaactaagactaaagaaagttcttcaattatcatttaaagaaaattatttattaaactattaaactagttaaatattaataagcccaataataaaaatatgctttgtaaagcaagatttaaacaattaacaacatacaatttacttttcatctttattattaaacatgaatgaaatacataaattaaaaatacatttaatatgtttaattgggaaatttagtttttcatatttaaactatcctatatatatccaaaagcaagataaaaactctaaggcaattctaatttatcatgaaaagcttttgttcagtctaatggcctatttaatactaacgaaaagtccggcaacagaatttgggtttcttaatgttcctttacatgactaagcattttgtgttattattcaaaggtattttattatcttgtaaacttaagtttatgtttgtcaatgagacccccaaattcttcatttttaaaataggtaacaatatgaaattaaatgcatttattacttattagtgaagctctatatgtggcttctaattacatatgaatagtttggtcaagagaggcctcaaaaaaatgagaacaagttttcccagttcatctggactgaatcactatatgcataagtgatacatgttttattctcaaacacttgggttttgtttaagcacaccaaggattctagtttggctgtttcccaagtttgctttaaagtaagattattggatcagactggtgtttcaaagaaataaatcaaaatgtacacagtcaaatttgttaggcagaaaaaaactgtcatctctccaaacgttttttggtgcctatgtttctcaagctcaaagaaaataagacatgccaaaaaaggagcatctgtcttaatgtaagtaaagaaaagtgataaaaaataatttgtgctgggtgcagtgacctgtaataccaatgacttgggaggcggaagagaaaggattgcttgaggacaggagattgagaccaacctgagcagcatagtgagacccagtgttcaccaaaattaaaaaaaaaaaattagtttggcatagtgaagaatgcctgtagtcccagctactcaggaggctgaggcaggacaattgcttgagctcaggagctggaggctgcaatgagctgtgtttgtaccactgtattccagcccgggcaacagaagtaacatcccatctctaataaatacataaataagtaagtaaattatctgatgcattattcaaggaaaaaaggaaagcaacttttatcatgtggccctcaaatacaactttacctcatattgccaacttctttgtttttttgagatgggagtttcgctcttgttgcctaggctggagtgcaatggtgagatcactgcaacctcactgcaacctctggttgctcactgcaacctctgcctcctgggttcaagcaattctcctgcctcagcttcctgagtagctgggattacaggcatccgccaccacgcccagctaattttttgtatttttagtagagatggggtttcactatgttggccaggctggtctcaaattcctgacctcaggcaatccacccaccttggcctccaacagtgctgggattacaggcatgaatgagtcaccacactcggcctcatattgccaactccttaatggtagagaacaaaagtaaatagatttatgaaccatttcaattctagatgaagggaagtgtagtaggtctttctttaaaaaaaaatgggagattgtagttgctgattttattatttctagaggtggaaagtatacaaagcatgctttatacaattatattttatatacaggtatataaaaatggaggacattcttttaatgagagtttttttaaatgctattatatgtgctataggtaaatacatgactattttcaaatgaaaagcttaaaacttctcctgaaaataattcagtgtcatttttagtgattctccaatgagtttcaaatactatatgctatctgaaaagcattacaaataaaacacttcatcttacttattcaacaaatattttatgtactttgccagtcactgtaatattgagttctgattatgctacataattgagtaaaatatataccactttaaggaatatgcataaaaatgagagaaatgactttattaacacctaaccatgcaaaattaaaatgaacacaaagatagagaaagcatattgaaagaaccaaagtaaaaaaaaaaaatcatcctaattagagagattaaggaaggtgcaaacagacactagcctttgatctgggtcccattgataagtacaatgtaaacaggcaaagaagaaaccaaaagcagggctggaaaaccatgttgaggaactagcatgagcaaagacagagacttgtgaatttctagccccacacagggctctaaaagagataaaatacagttgttattgttgttgtttttcctttgtaccggctctatatcataaactgagaattattttattgtggatgatgtcacatctcaccttatttcttatttatattgccatttgttatttctgtatatgaagaaagtgggctgaaatatttttgaggctttttcatggttcacctttgaactaaaatgatagtattatttatatcttcgctactgtctctgatatataaacacattatatatgtcatgaaaacacactgcatggttcatcaattaagatatcctaatatttgatctcatctattaggagaaagagtagcaattgagtgcatccataaataaaataaacctgactgtttttaagattgacccgtctcatcaaagactaaaacacataaaaccagagtcagcaaggatgtagggaaggaagtctcacaaagttttattgggtgtatagaccagcatgggattactgagtttatagttcaacaatccatttcaaaaacctccctgttttctattttttatcttttgatacaacagctaaataatgaaatttcaaaggaacatgtaaatgttttggtttgagtattatacttctgacaatttatcctgacataataaatttggatgcacaaattaaaaagaatcttatgttagtatatataaacacaaatatttggaaattacataaatgcctaacaacagtttattggctaaaaaagttataatcatataataacacactatgcagctatcaaaacttacagtgtatatgcacatagttagctagtgatatggaaattttcataatatgtgtaagtgatgcttagcctagttcctcatatatagtgagcacttaatccagtttagttattatatctgctgttgtgtctgttattaataagatgttatataaatatataaaaaataagcaggttttatatctgtaaatacagaatggtcacagagagataaatagctatatatgtaacaacttattaagagttgtcatatttaggacatgatattttggtaatttaaaaatcattttttatgaataagaaggggttctgtagacattttccaaggttaccaatatttctatatcacattggctcacttcaaattaaaattcactctagacaaaacagtgtaacatggaagcttcagttccctgttgattcattaaataaagtctctaatgtttgatgttgccgaaatgcctggtaggatttcattaaagaccgcctaaactgtaaacattttatttgaaattagttatcttctctccttgacccacatatctctaaatcatgtgtatgaccttttaaaaaatcaattttatttggaaaacacactatctgagattcttttaaatcatctcagagacaagtcttccaaatgggcaattcagaaaggtcactcataagtaatttacatttaaactttatattactttctatcttttaataaactccaaaaaattgagaggttttcagaaaatacctcaggtctgcaattcaaatatttggggcattttttttttttttttttttgctaagcatatgtttgatttgccagtggaacagaattgtgttatccttctcctcaagtaacatctaactaagtgcagagttcataattaaaaaataataataacagcaatgaaggtgtaagtgaaagtacataagctggagttcctctattggtgaaaggtctttgctgcatcagctgggactctcctgacttactgttcattgctaaacttcaaactgatgtattgagaccaaattaaaagcaatctcaactgctcatatattctatcttatctctcaaaatctatgaatgtgctactctttggacagatttcttcaatttttaaaagtttaaatactttcagtagtgttctcaatttatcactccatgtcacatattcaatttagtcttacttgtaagacctatttcgtttgagtcgtaaatcaatctaacaccacacaattgcataagtcaacttttactatcttaattctatccattacttactgctgctctagattcaaatcaatgaaaccaagaaatcacacatgtttgagaatgttacttaattcattcatttgctttcacataggctacctaaatcactccaaggggtaaaaataaagtatcttttaaaatattctgcagataataaaattactcctttcttcagtaaagggcttggaacatctcttacatatgtttgacactgaaggaaatataaaagtgaaccagacctgggcctattaaaattaaaacttaccctaagaaactagcaaaaagaaaagtacttttaaggacagataataagatctgtctttatcttgctgataattttctttctttgtaaaagggattcaacatcataaaagtaaaaagaaaaaaaaagcaaacaaaaaatcttcatttcacactgccacacaactcacttctctaatttttactattttgataagtcacaatcatcaaaacaattactagaggccttcttcttgattcctgtattggtcttttaatacagaaagattttcaagctgtgatctctattttttgataatagagttcacaatgagctctaagaatgtgtcaaactgtcaattgatttcaaagataacctaacaaggttaataactcttatcttccggatgataacctaataactaagtattgcacatctttagtgcccaaagctgctctatttgtcatgttatttttcaggaaaatacaaatggctattcaaaatttacatgatgcatttgcaccaggtgagggttaaatcataccaggacccaatgctgaaataaaaaatttgaataatttaagtgaaaagagactcaagtcaccacataacatggtgaggtagaagcacgatgaatgcaaaagtatatccagtactacattcagttgtacatcgtgatttaatttcagaaagataacatcctcaatcacattaacttaatgattttatttgaattttattttattttaattgtattcaaaccttatttgaaaatttgctctggtcttataattgaatatacattataaatattagggtctaattcataatgcaatggttttatattttaaatattattataataaaaatgcataagttagtggcaggatttcaggcaaatgtttttcttttaaaaggagttgaaagttaagtctgaaaaacactggactatagaaacaggccgtcaatagacaataaggtttgccaaattctatgatctaaagctttcgtgaagcaacaggaaagggcaaattaatacctgtcaattgcctactgtgggcctattatatctcaagcactgtgctaggtactgttgtgattagcaatttcatttaattctcacatgaacactataaatctgctatcaaactgttaatgtccccataccatgggagaaaaattaggacatataaggatttggtgacttcaccaagctttcaacttcactaacaacaaagctgagatttttagaccctgattttagttttctccacaaccccatgttctcttccaaagcaattgtgttggctgtcaattttcaggttagaaagtgacaaaaataaaaggaatgtataaggtgacaagaatgtttagaatagtgaagaaagatcacatagatgaagacaaaaaaatagtgtgtgtatgtgtgtgtgtgtataatttatatataaataaaaatcatcactcttccaattactgacttcctattttgcatataaggaaatgaggctgagcaagttacattgctaaaaaggggcagagaaggaatgatcaatcttgcttgcttaggcccaaaggtagtgccctagttaatatgagcaactgtgattctaaatagagatttctttaggaaaatccatgagcaaggtgtaaacttcccccattaggaagagtgtgatggtcaaaagtccctcactacaacaaaaggcagcttggcacaggataagactcgtgttccagcctcactccttcaacggatgaatgaaaagggaaatactctttttgaagaccttcaaaggaatacatattttacaggatggatatccttcatttataaaccacacattttaggttgttcatatattatttcccgttaattatattttttgttaaaagatttttaaaaagatacagtcaaacatttctgaaaagagaatattgcctcattagtacagaatttatttggggtaacactaattaaaaattaaactaaatacaatcccaactaatcctagtccctttgacaacatttagatgacatcaagaataaatctattttaatgcttttgtcacatattattctacaaagtaaatcccacagttcatttttctaattattaatagagagccaagaggagaagctgatgattaatggagtcaggtacaagactacaggcaggtgtgaaaagtgtgtcagaaagacttgcgctcagatcttgtctcagccaacagcagctatgtgacttgatcaagataattaaattccctaagatttaggttgctaatctgactagcatcttccttgcaggatggttgtaagagatttaaaataacaacataaatatttaaataaaggcctagaattggcaagaagtcaatgtatggtgagtattattattagccagatgaccatattgttttaagcctaagtgaaaacttaacaaataaaaacatttattaaaggaaaaaagaggtttgactattaggccaataccagtaagatttatctgggtcatcaagctttttctcattataatctctcatactttcttctgtttactagtatgtttactactatgtcaaataaagaaaagctgtgaaaacatggaaaacaatgtgaaataaagtatcttttaacataaaccaaggaaagctgataaaactaaacaagacacatggtaagaacaaatacttgatatgaaggatggaaatattaattggataaaaagctaagtttaaaatacctacctgtaatatttttaaactgataactttaaacagtcattatgaacgttaataaaaatatcattaacccatttattcataaacaaacaccaagatataagggcattgaaaaagcccaatcactttaccctttcagttagttttgtttggaccaattgaaatattaaaattgaacagcccaacattgagaaaggagcaaagcctggacatagtttatgaaatagtaatcactttgaatgctaatggtattttaggcttagctgttttagtttttgaagtataggaagtggaggatggaaagattagaagctggaagattcccaaagagaagttccaatattggctatggtataatttacaatttattatagaacaaataagtagcattgttgagagtaatttaaaaaaactcactacaactcaaagtgatctataacaagttcatttgagtctggaatctttaagaaaggtgagtattgagcttaatttgagctcagagggaccaactgggtttgaccttaacatgtggaaatgttctcatcatttcttggataaaacatgctaccacatatactggcgtttatggtacttaaagtcaaataaatagtaaatgatattagtaatgatattctctgtatagagtatgaaaaacttatagtttgagaagtagataaagtaatacagtatttatatttgctttacttgtcttctttcaacatttataatgactttgaaatctgacagatttctcattttctaaacaatgacaacacagccttcatcctttctgctaacaatttgcatagcttcatttatcagtagtattataacatattaaccaaataagaacaattatagtaaagtttctcttacccagcattcacatggctggatatttacacaaaatacagtcttttaactagaaggaaacaaaatgtttccaaacaaattctgtaacacaagtttgttggactctgcatgtctttttcaagagagtccaccaggccctcaaatacagtagaggatcttttattttatagacaaattttaaagcaaattcagtcctccagtttccaagatgactgcagaatagaagcagaaaattagaagaggtgtttgttatattcacatactaatacctgtgagcaaagccagtggatatgtgggcaaacaggagaagtaatgcatgaaattgtatctcacactatcactgtcattttctaaagaggcaaacagttgtaatgattcaataactttagatagcacagttgaattaaaataaaatgtgattacaaatattcataatgagcatgatgcctagagctgaaaataatgtattatatacttgaaaattgctataagattagatcttaaatattctcacgaccaacaaggaaaatgattatgtgaggtgatggatatgtcaattaacttgatttattcatttcacaatgtgtacatatatcaatatatcaaaacatcatgttatacactaaatacataaaattttatttgtcagttgtatgtcaagaaagctgggaggaaccaaatatttataatgagaagtgtgctggataagaagctcttagccttatcacattttactcctcttaggaagagaagaaagtatttagtatgactttgatttttgtgttttaaagcaatacattgttattttaaatgggagagacatcttttatatttttcatacacgaaggactatatatccattatttagaaaatttacttaagaaacagagcctgacattcaacaagaaaaagaaaaagataattattgggtctgtatttagtgttaaacattgtactaattctttttatatacttttaattcgcacaatatttttatgaggtattacttcattttttttttttaaagaagaaggtacaccccagagaagtcaagtaatttgtataaagttacatattcagcaagcagtagaaccaaatccagtcattctcattcactgggtcctctgcacaaacactgtttatctactcactgtcttctcatctcacctccacataacagggttcaagtaaaagtaggtcattcatttgaatgtctttttttaacgaatattaaaattggattatgtttttacatctatatatcagcaccaaatttagaaaagcttacatatatttttgatttcctaagttatataaggtttgcatctttcaagatggtatcaaacaaactgtctccattaacatgttccaggatggattctagtccatattctcttttctctccataactgtgaatttgtactgttttctgcactactgatatttgcctaaaatgttcttgattgcagtatattttaaattcacaattgctctattttttatcttctgcaataattttcctttttctttgcatattctatatttttagtttatgactaattcatctgtggatgactcaagaattctgttttattctggcacatctgaaataatttctcttctcttgagatcaccaaatatatattcaaattttattctctaaatttcaccactgaaggcctaattgtttactcaattttgttttgtttttaactaccagaactttggtacccggtgtgcttactttaaaataatacttttataatgcaaaataatttttaatcaagtgatacaagggtgcccacattaatcatattttcatgaaacccaaacataccagatgcaccaacattatcctatcatggctcctgaagataacagtagagaaaaataggccaaatgaagcaaaaaacttttaaaagttgtaatgtgtgtattttagctgcatatgtgggcaacaaaggaagaaatcatgatcatttttctttagtaattctcacttggccttttaacgatatttaccggataactccatgtacagcattatcctaaaccaagtagctcacattttaaaaacagataagcgaacacaacactagattagaataataattccaatatgattagaataataatattctaatacgtatgtgtgcgcgtgtttggcgaaacaatatgagcacacctgacatttagtacataatgaataaacaaatgttgagaaatagaaaagggaaagaagtacctgatgtctaaaaaaaacttctattaagaagtagtagcttcctagttgaaaaaataagtcagaggagcattgcaaacaatggctaaaagtacagaagtgagaagcagcagaccatgtgcaaataactgtacataggctggggtggcagtagttgaaagatcaaagtatataacatgaagagtgaagaattcagtaataaaaggaatcagattgtagaatgtcttttatattatgtgttatcttgctcaaatatcattcaatgaagcttactgatttctctcacaccttagtggcctagttttaaacgtcagggttcttaacacaaaattaaatacgcctgcccaaatgaatcagattcagtcttctattagtgcccaggccttaggtgatatattccataactctgaagaagaaaccaattttaattttctttgtgttctagcatctatttgcaacattatttaagtggcccatttttttcctgatttgaaatcatctcacatagtgtgatctcatcccaggttcatggttttttttttttttggaagaccttttaaaagcaattcagcctccagggacaattttttttttctttttttctttttttcttttttttgtcatttgcttggggaaaagaagactttttaatgggaatggtgatgggagaaagcgctcccattatacagttttatcttttgaacaataatgtcttactactcaaaattaatataaaaaataaaactgaaatttaataaaaataaatacagataatcctaatatgatgcaaaatagtaacatatggaaaatttaatggaacattaaattccataaacatatggaaaaaataattcaagtaactctgaaatacatcatgttgactataaacctatggaaagtatagcataaaaataaaaactgaaaaaatattgaactttgattagttgatttcccgataatagtcttggtgatgcaattctgaagctactctgagtatattgaaaaaaagtgactaaacgtacatattttgataaataagaatattcactatagaaacagagaaatacaaatatcaaatggcagaagatgagaaacaaaaccttgtaatgctgaatttcatttgaggcaatcagtatgaacacacttacatgtgcactcatatgtgacaatgtgttaagtgcatacgcacagttttccccctaactctatcatcaaaagggccaaagcacaatgaaacaaccaagaggcaataaacactccaaacttagatctttgtttctaaacaaagatcttttatactaattttaattagtataagtcattttatactaataagaagcaaagtttttctgaaaattgcttatttcatactgaggcaaataaaagtacaaggtgagcctgaagcaccttaatgtgccagaaaataaagaaatgctcaaagtctaatggggacatgtgaaaaagacacagaggtcagtttaaaggcgaccccattaacaaaactggaacactctgaatatcaaaaataatcatgaaactaatggaacataacacatttgaacttaaagaaataagccatatatatacataataatgagagagagaaagagaagaggagaagagaagaggggagaagaggagaagagacgagaataggggagaagaggggagaagagaagagaagagaagaggggaggggagaggaggggagaggaggggagaggaggggagaggagagaggaggggagaggaggaggaggagagaggaggaggaggagaggaggagaggaggagagggaaggggaggggaggggagggaaagcgggaaaaagcttccttacaaaaaagaatgccaactgtaaatgtagaacaactatagtcaattatttggcctaacaaatgttagggaacataatataaattttaattttacaaagtttaaaaattcctttacaatggagatatttgatggtcagaatcttaaccaaataatggcacatatatacctactgatgcgatgatgtgggagacatacaacatcaccaatagcatattcttgcttgaaatcttaggtgtaagtttatctcattagaagataggcctttctatactataagatattctgcaggacaacggaccaggacttttcaaataattcaatgttacacaaaaaaattcacatgaggaagacagttgcttcatgaagggtgactaggaagaaataatgcaaatatatacaccttaattggattttagacataaaaacaaaaacaaaacacagaaatgcaaagacaaagcataaaacacagccataaaggacatcttttagataactggggaaatttgtatggcctgtgtataatgatagtaaattaatgttgacttgtgctgtaagtattctcaggctgtgtcagaaaattttatcattctgaaaatatacacattttaatatttattgatgaaatgtcatgacatttatagtgtattttcaaatgatttggcaagagggaagtgtgtggtaagatgttaacaaatggtgagcttggtgagggatatatgagtatatattgtaccattctttcaacttttctagtgtaatttgtctgtttcaaactaaaaacaaatagaacagcaggaaatacaatttgacgagtctcattcatcctaaatcccagataagtgcatccattccttcttctgggcatgaaaattgcagtggggactggcttcctgcttcctgccaacaccagtttctagtctgatggccctcaaaggttttcctaaaattatatattcataaattaaacataagcctctcacacaagaatactttcaatggttctattgccctatgggaaaacttttaagcttagtaaagcatttaagagctttcatttgataatataatgacctagatttgtcattttccctgtaaaatgacagtgtttaaattaaaaaaaaaatgggacacaactgaagtttgaaattaccttgaagttttgagttgaattgattttaacaatattttatttgcttttatagaacctcaacaaatatgttttaacatcattgttatctcagatctatcacttttattttgttctaataaactacaggatacaaagtagaatgccagaccaaaagttttggaacacaacatctatcaagcaagcaacttcaattgttcccccaatatggcaccatttctttattccttccaatcccctaggaagcccaaggacaagtggtcccatatgagtacattattgctgttgttattaataactgttgttactctgaggcttagagagattaactgatgaactctgcctaacagggcttcatataggtgtcgttaggaaagaaccactgaactctaagaccaacattatgtcttctgtcatgtgttaggcaattccttttgatgtctatgcagttttacaatttaaagtagtcatttaatcaaacataactttcatttgtgaagactgtattccagaacatttctccagacatctagaaatcatcacaaaatttatccaagtctctcttctatacattagcttcacaattagcagcaatcagataatctttttcagataatcattttcaccatttcttctacatagaaatgctcccaattctgaaatgtgaaagtctaggtctgactgtaatggctaattttctattgtacatatctatggaagcatattgctgctactcactcataacattccaaaacaaaaacaaagcttatggtcctctcctaaaaattcgccttcttctgtaatttccttataagttaatgatgtacaccaagctcccaagtgggaactcttgatgccttgtaggactttaccctttccttcccaccagcaacaaaaagtagttttagtataggagaaatagcaaaagaacaggagttgatcttaataacattgaatttgcttttacctcaacatataggtttcaatatcattcatatatccagatttctctctttttgttctaataaactacagtatgcaatgtagaggtccatatataggggtcttggcatccatagctacaaattcacattttcactacatgttcaaccaaccgagcacagacccttaatagttttggccctcagttttgtttctcttttctgaaatggagatgtctagccttacctcgagaagttgtaaatagtaaacatgaataatcagtgtcaaatgcttggcactttaatagtgtttggcagcaaatagatgatcctaaagttgtgttgcctaaagcgagatgcatttgagctgcatcttgaaggataagttggttgttgctatgacctcatgaaaggactttattaggcgggggaaatgagaattttactctgaaagaataaatgatgtagacgcaaacaggctaaacttgaagccagaaaaatagagagaagccagattataaggaatttcctatgacaaactaaggagtttggatgctagagaaccaataaatgttcataagtaagagagaaacataatggagctttgtgtgtgtgcatgagtgtgtttgggtcacagtgggagaattaaatagttgttaaattattcctttattttattgaatatattccaagtttaaaacatgatattttgatatatatatttacatagtaaaatgattactatagccaagctaataacatatccatcatctcatatagttaccctttgtgtgtgtatggcaaaattacctaaaacctacgtgccttttttttcaaatttctggtttatgactcaattttattaactataattctcatgcagtacattagatctccagataacctgtttttttaaagaaagacagttgtgtgcagcttataaaaaatacactggattacaaagggcttaaaacaaacactgaaattcaccaggatgcttaaaatttgtcaattatccagctatgacaaaaccaccgccaacaatatactgaatcagcaaagcctggaaatatccccctagagaactagaacaagacaaggattcccagtctcaccaatcatattcaatacagaatggagtgctagctagagcaacaaggcaacagagaaaaataaaaggcatccaaataagaaaataagaactcaaactattattctttgtggatgagatgatcctatgtctagaaaaccataaagactccaccaaacggctcctgggactgataaataacttcagtaaagtttcaggatacaaaatcactgtacaaaaatcaggaacatttttacacatgaataacattcaagctgaaatccaaatcaagaatgcaatttcatttacaatagacacacacacacatacacacacacacacacacatacacacaaaatgcctaggaatacatctaaccaaggaggtgaaagacctctacagggacaactacttcaaaacactgttaaaagaaatcatagatgacacaaaacaaatgaaaaaacatttcatgttcattaattaaaagaataaatattattaaaatggacatactgctcaaagcaatctatagattcaatgttactcttatcaaattaccaatgtcatttttcacagaactagaaaaatgtaatgtagcattcatatggaacaaaaaaagagcctgaatacccaaagcaactctaaccaaaaagaacaaagccagatacatcacatcttctgacttcaaactatactacaatgctacagtaaccaaaacagcatggtacttgtacaaacacagggagatagaccaacggaacagaactcagaaataaagctgcacacctacaaccatctaatcttcaacaaaattgacaaaaataagcaatcaggtaaggaatgtctattcaatcaatgttgctggatcagctggctagccatatgcaaaagaatgaaactggactcctaccttttaccatattcaaaaattaaccaagattgtttaaagatttaaatgtaagacctcaaactataaggatcctagaaaaaagcctagaacaaaccgttctggacatcaaacttgggaaagaatttatgactaagtccttaaaaacaattgcaacaaaaacaaaaattgacaagtcagatctagttaaacaaaagagcttctgcacaacaaaagaaatgatcaaccaagtaaacagacagcctgtcagaatggaagaaaatatctacaaactatgcatctgacaaaagtctagtatccagaagctataaggaatgtaaacagttcaacaagcataaatgaataaccccattaaaaagtgagtgaatgacattaacagacactcctaaaaagaaaacatacaagaggccaacaaacatgaaaaaaattatcatcgctaatcttcagagaaatgcaactcaaaatcacaaagagatgtcatctcataccagttagaactgctattattaaaaagtcaaaaagcaaaagatgctggcaaggatgcagagaaaaggcaattattatatactgtcggtgagaatggaaattagttcagccactgtggaaagcagtttggtgatttctcaaagaactttaaacagagctatcattcgacctagccctcccattactaggtatatatccaaaacaaaaccaatctttctacccaaaagacatatgcacttgaatgttctttgcatcactattcacactagcaaagatatagaatcaatccaggtgcccattaaaattatgttctttgcagcatcatggatgcagctagatgctattatcctaagcaaattaatgcaaacagagaaaatcaaatattgcatgttttcacttacaagtaggagctaaacattgagtacccactgacataacgatggcgataatagaaacagaggactactagagtaggggtgaatgggagaaacagttgaaaaattttctatgtcctctcttctggatctgtccatgcaaagtaatcaattattttagagaccaaattacgttttgcgtttttgacattttcagaaattctttcttttgtgggggttacttattcaatctggcctccctacagggttcagggagaaaatgagaacaggatggcattcacattactgacagaacaccagtcaatgaaacattatctcctggagccattctctaactgctttattatttttgtgctttaatcaatgagaatgtttacctatggggaaaatctttgcataggtagactcactgaggaatctaacaagtctatcagtagaaagctttttggctttaaaaatggattgaacatattgaattttttaaacaaagaactaggaaacatattagagaccaaatttttaataatgtaagtaaatgagaggttgcaatgagaattgtgaaaaaaaagattcccttttactgtatcacttattaggcctcacatgacttaaataatttccccattttatcctacctcctgcattaatattttgctgttcttgcatgttaatgtttatagaaatttctattttggtatgctcatttttttctgttgaaatatttgctgagttaactctggttactttaaacaacatttccaaaaagcatatttacttgcctgccaatgccttccacatagggataaatgcaaaatcctcactaggacaataaagtcacccacaagcttcacctcctgactcaaatgttgtacttacaaatacacatcatggaggtttaggtacctaaaacgtgttctttttaccattgcgtccttgcattgttagttttttttttttccctattatccctctctaatctttgcctggtgaactcattattcaaacaccatctctggctttaagtattatatttgctaactacccacttatctgttggtatagatttagttgattaataaaataatataatccattatgactggaagaaataatccactttactgggttggggaagaggggtcaccagggcttctctcccctttttgaacaaccttgttcagagctaaaggaaaagcagtaaataaatatctactatgtttaaagttcaagaagtcttatcatctttcctcatactactattaataatataaataatttccacagtgtaaagatgtcccttggaaacaactgtttacttgtaagaacaagctctggagtcagaagtcgcaaattggatagtgtagcggttggctttcaaatgtgatgagcagaaacagagctttcatggaaatgcctgagaggtgattgggagagtggcaggaaaatggaggccaaaaggataggtggaggagaagggaggggagcttgggacaacctaacctaatctcagccagagaagtcccgattttatctgttttacatattggctttctgtatgaccgtccttttcttaaaagaaagaaaacaaaaaagctgcttttctgtatgttaattgaaaactactggtataaacattcttactgcccatattagtgttttaaagcattaagaactttattctgcaattaatgaatcagctattggtattcaaaccagtttgagtcaggtgcaggttcctttaattaagctcccagtgtggttcacaaaagacaggtggctacagtttcactgctttgctcaaggatggcatgctgctttcagtttccactgttatctaatgactagaaataaatttttaccaacgatactgaaaaatgaaatggtcacattatatccttcttttacacctttatgaaattcacctaacagaagaaagcattatgtttcccagttaacttaggtctaacctggcgaaatgcaagggttcaagtttgagaattcataaaattcgtagaagttttatgacggtacatggagatcattcctgttttcctgtattctgtccagctaacatgcacacaccctttttattttcattgttagaaataaactaatttccaaaagaaaatatgaaatcaagaaagctattgctctcctattatgtgcaaatattagtttccaaagaaataaagttaattatgaaaacaattcaaaatgcacaataaaaggataagatatggacctaagaaagtaatacaaataaggaagaagagcaattaaaggcaagtgcaaataaagtaatacaagagcagaaatgaagagcaattgtgttcaaaagaggcaacagatgagaaacaaaaaatggtcacttcctaattttacatctggaaagatattactgtgtgccccaactaaacatgaagcccagaatggcttgctttgtttcctctttactgtctagatagaaggttgatgtgcagatacttgattttctgattgtgctctgaagccactcccctagatgaacaagcagtttctgaccactaagagtaggattatgtaataaaagtacagtgcctaaggcatcaaaccctgattttagtccaggtgttgtccagagggagccaactttgtttcaccatgagctcacattcttccaattgtttcacctttattgttgtgctcttctacttttgtgctcccacagctctggatatcttccatcaatagaatcctcacactatactgcacttgcctgttcagtatgtctctttcattactgtaattcttatgaaggcaatacattgttctacttgattcccattacatacccattgtgtgtcgttttgaaatacagtaggtatactaaatatttgttaagtgaacatattttaccataaaacatacaaccatgaaatattatcctagttgaagaaacacttcaagtaattgaccagattaatgattgagactgaggcagtgttccatgggcaatttatgaagtaagagtttagttgttaaaatataccaaatgtaaaaataataacgcatagatttttaaagaaagttaaagcaaaacgtaaggaaatctttgaaatatattattttgaacattattatgaatgcataaaaagtgttatctacaaagatactcattgcaatatttttaaatagcaaaaactttattcaatacccatactatacaataagaatacaatcattagaaacagtattttaggagccaaaaatgatatatacatcaatgtaatcaatatgcaatacttttattttttcaggtggggtcttgctctgttgcccaggctggagtgcagtggcacagtctcagctcactgcaacctctggctcctgggctcaagtgattatcctgcctcaacctcccgagtagctgggactacaggtacatgccaccaagcctggctaatttttttttttttttttgtattttagtagaggtggggtttcaccgtgttagccaggatggtctcgatctcctgacctcgtgatccgcctgcctcagcctcccaaagtgctgggattacaggcgtgagccaccacgcccggccgaatttccttgttatctattagacaccattaagggcaactactctttattatttacattttgtatctgtgtttagaaaaataccaggaatatgttctatgctgtactgttaattgaaaaaaaataggtaaatgaaaatatttctaaacagaacctattaagagatatttgtgagataagtgtgtgtgtgtgtgtgtgtgtgtgtgtgtaacatatgcacagagagggaaataagtcaaaaagagcaagacaataccaatggtattctctgggaaaattttagtttttgttttcactcagaaataccttcttaaatttttgcactaaaatgttaatgataagaataaaaaaaaacagaactagaaataatgtgaaaactattgaaaataatacaagtttctataaagtgagatgctttgacatgtgacaattcattattagaatggcaaaaagaagtgcaagactaagaaattagaaaaaatacttcaaaaagctgtcagggagtcctcccagatattccaaaatattatcctctccttattgcaagaaaacgctctccttctgtcattatttgctgtgagagtagctacccaaaaagctattttgtagcaaaaccagttttattgttatcattgaaaagaatttttgcctcacatgtctgacccaaattccagtgtgattctaattcacaggtttgtcgttaggatcaagggagatactacttgtgagagaaattgtaaatgtataaatgtataaatcaaatgcagttatactccagttttatgagaccatcagtgttgggaaaaaccaagactagaaaccagaaaatgaatttatttagcagagaaaaatcagtctaggaatttttacttgacaatttctttttctcaaatggcagattagagtgtgtgtgtgtgtgtgtatctgtgtgtgacagagagtatatgcattagtttttaaagcaatgaacagaggtctatgtatttcatttctgctatgcaggaaaaactgtgctgaattgaaacctgaaagagagtggttaacattttcagaatcaactccatttccagaacagtctctgcttttacaatgttttactgtaagaactatgaggtaagaacaaagattgaagtaaaagaaaattattctagggttaaatgggatattgacaaattagattttgggagatatgagaagttaaaggggaagaactttcgcataccgggaagctctgggcctccttgcaagtgtgcaggttatatggcctgtctgccactgagcctgctgaactctctattttgtgttggacggtaagagctgatgtgtcctgtgtttgcttttccaatttatcaatctcaacaatggctcatattattcccttgggttgacagttcaatagagaaagagcatagtatggtagacacagtgtgagttttcgttcagagaaatattgtctatttaacagaggagaaacagtagcaacttgcttatcccctctgagtctcagttttctttctataaattgtaaacaacaacgtctatagtgcaaggatgttgtgaggctaaagatattttaagtacaattgttggcacatattaagtgcataataaatgtcatcatagttactaatgactgattctggcatggatgtctgtttgcatgtgtatgtatgtgtgcaatgtgtatttatacattattaaagaaactatgcattacttcacttctcaagcacgggtttcattcagtctatttgcttttgactgctctatattgactgttctggtcactgttttgtttatgatacaaagaagatacttcaggcagaattatctttctgaaatgcagttctgttcctgccactcttctccatataactcatgtcccagccaacttctcaggtgtcagctctcagcaaagtctcgctctcttccaccatgtgcacatacaaacaaacacacacacacacacacacattgctataatgcacaatgttctctgcgttttctttaagctaactcacaccctgtccccatttcctgggatacccagtctctgccacttttctgaaaatctcctatacatctttcaggtttcctcactgaaacgtttttatgacttcctggactctctaatgtgcccatatagctctctgaacttccaactgttactcagtagcattgtatagattgtaatccctgttaattggtatgtctcatacactagcctgaaggctgcacaagagtggggtttttctccctctttcactgtctcattgctggtaaattgtagagtaaatggtattggtatgcattcaatgagtattggttgaatgttctgatgcaaaattcataccccaaaacgtaaagaaaaatttctaccattaacttctcagtaccgcctactacctcttgtaaattccatagtaagttaaaaaggtgaatgcagaaagagagcttttttttttaatccccaggaatgctaatgtggaaagtcacagggtttttgatgatgtcagtatttttatttttctctcaatatgtatgtatagaggaaatcaaacaatgggtatccattttaaaaataaatcagaacaatttattttcagccttgggcaatcatttccatttcttaaatgagaaaaaaagagaaaataaaacaggaacagatgtctatttccatccattatcccataattgtttttatctgtaaaacatcttctaaaaggaatatagagaagacagtaagaaaaataaaaatttaatagttattatatttgagcgtttggataatggaggattttcccctctcttttctaaactttctataatgttaaactatctttaatgcaatgaataaaatgaatagagagtgaagaaagcaatcatgtttctgaattaccttcatttatccttctgcaaagatagtgaaataaaaaccctgatgttctagatcaaatttattgcagcctattacagtaccttgcaatttgtaagactcgtgtttattgtttgcggattgagggttttgaggaaagagaaaggatcaagacacaattatcaacattccactttttaaaaattcatgcattcattgtagtgtatacacatctacacacacttatatgcatacacacacatctatgccagtagattaaaatcccataccatagaattgggcaggtaataggctctcagaataagacctggagaatgactaatttgtttctttaaatttcaacagcctactttatcatgtttttttctttcttaagtcagtatcttcaaagaagcaaaagaaggtacacgaagcagaaatgtaagccaaatatatacactctgatggcctgttaaagtcacataggctgacctcttctaaactataaaaccacatgagcctccaccttcatttgtttcctctgtccttgccataggcactaccacagtgctccatggggcgctgtggccagtcgctatcagaaaagcacatctccttggtatccacaatatcaacattgcctatgttggatacttaattctaatatccatgctgctgaatcatgtaatttatggtgaaaaaaatcaaaatgtcatttaatggagaaagaaaaattgtgaaagaatcacacaattgagtgctttatgatgctaaagatatttcaagcagtcattttcatatgacttttgtaatgtagcaactcgtcttacaatgttttaagagaagtattttacctaaatgtgcatgtcttctgaccattgcatggagaataagcttctgtaaacaccactgaaagaacatattatgttttatgttaacacgttatatttcatgtcagtcttttggttcataaatggtgtagataaaattactgttcaaagaatggttatcaacctgctgttctcctttcattaaaattaggttcatattctggtcatttcttagcagttttattcaatgttaagtccataggttagctaaaatgctgtttcttcccagtggaagagttgggaaagcacaataccagtcatgtggtgccttctacatcaacagtatcaaaactgttccacctaagatggaaatgctgcatatcttaaagaaaattagttaagaattcaaaagcttttcattgacctcatgagccctccaaaaataatacagagatacctgacattttgtagtgttcttctagagagaatgctaaagtgtttttgcttaacatttgtgtgctccctaaggtaagtaaagtgaatgttattattcttatcacatgttgtataaagaaaaacaagaccagagagactaaaggataaacgtttatttaacaatttagtaatataatcaggtctaacatgagagcccagcactgctcaatagaactttctgcagtgatagaaatggtctataaatctaagctgtttgataccagtggctattgagtacttgaaatgtggctggtgcaacagagaaactgcatttttaatttatttaattttaattaattttaatttaagaaaccacatgtggctagtagccactgtagtagacagcacagctctagtcatttcccctgtgttctgtcctgtaatcacctggctgattttgttaccattgttggcatgataaagtaggctgcttgctgttaattgttctaaccttaaagcctggtggtaggcatggtacattgtggaacaggtgctcggatgggtgaatgtagaaaggcttcaatggcaagggctaaggattaaaatttaaaagactgaatgtaaaagacttttagatttatctttccaaaataataaaatacatggggatactttcccatttactaagttcctgaaaaatgatatggacaatttctataatgatttatggcctgtccaacgctttcacgtgttttttttcccccattggcattaatagtggtaacacaaagccaacaagcaagtaattttgtgttgtttgtatacacacacaatcaaaagcaaagataaggtgagtaacttgttcagttacagaaccagaaggagtttactgttatcattcttcaagaataaaaagagctgggacaattcttttcaatctactacataaaatatttcaaacagttcagcttatgttttagagtcatacattaatcactaatgtgtataaacaatgacactaaaagatcttatggtgattattcaggttcaatggtaacagttaatgatgattacgtatgccttactataacctcttgaaaattggtaaattttgcaaaccatgtatgttaactcttgatgaaggcacagataataaaactcatgtaattataaaattaacaaaaaatgtacatttccacagcatacagaaaataatttgccatatttatttctccactctcaacttcttcgttagcttaaaatgctttttttctatctaatttcttcacatttcatctacactctgatcataccttgttccgtccttgtcccaaatgtatcctgaactttcttgcttcttttccattgtgtgtggagttctgttcattcagagtgcccttcccacttgtccacctactaaaccttaacatttttcagcatctagatcaaatgcctcccactacagaaagtcttttctctcatcagaattcatcactccttgttcagtattttcttagcaattctgatcttgatctcacactttgcacaatagatatttatctgaaagccttgttattagttagtagtctgaatgtaccatgagttgaagaccatttgaatctctttaaagttcctataagataggttcttaaataatgctggttacaaattatttttttaaaaattcaattgtgaaacagcatttgtattttgtcttgctaacgtcagatcagcttcacaaaacagcatcagaaactcaaacctctattcaggcattcctgatactattcacaagtgagaatctgaaagtgcaaagcttagagtagcagattggcacagaatcccctcagcttgaaaattttgtcggaataaataatcacctaacactctgccttcacactctttgcacgtaaaagctaaagtgttcagaatgcaaatcccttaacaaaattccaaagtagagcagtcagagaataacattaaaatcttagtgatagacgatatttatcatggtacactgattctaattaagtgaattattttgttgcaagtattttattcacttattcaagaaatatttattaagcatacatcatacgctaggcactctgctaggctagagattgaatacaaatattacattgttcctattctcaagaattcatagtctcctaggaaaggcacagtatgtagtatattaaaaagaaaaactgggcgggcgcggtggctcacgcctgtaaacccagcactttcggcggccgaggcgggcagatcacgaggtcaggaaatcgagaccatcctggctaacacggtgaaaccccgtctctactaaaaatacaaaaaattagccgggcgcggtggcgggggcctgtagtcccagctcctcgagaggctgaggcaggagaaaggcgtgaacccggaaggcggaacttgcagtgagccgagattgcgccactgcagtccggcctgggcgaaagaatgagactccgtcaaaagaaaaaaagaaaaagaaaagcgtcggtacaataacttctattttgttctcagcttgatcaactaatctgagcctatttcttcatctgtaaaatggagacactaaaattacataccttactgggttattgtgagaacttaggaaggtaatgtatgcaaatacatgaagtatttagtccattgtttgtaatttaataaattctcagtaattatcagtaataataattgcagttcaaggtgaaaagtgctatgaacaaggaaaatagaatatactatgcaaatgtgaaaggatgggacctcattctgtcaacgtaagttggagaagccttctcagaggaggattgttgaaagacttgaacgatgagtaggaattttccaggtgacatcactaagaaaggaatggatgcttccgatgaaaaaacacatcctcagaagaatatattcaagagaattgtaagcagcacagtatggctaaagcagaaggcggatggagaagagactaaagaacatgacaaagagatctcataaacattcagaagaggaggactgtggatgtatttccattttaccaaaagcaatgtgggatgaaatacactttagagtgctgaagcattaagtgagaaaacaagctgtaagtttatctcaacagttccaggacatagatgacaagatcttgaacttagttctaaacaacggggatgaagataagaaaaaaatgaggttgtcttgaaatggtgtaatgattggtaatggagattgagacatcactataaaatcacagaagaaagtatgttcctgttttttcaccaacttactataatgaaaatggacatataaatatatttcatttattgctggaaaactaacaggatcatatcagaaagaatgaagataatttctctctattacattgaagaatattgcaggattagttcatgctttaaaatgatcttcccccatagagacaatattttttatttttactttaaataatcttaatatttcattcattttaaaatgtaaatagagtttacaaaaaaagtatccaaatttatcccacaaaagcagaaagggaagattagaaatctctaactgtgcatagtgttctaatttttaaattctaattgtgttttatcctatctcaaattgtagaatctttttaagaactatttttaattttagaaacttatattttttatactaccaaagattgaagttgacaaggtatagaatttttcaacacctaaaattatcaaaataattaacttccaggacaacactttaactcaactacttccccaacctatgccctccagccaccagaaagaagccttcaggagtccctacagcacccacacaggtcctctccagttttccccctcccttcctgatgctgtgaaaaccacagaataaatgtttatcactttcaaaaatattttatatatatatatataatgtatatgaatttttctttttactgcacataatatagtatcctgttcacctctcagataaataaatcataattatcattttctgcttttaaataccctgaaaatataatataaaaattacataaaatcaattttttgaaacataaaaaaattaaaagaattacaaaaacaacttgttcaataaattttgtcttataaaatatctgccaaagaaaatattctaaagagaataaaaatgattgttcctctaaggcttaggcttaaatattcacacatttcaatataaaatataactaaagacatctttcatttagcataaattgttctgatacctattagataaatcagtatttgcagtgaaggtattttaagataaaccattatagtttacaatagcaattctcaaactttctaagtttcataacacctttgcactcctaagaagtactgaatgctccaaatgacttttgtttatgtgggcaatatccactggtatttactatattaaaaactaaaacacaaatttaaatattcattgatcttaaataacctattacatgttaacgcaaatatttttattgaaaattgtatatttccatagaaaatatagaaatatttttagtgtgaagggtggcatttttagtgtgaagggtggcattttttcttactttatttttaaaaagtttgcaaagtgtcagacttcatagaagatagttggatttttatagctatcgcatttaaaatgctgtgataccatgtgtcagaaagcctacagaaaattcgatcatatattcataagagaatgagaaatagagatatatggcattttaatactatataaaaatagttttgacctcacaggacctgtgaaaggattctgaatctccaggtgtctttggatcacatattagtaatttctgctcttcaggaaaatgtcaattggaagtgtaaacaatttaaattttagtaactgaaaatacaaatgttaagatgattgtagcaaatttatagaaaaaataaaaactgtgatgtcatgttgaaataaatatattcataaaaataccagtggctccatcagagacagatatgtctaagaaattaatattatgcaaattttaactaataatccagattttgtcatttttaatgttcagatgctgaacataaaatataaacatattataattaattttatatacattaatatacgtaaagtttctaaataactttatttttatctgcattttagattttaaaatgtcaaattctaaagtaaacatagttctacaggtataaattgataaaaatatactaatcatctgacagttatagctctttttaaagcagttttgagatactctatttcaagaacaaataagagactactaacacccttccttccctgctccacataacagtttcacctcttatttgagagaatgttcagatattgaccttagttgagtcagccagagacacagagctctgggttagaaccactgcctagccaggaagagggaaatgtgataagaggtcagtgtattgctaaaaatcacactcctatctatgtttagatgagatggaataaatcatgaaggcaaacaaagtcttcttgacagaagaaagtatatatacagctagactttggaaagattttcttttcttgttttccatagaacattttaaactcagtttaacatatggtgtttagcaaagtcatcgctgataagatgacatttgagtagacatctggatgaagggaggaagcaagccatgcagactccgggtaaagcatgttctcagcggaggaaactgcacttggaaaggatctgaggcagacttgtgcttagaatgtttgagaaagagcaaggagaccatttggccagagtaagatggatgaatggggcaagtgaaaggcatgcagtcagagaagtagtagggaactgattatgtaggtctatttatatttagaatgaatgaatttgggaatgactggaaggctgtaaaaagaacagagacattatccaataattaacacatattacaattactgtgtgtcaggctctattctaagtactttatataagcttgtgtcatcctcacaaaaaaaaaactatgaagtaggcacataaaggatattgctaaatattaaaagggctttgtgaaattcttcagattgactttctaaaccacctttgggcaaagacaaatatttcctaggaaggaacatccattgctaactaaagttgagtgagtgctggttaatgcttggtgcaacagacctaatatctgatttaaaagaatcacattagatagtcttaagaatagatagtagtagggcaagtgtggaagcaggaagatgagttgggaagcttacaatacccagaaattttaggaaacttggaaaaatgtgtgagatgaacatgtttgagctgatttatcctagattccccatcactgctggtgacctagtagagttagttgcagttgacagaaatggaagtaaaggagaccactaaaataacatcacagatctgaaaccaaatgaccgtaagatattttccttagtataaacagtaagccaaaaatgaattcaggtgaagtcaaccattatttctgattacattatatataaaaaatattctagatgaagcggtttttaacagatattagcactcccatgatattgataagaaaacaagttcagaaagaagcatgtatactgaagaacacatagctaataactggtagagtctggatttcaatccaatggtgttcaactttggggcctaaaataactgctagattatatcactggctctttaatttatagttgctaggggtactgtgaatctctaggtgagaaattcttcaagaatagcctaaataattcaaggaggtttaactggatccaagtggggtaaaaggagaacaccaaaagtaggcaccatatatgaactcactgttttagaatattgttcttagcatctagacaggtgggtaaacaaatgggtgcaatgtacaagcagctcagctgttcccagtgatttgtgttttgtcaaaataactcagccaagttgtcctcagtaaaaatgttacagcattttttttttttttgcttgttttaaaaacactggcgaacccaaagagacacagcagccaagaattgaggctgccatttgcaactgtgccagggtcaaagtcactgtctgtccttgggccattcattcaaatgttttgagacctcatttgtctcacagataaatggaactcttgctacttatccatttttcctttgagatccttcagataatttgcaatttaatgagaagtatgggcaagatattatcaccttctctctgctaattaaattcttcctttctttacttcccaaacttcaacataacattccaagacttacttgactattcatgatcctcttctttttcaattttatcataaatttgtcatctggcattgagcattcccttcattttaatggtgataatccttttatgcatgtggcctgtctacccagagttactaggagatcctagaaggcagaaccaagattacatatatatttccatgtacacccggtgatcagtgaaatgctgtgcaggaaattagaactggctgagaattcgatgatggtaatgatgactgtaatagcagttactgtttatggagcacatactttgtgccagtcacattatataatgtcttattttatccccacaaaaacttgcaaggcatttattataatatgaatttagaatcaaggaaactgagatgcatagataaactgagatgcataagtagtgcataaaaatcagaaagtcagtggcagaggtatgataaaaatccacactgttctaactctcaaatcagtgcagaatggcagaagtgtcatttcagttatatatgtatgtaggatccattcgccatgcactcaccaatacacttatgcatcagtttatccatcagtttaataatttagccatccacccacctttcctccaaatatccactcttccatccacacactcatttgttcttatattcacgtagccattcttcaattcttccattcacttaccttgtcttccattccaccactctcttcatgcattcaactaaccattcactcatacactaaataattcattcatatatctactcatccaattattttctaactcatccatttattccctaacatatctgtatattgaaaccattaccaatctgttgatttattcatttagtcactgattcattcatttattaatttaataattcctgacatctatccattaattctatcacctattcaactgtttattaaaatatatgcatttattaccattattaagtatcttctttgtagcaaacccttactagatacaaggaacactaaaatgagtaagacgtactctaacctacagtatcttacagtctgattcaaataatctagaaaaaaataatgtgaggcaaaggagaaaatatctttgttgtgtggagagaagcagttcaataaaaacttaccatcccagcacggtagttcacgcctgaaatcccagcactttgggaggccaaggctggcagatcacgaggtcaagagatagacaccatcctggccaacatggtgaaacctcgtctctactaaaaatacaaaaattagccaggcatggcggcacacgcctgtagtcccaactactcaggaggctgaggcaggagaattgtttgaacccaggaggcagaggttgcagtgagctgagatcatgccactgcacactccagcctggtgacagaacaaggctctgtctcaaaacaaacaaaaaacaaacaaacaaaaaaaacttaccaaaggaggtgatatacaaatgcaggcttaaaagaaacagagaggtttacaagttggaaaacaaaggaaacatttcagacaatgggaaatggtaaagcagatgcaaatttacattaaataacaggatatatgtggcatactgttggtcattccccaatatttattatgcctttctaatagtaataaaattacgaattaaaagctaggcaaaatagttgcccagaatcaaatttactttttcagcctcactaaccatacagttagttaggtattgccatttatgttagttttgatcactgaatgtgagcagaagtagtgtttgcaacatctgtgttatgtttcaaaaggagaagaagtaataaacttgccatcccttttatcttccttctggctgaaatacagttatgctatttagccatgttggaccatgtagataaagcaacctggtagaggtggcagaattataggatggaaaaattctagaccccatgacattgtgccggtcaacctcttctagctttggcttttactttttttatcttgtttaaaccacttgtaatttcttaatttggatgttttatggtatgtgaccctttattctatacaatggactgtttcacgaaacgaatataaaatacgtggcattctctttgagacagtaagagaggctgtgaagatacagatatcacatcttggaaagctgaaaactctcagtacattatggccaatatttggtaaaacttgtcctaatacttggaaagaaaactccttcctgtgagagtctatgctcaagaggaaaggtttagaaatattcttattcttattttatgttttagtaaaggcccacaagagatgaaggacactaggatggagatttagtttacacagattggagactctacagatcagtgcagggacacactctttatgtgcaatttgtaatctaggttgactgaaaattttataatttggggccttatatattcaaaaagtgaattgattttgtaacttaggttgaaaaataatagtaggcagccctgaaaaagtactttacctggagaatagaatatggcaccaagtgtttttaattaaaaattgttagtgagacattggagccaccacaatagcaaaaatcgaattaaggatgttaccttcccatccaaacatattattttagatgactcaaaagatagccttcattttatttttctgagagtaacagtagaataggcagggcacagagggttttttttttaaagactagactctccagacttaaaactattttaaattctatattttgctcagtagttttgagaactagaacatgcacatttttaaaaagccaggcaaacagcaagttcacaaattttattgagcccatctgagtgctgtggtcacaggacagccaactgtccaccaataaacaaatagacagacacctgcagggagaagtgaaacatagtaattttccaaaattattgactgacaacaaagcatgtatccaagaagttgagaacaaaaagcacaatacatatcaaaagtgctgtaacttggcacatcatattcaagctactgagaaccaaagacagagagaagttcttcaagatagccaaagaatgaggtcaaattatacacagtgaaataagaataggaattatatccattctcagcaatagacttggcctacttttgtatattaaaaaagaattatatcgaattatttaagacttctcagaaactgtgcaaattgaaagataatagaatgacatctttaaagtgctgaaagaaaaactgtgaaaattgcattaaaaagttgctaagttaactcaagtggtcagaaaaagaacaataaaacaacatattgaacaaatacaatatacctagcagatctgtatattataatccaactacatcaataatagcattttctataggtgttataaacacaccaattacaaaattgttagactgaataaaaatctaaggcatatagttatattctatctacaagaaacgtacttgttttattcagttcaggctgcttttacaaataccttagacagggtggcttataaactttagaaatttatttttcacagttctggaggctggaagtataagatcagtttgccagtgtgttgatttctggtgagaggcctcttgcaaggttgcagacttcccattctatcctcacatggaggaaagagggctagctcactctctggccttttcttctaagggcactaattccattcatgaattaggtcatgaactccatgctcatgacctaatttccttctaaaaaccctacctccaaataccattacattgagattaggatttcaacatattaatttgggttgacataaacattcagtccattgtactacattaaatatatagccttatgtatgataaaagtaaaaggatggaaagagatttgacaaacacacaaaccaaacaaaggaaagctggagtagcaatattaataacagacaaggtagaattcagaaccaggtatatatcatcaggagtaaaaaggtacacaatcaggtcatttctctaagaaggtatttttaaaatcttaatttggtatgtagccagcaacatatgtaaatacataaaatctgttggtacataaaggagacatatacaaacacacaattgtagtggatttggaggcatcaacactcctcagtaattcacagaacaaggagacaaaaagtgaggaagcttacagaagtcttcaaaaatattagctactacttgatctaagtgacattttatgcaatagtttactgaagaacagcagaatatgcattgttccctcaagcatacatgaaactttcatcatgacagaacacagaataggaaattcaacagactttaaatttacgaaagtaaaaatcatacaaagtatattagaccgtaacataatttaaatagaaagaaataatagaaatatatctgggaaacctttaagtacttggaaattaaacaacacatttctaagtaacacagaggtcaaagaagtctcaaggtaaaaatattgaactgaatgaaaatggaaataagacatcaaaatttgtaagacacagctaaataaatatttagagagaatgctatagcattaaatgcttatgaaagaataaagaccttaaatcaatactcaagttctagcttaacaaattagagaatgaagagacaaactcaaagcaagcaaatcgaaaaactaggagcataaatcaatgaaattaaaaacagaaaagcagtttaaaaaaaagctgtgtttttggaaaaaataaaactctagtcatactggcaaccaaaaatgagaaaagacataaataccaatatcaggaattgaataagggacatcattacataccttcacagacacaaaaataacaagggaaaattgtgagcaactctatatccacaaatttgacaagtcagatggacattttagtgtggttatactgttcctactctactgttgcgttttgggtatgttataggccactggatcatgaagaaccatagatagacctaataaaggtgagtactcataacctcaagttcatggacttcaatggactttcatgaatgagactttgaagtctcccccctgggtatgagatgaatacgttctctatgtggaaggaagtgtacacaaatgattggctgaccaaggcgcatactatggcagataattctggttttcctttaatatcaagtgttttctcctctcatggaataaacatgaagcataatctttagcagtgtgtatggccctccggaataaagactgcattttccaccatctttcaaagctagctgtggccatgcagctaggccaagagaaatgcaaaatgtatgtgtggaattcaatgtcatacaccctatcgggcatagtacatctaataaaatttgagaccaatctaagtgtttcaatcagatgatattttatagaagacatttttacacagtgacagacaatccaagaagccaagcataatgaattccttaatagccacaatttaccaaactcactaaagaagatatatgtgtgtgtgtgtgtgtgtatatatgtgtgtgtatgtatatatatatatacacatatatatatatatatatatatatatataaaatcttctgaagagtatttcatctattaaagattaaaaacaaaatgatgcccctaccacttatagggatagagggatatctcagtccattgtatgttgctgtaacagaaaaccacggataaattataatgaacagaaatttatttcttatactttggcacctgggaagtctgaagctatggggcctacatctagcaagtcgttcttgccatgtaatcctacagctgaaattcaagagtgcatgcatgagagagcaagcaataaaggggctcagctaattctttataaggacactactcctgcaataacggcattaatccattcatgagggcaaagtcctagtgttctaataatcttttaaaggtcctacctatcaacactctttagggattaaatttcaacatgagtttcagagggcatattcaagtcatagcaacagataatatgatgagtccaaaagctaaagctccctgctgatggatgcatgttgagaattgagtgatgagagtatgggccatttgtctgaggctagaggcacagagaaaaggcagcttctatggaagatgcacccaagacagaccaagaggaaggaaatacctaacctaccaaggtcatccattggatgatacaacagaaaaggaaaaagtgaagactacacctaagagcaaaaatagagtgaccatcaaatttacaggtgagtcatgtttaggccttccccttcctttgaattcgaatttggatgtgatgtctattgatagtggagcaacagaattgagagatttaggactgctaaaaatttaatgaagaattttatgtgaaaaagcccaattcaggcttatacaaaaagaaatacatgtcatattaaaatcattgttaattttgaatgtccaatacagtagtcaatctgtatcttaattaaaattaatacagtatgttacaattagatctggtcagctggaagaatatgaaagatggagttacaaaagagagaaggcttaaacaggcaggaatatattgtataatttcatttacgtgaaatgtacagaataggcaaatctagagagacagaaagtagaatagtggtttccaggaactaggggtagttactgctaaagggttcaaggactgagcatggtggttcatgcttgtaatcccgactgtttgggaggccaacttaggaggattacttgaagctggaagcttgagaccagcctgggaaacaaagagagacttcatctctaccaaaaataaaaataaaaaacttagctgggtgtggtgacttgcacctgtagtcccagctacttaggaagatcgcttgaggccaggagtttggggctgcagtgaaccataaatgtaccactgtactgcagcctgggagacagagtaagtccctgtctctaaaaaataaaaaataacacaaagtgttcaagatttttttagggtgataacaatgttctaatattagacagtataagtaatttcaaactttgaaaataccctaaaaagccactgaattgtatacttaaaaaataaaaaccaaactaaaaaataagtatgtaagagtcagataatcaaagggtttagatgatatgacaagaaatctttaattatttctcttggctgtggatagccaggatcgggttttttagatgtagtaacaataagattagattttttaaaagaaaacttcagcatcagtgtggaaggtgtattatagacagcaaaggacaatcctgaaagtacgacaattatttagcatagacaggaggaaataagggcctgaacaagagcaatagcaatgaatacagaatggaagtaatgaacaacaggtgaggagaaaactaagtggataatataagaatgcatttcagtcatttaacttttgttcccatcaattgtgcattctaagagatgacctaaaacacctatgctttaaaaaattttcatattttttctgtcactgattatatatatatgtatatatttacttgctggaaaaataagatgcaagtatccaagcatgtgagaaacactacccaatgcttggggacagtatttttataccccaaactaaaccttctgcaggtagttttaggtaccaaattaccctctaaattaagatctaactgcttcttgcggaatgcatcaaatctaatttccccatcaaaagaacatctttatgtcagtgatttctttactgaaaccaatcagtgatctcttggaactcctattaagaaaatgctcctgggtactaacaaaatagagtatagcaaatgagctgaaattacttttaactttatcaaatatgtgatataaaggtgttaatgtttattaacatggcttcatgttaatagctccatcaaggatcagatgtttatagcagtaagaattctgtatgattattttacatcttttgctttagacatgagaccatcattaacagggaagaaataaactgatgtcaaaaagaaagaatatgtatatactttgcattttccattaaaatgctaaatttcgtgcacagaaagaaattcagcatgacatatatagctttatatttccatgactgtcttcatacattttgagttatagtcatatcaagaaacttgacttcccttaaacacaatatccactgcctcatttgccgtacttttatacatgatgttatctctaatgggaacataatcttatttcctgcttctttaattaatacttattttttccaatactcaagtaggtattacctcctgtgggaaacgtttcttgattttcttccgtatctaacatgtattaagtgaccttattcagtgtacatataatatactatgcataactattcaacaggtataatattataaagataatattagtttaagatgttgtgtgtgtttgtgtaacttgaataagcttctgtaacaaatagatcataggaggtatagtggcttcaagataaatggatgcttttttctcacctacctaatagttcaacgtgggtggctctgcttcacatagcataacttacgaagctctgcttcttccatcctatggcccctgcttcccctagattttcactgaaatctgcatccatcaggcaagagtgaagaggtagtgaaggagatatagcttcttcttaaacgtctttgtctggaaatggcacatatcacttctacttgcattccagtggttaaaacatcatcatttggcctcaagtagctaaaaaggaagctgaaatggagccttactctgtacataggaagaagaaacattgatttatcttggacagctagcagcaacattaaactgaaagtaattaaactactacattagtcaagctttgggtaggcatgcccagtggggacagagaacagcatgtcagggcccactttgggccaacgcattggtatgatgagtgtcacatatctggaatcaacagttctaactgataaatttgtcttcctttttctctttccctttttgaaagttcagctttcaggtgttgtacacaatatgtaggcagtgggaagtgggcagtgggcagtggtatgtaggggcccagctatgagccagcatattaatacagggaaatgaaattttggggttgtgctttctaaatgtccttttcttcacccttctttctgccctcttttaccttcttcctttccctacttctccccttcctttgtgtgagcttttagccagtacacccaatatggatgtgagtcaaggacactgctttctgctgtcatggtgaggagtttgttaacaacggcaggactgaataaattaggaaattcatttagggtagtggaaaacatatttctcattgttgaaaatgggacttatgaatatggaaaggagatagttttggaatgcaagtagaagcaccagtgtgcacaatgatcaaatatgatagagctccagttaaaattaaaatataaaaacatatagatatacacatatgtgcatattatttgtatacatagatttgcttttttaaatttaactgtttttaacttttattttaggttcaccggcacatgtgcgggtttgacatataggtaaattgtgtgctgtgggagtttggtgtacagattatttcatcgctcagatgatgagcatagaagctaatagttttttgatcttcaccctcctcccactctccactctcaagtaggccccagtgacttttttccccttctttgcatccatatgtacttaatatttagcccccacttataagtgagaacatgtggcatttagttttctattcctgtgttagtccacttaggataatggcatccagttccacccatgttgctgtgaagggcacgatcattttatattttatggttgcatagtattccatggtgcatatgtaccactttttttaaaatccagtttattgttaatgggcatttaggttgattccatatctttttcactgtgaatagtgcataaatagattttttttatctgactctctttagaggacatacatgtaattacaccgcagttatgaggagcacatatagtgtcctattatttgtttctagatactagggagccagagcttcctggggaagagtacctgactccagggctgaggcagggaaaatacaagatgatctggtaacatcctgttgtgccagaggtactctaggggcatgtgcaaaagacataagaaccagttgaaggagcttccactagtcaagtctgggacaaattcaaataagtgataattgacacggcaggagcatcgccatcttggacaagcactgccatcttaaagttccccttgatcaaaaactgcctaaatccaaagggcatcagcctaatggctaaggttagcatgaccataaaccataaatgacatctccgaccagaaacattcgaaccgtaatataaacctctccccaaccagagacatgccagccctgagataacctcccttccaaccagagacattccaaccctgacataaaacttctcccccacacagaaacatttcaagtctgtaataagttccctcaccctaaaaccaatacatactcttagtctataagagagagcactcctgactgaaattggccagaagcccctctcaggtttattctccaaaataaacctgtctttgactgttgagccactttttgtgtttcttttctctttaactcttaacaataataatgaccagttataatattttgagtaaaataagaatttatgagattttactaacataaatggatacatatataaattgggggtggtgctggaattggaagggaattcttccaggccaactaattaatctacaaagaattatggaattaggagattaccacttgataatcatcagtgaaaactcattcaggcagaattcatcaatgaatgccaaatctggtgtgtaaaagactgatgaaaaatggagtattcacatagtctcaaagtaactttccatcaatgcataatgattatttattgataacatacttattaactttctagtgtagaaatctcacaggcaccattaattaaataataaatgttaccatcatcaataatgaaacaaaatcagcatgtataccttctgatatacacactgcaaagagctcagcatcacttctgtggtattcttgccagaaacatacaaatcttaaatataacaaacattacaaatggagtcacattctacacagtaactaggctaatttttaaaaatgttaggaccattaaagacaaagaaaaaataaggaactattccagattgaaaggtattaaagagatatgacaatgaataaaaccactgattatggattggctagtgggcctaaaaagggtatatctgggataattaggaaaatgtaagtggggtctgtggaccagaaaataatattgcatcaatacttatttcctgattttgatggaaacattgtggctatgtggcaaaatgttcttgtgcataggaaatatatattgtagaattaagaggtatggtaggaagaataatagcccctaaaggtatcaggttctgaaacctacacctgtttaagtgttgtcatataacaaataaggttctttgcagatgtgagtaagttaatgattttgagactgggagattatcttggattgttcaggtgggccctaaaataccaccacaagtgctcttatcagagagaggcaaggcgatacttaatccagacagaagaggaaaagaaagtgttaagatggaggcagaaattgggttaatatggaggcaagccaagaaacattgataaccaacattagttgaaagaagcaaggaacagatctctctctggaggagacccccatcctgccaataccctgatttcaatccaatgaggctaattttggatttctggtctccagaaccatgaaagaataaatttctgttgtttaaatccaccaagtttgttgtaatttgttaatgcagccacaggaaactaatacaaggagtaatggggtatcataactgaaacttactcttaacatttttgaaacaagagaaatgttaacaaggaaatctgggtgaaagttatacaacaggtccctatattttttcaatttctatgtaaattttaaattaccgaataatgcttttaagaatttaaaaattagaagattaagtaaaggttaaaagctattgcctggataacatgaaatgggaggaagatcaacactttctagagggattcagacattcaatattctactattttatcctctcaaaatgttggcctttatcctaaagctatttatttcctagttctaaagtggctatagtatctacagatatcatatttgttttcaagatcagaaagagaatagagaaagatgataaaggttcatgccagttgaacctgtgtcttttttatcaagaaagcagatgttgttttaggtatctccagaaaatatttgtttaaatcttggtagccagaactatacccaactgtgagggaagctgtgaaggtgggcatttgccttcccagcttctggagtagatatgaaaatggagaaaaagattgaaaaacatctgttgagttggctaacaaacagtgttatctccctggcaatagagatagatagatagatagatagatagatagatagatagatagatagataatctgtatttagagagcctagcacaatgctttaaatatatgttcaataaatgcttataatattaattggtgtatgtatgaatgaatcataaatggatgaattaaagaatcttatattccaagtttatattagccatgtgaataaatgtcagctttattagagcatagtccccaatatagaatcatttcagaataccttaacaccctaggccatcatttgtgtttcagtttgtaagttttacattctatcatgattttttgtcttagattttcttttgtgtgcccaattttatggtattacattaaaaccgtatcaacttttagcatgaattgttacaaaaatctcttatctctcatctctttaatgtcttctctctcaccccattaaatgaggtaagtaagtaggaacatactagaaagaaaaataggaaagacaaaacttggtaaataattaggtgtaagaagtgattcataagaagtagtcaatcaatattctgaagaccttgtcttagataattgcagtggatgggaatatcaaacacagaaagataattgagaagacttatcatgtaaaactgatgagtgctgttttagacataaggagtctgatgtgtcaatgggacatacttgtgcagataaatatgtatttgagaattagacgtttaggacttaaattaagagaagttagaacaagagatataagtttggtattcttctgcaggtaggtgctagttaaagcttgtgaatagataaaatttctcaaatatatcatataaagtataaagaaagaggactatgaataaaatcttgacgtttcacaaaccgtgatggcagccaattccagcactgggagaaacaatctggtatagaggaagggagtgagaagacatcatttctttttctgatacaaattcaatatgcaatttacattaatgcttctcaaactgtagtgtgaacaaaaattatcttgaagtcttgttaaaacacagattttcaggtcctatttccagatattctaattcaaggggtttgaaaggatgccagggagtttgaatttctaacaaactctcacatcatgctgatgcctcccacctaggaccacccttcattatatctcaaagctctaaattaaaccttcttactcacagtgtggcccatgggccagaaacattggcatcacctgggagcttgatggaaatgtaaaatcctaggctccaacccagatctactgactcagaaactgccttttaacattatccccagttgactcatatgggcatgaatgtttgtgaagcactgccatctaaatgtattatataacatgttgtttcatttctgttaaaatgacaatgttggtctcattttgattccaacatactatgaggtaaaaaattaggctttgaagccaaacattggtaagtcaattgtgcctccactaaccttagtttccccatgtataaaatggagatcataatagtgtcctcccttggttataacaagaatgaaataatgttatgaatataatgtgcctagcttccatttgaacagagagctatggtctcacgttggttttacactttcacatgaatattcaggttgcagctagcacatggctgcttgtgaaattgcttatttgttatgttggttccacctatttgattagttaatttgataaatttaatgatgctttaagtgaaatgattccagttaatgattattgattttaacctcaagaagaggaaaataaaattgattcctaggtaattacaacttaaaatacatagagtgtgtgcagatactgactgattaaatataatgaatatttaaaaactgatataaaattgtgaccaagttggagagaatcggattgtggttgtgacagtaattaaaacaaaaattgagacctggctggagtgtacttcggtctcgtgaatcttgcgaatctaccatttcctctcctttcttcaatgtcactttttttatttctcaaatagaactatggtagcctgaatcttatcttccaaaggttttgtttctttatccaataaatagatataatatatctaatacatggggttgttgtaagaaaatttaaaaatccaagtgctgaacacagggcttggcaaaaaaaaaaaatgaattaataattgctgttattatgtaaattttacccataatagatttgaggaggaggttgatgatgctgagtttttcaacactgtattctttaggattagtagcactctattatatacagaagcaacactcaataattgtttgctgaattgagcatccagagtaagtttttatattgtggtagttgcaattaagcagtaaatctgacacacacacaaattgttttttcagagataaaaatggaagttcttttatgctgctagtgaagacttaacttcctccaactcttttctataaatacaaaaaaaaaatacttagatatgctattttttcctgtatacttagcatattccccttaaataatactgttggaaagagaaaaaatgaataatgtcatccctagtaaactagtcaatattgagggagaaactctcagtttaattttctaatagatcatataaaactctatttctcatgtggggagatttagagtctagcaagattttattctcaaataatagattcatttgaagagattaaaacaagtctttgtcaaaatgaaggaacatttttaaatgaatttgagaaattcatcccaggtgatttaacataaaatatttttgtttctatttttattttatattatattattttattttattttatttttttgagatggagtctcgctctgtcacccaggctggactgcagtggcacgatctcagctcactgcaagctccgattcccaagttcactccattctcctgcttcagcctcctgagcagctgggaccacaggcgcccgccaccacacccagctaatttttgtatttttagtagagacggggtttcacagtgctagccaggatggtctcgatctcctgaccttgtgatccgcccacctcggcctcccaaagtgctgggattacaggcgtgagccaaagtctttaaaaaactgagttcattaacaaaaataaagttccattcggaacgcagaaatttaaatttccaaagtattatctacttgctatcagctatgaaggtcttaaatatttgaagtggtgtcatatacaagaatttgagactagctcaaaataagtgaccacagcaggtaagaagcacatttctgcaagtgaaagattaagattttaattcaagatttcatattttgttgccctggatattcaaggagaagccacttgctatagagggaaagacagatgcaacatgcatagaattacctcaaaattctgtgctgcttatgacaattgacatgaatgttatttggcatcacaatgccctggtaaatataggtagagagaacaattactttctcttgcacatcaacacacctcccttgtcaacacatacaaactcatagtaatcttgcacaaaattgttttattaccctttcattcagcatttctgcttatacatccttaagtatatcatctactttattgggtatcatatagaaaactgcgcattttcatttgtagtagatcagtttctgctccacttgaagccaaccttcctcacaattagcctgctctaaaatacaagataaataagtcctaggtatttactgtacaaatatagtgcctgtagttaatgttgtattgtacatttaaacacttgcaaagagggtagatcttatgttaattgttctgtcacaaaaagtaataataataaacaagaaagctggaagaaacttttgcaaatgatggatatatttatggcattggttgtgctgatggtttcatgggtgtatatttacctccaaactcatcaagttgtatccattaattatgtacagcaggggtgtctactcttttggcttccctgggccacactggaagaagaattgtcttggaccacacatcaaatacagtaacattaacaacagcagatgagcttaaaaaaaaaaaaaaaaaaaaaaaaaaaaaaaaaaaaaaaaaacctcataatgtcttaagaaagtttatgaatttgtgttggggagcatttaaagccatcctgggctgcagtcgcatgtggcttacaaggataagggttggacaagcttgatgtacagtattttgtatgtcaagaaattaaattttaaaaatgttgaaaatataaaatgttgatgttggagagaaaaaaaaaagcagctaatattttgagcaccttgcatgtgccagtaaccatagaaaaagctttctgttacgtcatagaatcctcccattctctattaggtatctattatctccattttgctaatgaggtaactgatgctcagagtagggaacttgtcaaagacacacattcagtgagtggaagagccgagattgaacgcaggattcctaacttcaatttgtatttctttaagattgcactctttactgtgtgagaaaagacataaatactatagagtgtatcaaaatccttcatacacctcctaccgtctttaaaacagacctagttttaagaaaaattcatttcacaaagagccataatttttcatcttcttgttcagcaatgcagtttcattcctgatgctgctattaactcttaaataatctaaacctaatgaataatgggaaagtcacaggcaggtgaaaggagaattggggccttggaattctcctgtgatgagtaattagtttatcctgagaaaaaccagtcttttaaaacaacagtagcctctcaagtcatggagggtctaactagtctcactatcatgatttcataacgccgggagggtttattgaacttttgattccaaaatgtaaacaaaatgattttttgaaacactggaaccaaatatttcctggaataagaaaatgcacatttattctctaacttacatattaatacatatatcaagtgacaaatgttctgtgagtctgacataaatttccaagtcattacgttacaggtattacaaaaatattaatcctttctaggagactatcttatttgtgtcaagactctttagagatgtctgattattgctgatctgttttgtgagtataccatgccatttgctttttttcagggcccatcttactatttgtagaaaagccttcagctttgcccaaagttgtcttttgcctcatctgtttaatattctggttctgactttctctgtgcttaggtctgatgcttctgtgaattcctgtctgtggctctcctgtgctgcagtagagagaggagtactttatactcctttctttgtggaaaaaaaaaatcacttcctaataggggcttgagccgaaatcaatgagtaactgagcagacatgtgagacagacattaacattttttttttaaacactgttgctgttgagtcacggtctttctaattcccagattcttattgaagacctcacattggcctaaccagggcaaaaagcttggaaatctaaggcattttattgcatgggctatttacccaataaaggactatacaattttaaatgttggaggtaaagaaatgtgggagattctgaagatatgatcattgggagataaatagagtcttagtgtgcggaggttggattttgcagacttctatccacagactaattcttcagtgcatatttttagaattgcctcctagttttataattgaaaaaacacagctgaaaattttggaaatattaatcagaaatacaatatctctattacctactcaattaaaatggctaaaaataagcattcaaattttggtaaatgtgttctgagtagttaacaaaaaataaattatatctaggcaatgtttgttaatgaaattaagagagtcctaagtgaatgtggtttctgaacattaagcaggagagagaactattgatgtcctcaacctaatcactacctcatgttggtgaaatatctaaaatctaagaaagagctaagaaatgcactcctaaaaagttagtttaattaaataaaagtgttcttattttttctagtagtttttccattataaaaatgatataacctggccgggtgcggtggctcacaactgtaatcccaacactttgggaggcagaggtgggtggatcaccaggtcaggagatctagaccatcctggctaacatggtgagcccccgtctctactaaaaaacacaaaaagttagtcgggcgtggtggcaggtgcctgtagtcccagctacttgggaggctgatgcaggagaatggcatgaacccgggaggcagagcttgcagtgagccgaaatctcaccactgcactccagcctgggcaacacagtgagactctgtctcaaaaaaaataaataaataaaaataaaaggatataacctgacctgtagtagttcagttaatagtatcataccaattgtttggacaaatggtgatgtaaaatatcattaaggaaaactgaggtaaggatatatagaaattatctgtactatttctacaacttttcttaaaactaaaatagtccctaatcagaaaaaaaaaatgagttttttaaaaaaatctatggttaggaactattttttgcctatattctcttctcaaagataaagatgttaatctaggcatacaaggtactctgtgatctctgcctcttcaacctcatttcatcaatgctttctttcatttggcttcatcaatatatgcacgtgtttgttctatgccatacactttgttaatattttagataggccactgcattcaaacattatatgaacctttttacccaaatattaaacatgaggaaactgaagctcagagacattaggtaatttatctagtgttacatatattcaatgaaacatcaatatgtacaagtctgtgacttccaaacctagactcaaaactgtccagattaaaataataataatgaatcagtataaagttaaatttttaaatggcaaaaatttcacatggaagcttaatctagttaattgtgatctttatgctatttacagacaaaacattggaatggattaccaaaggattgctctccaaactatgagtcaaggagagacagtcattcgttctggctgatttagacatttattagtcagaaatagtatacacaaaaaaaattatttctctaccccccaccttgccataaacaactgggttcttagtttcagattataaaattgaaatacctaattgatgtttaagtgaaaagaacacagaatcaggagtcattgaactgaagttcgtatctcagctctgccctcaaattctggttaccttctatagccctcactttcttcatctgaagaattagaataagtccttatatcacagacagctataagggttaaattagatcaggcaaataaattgcctacaggagaaattggcatctaggaggctgaattaactttgaacctgagctgtatcttaatattgatcagccatgttagttttttcttcccttttgtattcctacaatgcaagataacttgaattttctatcctcaatttattatgatgtattgctccaacatgtaaaaaaccttagggaaagcaaagtgacatttcaaaatcctgctgttggtattgggtaaccaatatttttgcaagtcaaatagattccaattttttgtttctatcaaaattgaaggaaaattcaacagatgatcagctggtcactaaaattattttctcatgttcatcatgtgatttttggaaaatagaaagaattaaaaacattcaatgtcactgcaatagaatttcttctagcctacttgttcatttatgtgaacagtatttcatagcccttacatttataatacaatctaaaaaatacaaataagtgatatataaacctttagcttacataagtctcaattctaataggaagtaataattatctatggatccatgaatcatttggaaaaagaactccacccatcttataaaaatttgtcattgccaaattattttatctgtaataattcttttaatttgtaatatagttataatgttttgatcaatttaatactaaattatttatgagaataatactgttcaggtttttaaaatacagggaaatagacacacacatatatacatgcacctgtacacacaatttatctattttttgttttatacacacacaataaatctttaaaagtatatcttaaattataattaaattttgtgaaagaaatgtaatgaaaatacaaattatagaggaatattaatttttaactgttaaaatcagtacatttgtactgatttccatcttatatagaagttggccgggtgcagtggctcatgcctttaatcccagcattttgggaggccgaagcgagtggatctcctgaggtcagaagtttgagaccagcctgaccaacatggagaaaccccgtctctactaaaagtacaaaattagctgggcatgatggcacacgcctgtaatctcagctactcaggaagctgaagctggagaattgcttgaacctgggaggcggaggttgcagtgagctgagatcacgccactgcactccagcctgggcaacgagagcgaaactccgtcacacacacaaacacaaaatttagctaatctttacaggcatgatatagcctcctttttcaatgtttctttggtcaggtattcaaattcacattttttaagtgtatgctataacaataacagacaaatctggactactgacataaatctgttggattatatcattacaattttttcttcctcatagcaattctcttactactttacattcacacacaaataaaactctattgtctccttagttgtttctcaaatttatcttaattggcacctaaagagttcatgtgcatagtaactacagttatgcaccacctattgccagaatgttttggtcaacaagaaatcatatatgcaaaggtgatcccataagattataatgaagccgaaacattcgtattgcctagtgatgtcatagttattataatgtcatagtgcacctcatcactggtgtttgtggtgatgctggtgtacaaacctcctgtgctgccagtctcacaaaagtcttttttataatatctcataaaatctaacacatacagttacatacagtacctaacactcattaatgacaataaatcactatgttactaatttatgtacttctgataatatactttatactttttatcattattttagaatatactccttctgcttgtgaaaaaagttacctgtaaaacagccccaggcaatctatcaggacgtattccagaataaggcatttttaccataggaggtaatgcccccatgcacattattgcccctaaagattttacagtgagaaaagtggaagacagtgatatttacaggtcctgattctttgtagaccgaagctaatgtgtgtgtttctatctcagtttttaacaaaaagttaaaaaataaaaacttttaaaaatattaaaaagcatatagaaaaggaatataaagaaaataattgtgcacagctcttcaatatgtttgtgtttaaagctgttattatgataataaaaaacttaaagtttataaagtaaaaaagttacagtaagtttattattgtaaaaaggtgtcttaataaatttagtatggcttaagtttactgtgtttataaagtccacagtagtacagagtaatgtcctaggtcttcacattcacttgccactcaccaactcaccagagtaacttctaatctttcaagcttcattcatggtaaatgacctatacgggtgtaccattttttatcttttatattgtatttttactgtaccttttctatgtttatatatgtaaacacttatcattttgttacaattgcctatagttttcactacagtaataggctgtacagatttgtagcgtaggagcaataggccataccacatagcacaagtgtagcgtaggctatcccatctaggtttatgtaagtacactctatgatgttcacaggatgaaactgcctaatgttgcatttttcagaaagtatttccactgttaagtgacatatgactataaatgtatattatgcagctaattagcaatatctttattatcttaactctgagaattaccttcctaaatttaaataaagattataaaattagaataaatgatattcactttaaacttgtaagacctatatatttttaatcaaaaagggttaaaagtttatgtaacattcaaacggtttattaaagctataggagaaagaaaggtatttatttgaattacagcactgctggggaaacagagagacagcacttggatgttttcattttccagggcatcatatactaaagaatcattccatctaatttcttcaaatctcaagaacacacacctggcaaatcatgaaaataaattttatgttgttatcaatgatatttttaaatgccattttaataatttgactcactttttttctaatcacagtattatgtgtatcatcaatctggtactcaattttactccattccacttaatcatttattaagtcctttgatacaggtacagtctaagaaataaatacacaagagccataaatcccactctaaaggaataaagcctgccattccactctcacacccagttctcttaatctcaccatgttttttaagatttggttgcagtatcatcatttctctggaaaaactattttcatacccacaatcctaaaggttagatgccataactcatgctcctacatatataaccaattttgtttatttatttttccccagactctggcaaattttaggtacataataaaaatcctttgaatgatttcattttagtcacaattaagagaatggaaaaaattataggtgattcttctgagtataaactaagagtcaagctattagagaagcattccctaaagcaatcaagataactaaaggcacaatttattgtctgtggatcacagttgagcttaccccatgagtcctcgtatactgatctcatgaaaactcatgtatgcttcggactatgttttaataaacaacactttctgacataaaaaaaattattaattaaaatgaagtcctaatcataccaagaacaccaaatgtttcacttttccatattaagtttaaattcagcagttttcaaacatggccaaggatgcctttggtgtccccaagacactttcagaagatttgcaatgtcagtattattatcatagcaacactaaagcattttttgtccttttctactgtatggatgcttgcagatgcaagtatgcacatcaatctatgtcaaatagggttagctaacaaaataatacaagtgaaaatcagggtaagttatcaaaacataactgctagtgtgtctaaaatgcaaaattacaatatcaatcatttatatattgctgatagtagtataaaatagtatgtccaactctggaaaacattttggcagtttcttaacaataataaataataaataaacattccaccactatacaacccaccaattgcaatcctgggcatttatcctaaaaaatgaaaaattatatttacatataaatgtgtacacaaatgattatggcaggcttattacagatatccttaaatggatgaacgtttaaatgaccatggtacatccatctcatggagtactattaggtaacaaaaaagaacaacctattgatactaatatatacaacaactaatataatctctagagagttatgctaagtgaaaaagccaaaggtcatatattgtatggttcaatttatataacattcttgaaatgacaatactatagagatggagaacagattggtggttgacaaggttcagaaaaaagagaaaatggaggaagtggtgtggctataaaaggataacatgaggtttcctagtggtgatggaacacttctctttcttaactgtattaatgtcaatatcctggtggtgattttatactataattttgcatttgtatattttctttggaaagaagtctttgggaaaaaatgtttattcaactcttttgctcatttttatttgggttacttgttttttgctactaagttgtatgggtcccttacacatttttggtattaaacccttcctagatatgtggtttgcaaatatcctcttccaagccataggttgcctttttattttgttgcttgtttcctttgctgtacagaaattttggtttaatatagtcagatgagtttatttttgcttttttttttttttttttttgcactcttggtatcatatcctcccccaaaaatcactgggaagaccaatttcaagaatctttccttctagttttcctatagaagttttatgttttcacatctcacatttaagtctttaatccacttctagttaatttttgtatgtaagacaagagtccaggcctggcatggtggctcatgcctgtaatcccatcactttgggaggctgaggtgggtggatcaagaggtcagatcaagatcatcctatcgggggaaggagccaagatggccgaataggaacagctccggtctacagctcccagcgtgagcaaggcagaagacgggtgatttctgcatttccatctgaggtaccgggttcatctcactagggagtgccagacagtgggcgcaggtcagtgggtgcgcgcaccgtgcacaagccgaagcagggtgaggcattgcctcactcgggaagtgcaaggggtcagggatttccctttcctagtcaaagaaaggggtgacccacggcacctggaaaatcgggtcactcccacccaaatactgcgcttttccgacgggcttaaaaaacggcacaccacgagattatatcccccagctggctcggagggtcctacgcccacggagtctcactgattgctagcacagcagtctgagatcaaactgcaaggcggcagcgaggttgggggaggggcgcccgccattgcccaggcttgcttaggtaaacaaagcagccaggaagctcgaactgggtggagcccaccacagctcaaggaggcctgcctgcctctgtaggctccacctctgggggcagggcacagacaaacaaaaagacagcagtaacctctgcagacttaaatgtccttgtctgacagctttgaagagagcagtggttctcccagcacgcagctggagatctgagaatgggcagactgcctcctcaagtggatccctgacccctgacccccgagcagcctaactgggaggcaccccccagcaggggcacactgacacctcacacggcagggtactccaacagacctgcagctgagggtcctgtctgttagaaggaaaactaacaaacagaaaggacatgcacaccaaaaacccatctgtacatcaccatcatcaaagaccaaaagtagataaaaccacaaagatggggaaaaaacagaacagaaaaactggaaactctaaaaagcagagggcctctcctcctccaaaggaatgcagttcctcaccagcaacggaacaaagctggacggagaacgactttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgcgaagaatgcagaagcctcagtagccgatgcaatcaactggaagaaagggtaccagcgatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgacggggagaatggaaccaagttggaaaacactctgcaggatattatccaggagaacttccccaatctaacaaggcaggccaacattcagactcaggaaatacagagaacgccacaaagatactcctcgagaagagcaactccaagacacataactgtcagattcaccaaagttgaaatgaaggaaaaaatgttaagggcagccagagagaaaggtcgggttaccctcaaagggaagcccatcagactaacagcggatctctcggcagaaaccctacaagccagaagagagtggaggccaatactcaacattcttaaagaaaagaattttcaaccaagaatttcatatccagccaaactaagcttcataagtgaaggagaaataaaatcctttacagacaagcaaatgctgagagactttgtcaccaccaggcctgccctaaaagagctcctgaaggaagtgctaaacatggaaaggaacaaccggtaccagccgctgcaaaatcatgccaaaatgtaaagaccatcgagactaggaagaaactgcatcaactaatgagcaaaataaccagctaacatcataatgacaggatcaaattcacacataacaatattaactttaaatgtaaatggactaaatgctccaattaaaagacacagactgacaaattggatgaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgatgaaacagactttaaaccaacaaagatcaaaagagacaaagaaggccattacataatggtaaagggatcaattcaacaagaagagctaactatcctaaatatatatgcacccaatacagtagcacccagattcataaatcaagtcctgagtgacctacaaagagacttagactaccacacattaataatgggagactttaacaccccactgtcaacattagacagatcaacaagacagaaagtcaacaaggatacccaggaattgaactcagctctgcaccaagcggacctaatagacatctacagaactctccatcccaaatcaacagaatatacatttttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcactcaaaaccgctcaactacatggaaactgaacaacctgctcctgaatgactactgggtacataacgaaatgaaggcagaaataaagatgttctttgaaaccaacgagaacaaagacacaacataccagaatctctgggacgcattcaaagcagtgctttgagggaaatttatagcactaaatgcccacaagagaaagcaggaaagatccaaaattgacaccctaacatcacaattaaaagaactagaaaagcaagagcaaacacattcaaaagctagcagaaggcaagaaataattaaaatcagagcagaactgaaggaagtagagacacaaaaaactcttcaaaaaattaatgaatccaggagctggttttttgaaaggatcaacaaaattgatagactgctagcaagactaataaagaaaaaaagagagaagaatcaaatagatgcaataaaaaatgataaaggggatatcaccaccgatcccacagaaatacaaactaccatcagagaatactacaaacacctctatgcaaataaactcgaaaatctagaagaaatggataaattcctcgacccatacactttcccaagactaaaccaggaagaagttgaatctctgaatagaccaataacaggatctgaaattgtggcaataatcaatagcttaccaaccaaaaagagtccaggaccagatggattcacagctgaattctaccagaggtacaaggaggaactggtaccattccttctgaaattattccaatcaatagaaaaagagggaatcctccctaactcattttatgaggccagcatcattctgataccaaagcctggcagagacacaaccaaaaaagagaattttagaccaatatccttgatgaacattgatgcaaaaatcctcaataaaatactggcaaaacgaatccagcagcacatcaaaaagcttatccaccatgatcaagtgggcttcatccctgggatgcaaggctggttcaatatacgcaaatcaataaacgtaatccagcatataaacagagccaaagacaaaaaccacatgattatctcaatagatgcagaaaaggcctttgacaaaattcaacaacccttcatgctaaaaactctcaataaattaggtattgatgggacatatttcaaaataataagagctatctatgacaaacccacagccaatatcgtactgaatgggcaaaaactggaagcattccctttgaaaactggcacaagacagagatgccctctctcaccactcctattcaacatagtgttggaaattctggccagggcaattaggcaggagaaggaaataaagggtattcaattaggaaaagaggaagtctgattgtccctctttgcagacgacatgattgtgtatctagacaaccccattgtctcagcccaaaatctccttaagctgataagcaacttcagcaaagtctcaggatacaaaatcaatgtacaaaaatcacaagcattcttatacaccaacaacagacaaacagagagtcaaatcatgagtgaactcccattcacaattgcttcaaaggaataaaatacctaggaatccaacttacaagggatgtgaaggacctcttcaaggagaactacaaaccactgctcaaggaaataaaagaggatacaaacaaatggaataacattccatgctcatgggtaggaagaatcaatatcgtgaaaacggccatactgcccaaggtaatttatagattcaatgccatccccatcaagctaccaatgcctttcttcacagaattggaaaaaactactttaaagttcatatggaaccaaaaaagagcctgcatcaccaactcaatcctaagccaaaagaacaaagctggaggcatcacactacctgacttcaaactatactacaaggctacagtaaccaaaacagcatggtactggtaccaaaacagaaatatagatcaatggaacagaacagagccctcagaaataacgccgcatatctacaactatgtgatctttgacaaacctgacaaaaacaagaaatggggaaaggattccctatttaataaatggtgctgggaaaactggctagccatatgtagaaagctgaaactagatcccttccttacaccttatacaaaaatcaattcaagatggattaaagacttaaacgttagacctaaaaccataaaaaccctagaagaaaacccaggcagtaccattcaggacataggcatgggcaaggacttcatgtctaaaacaccaaaagcaatggcaacaaaagacaaaattgacaaatgggatctaattaaactaaagagcttctgtacagcaaaagaaactaccatcagagtgaacaggcaacctacagaatgggagaaaatttttgcaacctactcatctgacaaagggctaataatatccagaacctacaatgaactcaaacaaatttacaagaaagaaacaaacaactccatcaaaaagtgggtgaaggatatgaacagacacttctcaaaagaagacatttatgcagccaaaaaacacatgaaaaatttctcatcatcactggccatcagagaaatgtaaatgaaaaccacaatgagataccatctcataccagttagaatggtgatcattaaaaagtcaggaaacagcaggtgctggagaggatgtggaaaaataggaacacttttacactgttggtgggactgtaaactagttcaaccattgtggaagtcagtgtggtgactcctcagggatctagaactagaaattccatttgacccagccaacccattactgggtatatacccgaaggattataaatcatgctgctataaagacacatgcacatgtatgtttattgtggcactattcacaatagcaaagacttggaaccaacccaaatgtccaacagtgatagactagattaagaaaatgtgtcacatatacaccatggaatactatgcagccataaaaaatgatgagttcatgtcctttgtagggacatggatgaagctggaaaccatcattctcagcaaactatcgcaaggacaaaaaaccaagcaccacgtgttctcactcataggtgtggattgaacaatgagaacacttggacatagcaaggggaacatcacacaccggggcctgtcgtggggtgggggaggggggagggatagcagtagaagatataccgaatgtaaatgacgagttaatgggtgtagcacaccaacatggcacatgtatacatatgtaacaaacctgcacgttgtgcacatgtaccctagaacttaaagtataataaataaaataaataaaataataaaaaaataaaaaataaataaaaaaaaagatcatcctatctaacatagtgaaacccacctctactgaaaatacaaaaaaattagctgggcatcctggcgggcgcctgtagtcctagctcctccgtaggctaaggcagaagaagggcgtgagtccaggaggcagagcttgcagtgagccgagattgtgccactgcactccagcctggaggacagagtgagactctgtctcaaaaaaaaaaaaaaaaaagacaagtgtccagtttcattcttttatatatggatatccatttttcccagtggcagttattgaggagacttttcttccatcattgtgtgttcttggtacccttattaaagattagttgaccatatatgtgtgtttaactctgggctctctattttgtgctattagtaaatacgtctgttttgaactgagtaccatactttctaaattatagtagctttgtaatatagtttgaaatcaaggaatgtgatgcctccagctttgatctttctcaaaattgctttggctattcagagtcttttttggttctcaaagacaaactgtttctgtgtaaaggtaatgtaatattatatatagaaaaccctaaagaccccactgaaaagatatgagaactataaatgaattcagtaaattttttttctggttttatttctggtgtttttagtttgtttgttttttgagacagggtctcactctgttgtccaggctggagtgcagtgatgtaatcatggctcgctgtagccctgagatgcagtgatgaagtgatcctctcaccttagcctcctgagtacgtggaatgacaggcttgagccaccatacccaactagttgttttgactttttgtagttacctccatatgttgcccaggctggtctcaagctcctaggctcaagcaactctctcgctttggcctccgaaagtactgggattactgatacaaagcactgtaccaacctcagtaaagttttataatataaaagcaatatacaaaaatcagcagcattcagttactaacaatgaaccatcccccccaaaaaaaataagaatataatcttatttaaaatagaataaactataaaaagaattaaatgcttgggaatatatttaaccaaggaggtagaagatacatacaaggaaaacaatgagacactgatgaaagatatttaaaaaagacacaaataaattaacagatatcctgagttcatggattagaagaattaatattgttaaaatgttaatattactcaaagcaatctacacattaaatgcaatccctatcaaaattccaatagcatttttcacaaaaagagagaaagtatttttaagtacctggtagggtgcctgacacaaaaacccattattattatttatcactttaactgattatatatatatatatatatatatatatatatatatatatattacaattgctgcaaagtattgatatgacaataatatagacattgtgaatcctctgagagaatcttggagacagcagagttagccatggtcattctttgaaagccactgaattaaagcattacagaaaaaaaaaaaaaaaaacagtaaaacactttgttggtgttcctgggatgatttggatttaactcagattaagattttaatttactttatatcagaaagttctttttgttttgttttgtttttttacaaaatcattgtctcaagtatgtatgaggttccataagatcaagatccaaggactggtgggggttgaagttctattgatatctatagagcttccctgttactgtacattatggttttagttatcttaattgttttagggaatgcttcacctatagcttgcttcttagtttatcctcataacatttacctatgctttcattccttcccataaccataactaaaatgaaattatttaaagaatgtttattacttacctataaattgccaaaccctggagataaagaaatgagcaaaatggtctagctgtagagctcctaaactttgagaattgtgagcatgagcctggttagaaaaattcccagaacaatgatgatactgaaactaagctttaaaaatcatagagtaatttgaggagagaataggagacagttattatagcatccacatgtaacaagatatgaaataagagatccagcaagaattggttgtacagagcaaaagtgaacatatgagttaaaataaggccagtgaccaggcacggtggagcatgcctgtaatcccagcacttcgggaggccaagggaggtggatcacaaggtcaggagatcaagactatcctggccaacatgatgaaaccccatctctactaaaatacaaaaaattagccgggcgtgtttgcaggcacctgtagtcccagctactagggaggccgaggcagaagaatcacttgaacccgggaggtagaggttgcaatgagctgagatcatgccactgcactccagcctggcaacaagagcgagactccatctcaaaaaaaaaaaaaaaaaaaaaaaaaaggccagtgaagtacatggtataaggtactgaagtggtgtgcaccaatgttgtagaatatattcttgggcaaggacaattaaagattctctggacttgacaactatgatggctgctgcaatctgtaggatgtaaatcatttgacattttctaaatatcagttctcatttctaatgatatgattgaaaaatggtatataggttgtatcagacatgtgaagggtacccagcaaaactcaaatcttgaaattccaaataaaatatctacaaatgtataagaagaatgattacatattggggctctgggcatggaaagaggaagaaccatatggctgctttcctcacctgaatccttcatccaaagactttccagaaattgacatctccctcagaaatggtcatcaaaaccataaccaaagaaagaaaaaagaaaagaaaaaaaaaagaaaaacctcacagagaaacaagagtatatagctgctagtcaaagtaaatgtatgcttgtatgagatcttacagcttcacgttttttaggacagttttaattatcacccaacgtattagtttcacagttcaactcagcatgataaaccctgtgggataattttactacaaaatggcctattttccatacacacaatttgattacagctgtgtctttatctctgaaatccatgagaaatatgttcttcctttggagaagaacaatactgataaacttccaaaggacatctctgagcacttctgaagagaagaaatggtatttggtgtacttgggcttcataagccatgcaacacaaatcaagttataacaattctgacactatctatggctgcaactaattacttgtcaaatttgaatgatgatacatcaggtcattatactacagaatgataaaaaagaggacaacccaatcctaaagttatatgcaaccaacaacaaatcttctagtaatgtgaagcaaaagctgatacaatttaaaagaaaaagggacaaaaccacattttagtggggtacttccatgccacgctctcaaaaattgacagaactagacataaaatcagtaaggatatagacaaacatatctagtaaaacatctaattggcatttatagaacattccatccaagagaagaatacgttcttctttttcacgtgcctttggaacatacactaagatagaaaacaaaccacaacaaacttgaaagacttgaaatcatgcagaatgtgttgtttgaccacaatggaatcaaaacataatcagtaacagaaagataccaagaaaatctcaaacacataaatattaaacaatacactgctaaataatctacatgctaaaaaggaagtatcaagatagaacttttttaaatcattgaactaagttgacaatataacaaaatttgtggaacacagctaacacagtgctgagaaatgaatagcattaaatgattttattagaaaagaagaaaatctctggatgggtgcagtggctcacacctgtaatcccagcagtttgggaggctgaggcaggtagatcacctgaggtcaggagttcaagaccagcctggccaacatggagaaaccccagctctactaaaaatacaaaaaaattagctgggctttgtggcaggtgcctgtaatcccagctacttgggaggctgaggcaggagaatcacttgaacccaagaggcggaggttgcactgagccaagattgcgccactgtactccagcctgggcaacaagagtgaaactctgtctcaaaattaaaaaaaaaaaaaaaaagaatgaaagaagagaaaaatcttaaatcagtagcatgactttccacctcaaaagaaagagcaaaataaatgcaaagcaaacagaaagaaaataataaatataataacaaaaattaataaacttgaaaataaaaaatagagaaaatcagttacttcatttaaaaaaatcagtaaaattgacaatcctctaagaagactgaaaaaaatgagacagagagagagaggacatgaattcatgaattaccaccatcatgactgaaatgtgcaacatcaatacagagccttcaaatattaaaggaatagtaaggggatactacaaatagcgctacaaacacatacttgaaaactttgaggaaattaatcaattccatgaaatgcatagacaatcacaatttactcaaatacttaaatataaatagataacttcaacatcctataactattaataacattgactttataatgtaaactcaaaaaagtcatctccaggccaggatgatttccctggagaaatttatcaagcattaaggaagagttcaaatatattttatacattctctttcagaaaagagaagagtagggagtacttctcaatatgctttatgaatatagtacattcatgataccaaaaccaaagaaagtattccctggtatgaaaactaataacaaaaaaaaatgagagggggcaggagaagaaaaatatgagaggcggagagagaagaaaaatagtaaagagagagagaggagaagcgagcagtaaagaaggaaggaaggaaggaagagggggagggagggagaaactaccttgcaaatataaccacaaaagtttttaacaaaatattattaggtagaattcagcagtacataaaaacgaattcagcagtttatacaccatgaccaagtggtgtttattccagggatgcgaggttggagtgatatttgaaaatcaatcaatgtaatataccatatgacatgatcatatcaatgaacgcagagataccatttgataaaaatcaacataaattcattgatttaaaaaacccaactctcaggaatataggaatagagagaaattactcagcttgatgcttgataaagagcatctccaaaaaaccagcagtaaatgttatacttcatgttgaaagaccaaatgctttagtctaagattaggaacaaggcaaggctgaccaatcttcccattattcaaaatagcactagatgttctagccagtgcaacaggcaatataagtaaataagaggtaaaactaagattagagatgaagcaataaaactgtttccattaggagatggcatggcagtctaaatagataatcccaaggaatctacaaaaatactcctaaaactgacaagtgagttcagcaaagcttcagtattcatgataaacataaaaatcaaatgtatttttatatactagcaatgagcatatggacattgaaaataaaaaattaccatttacaatcactaaaaaatggtgtataaatctacaaagtatacaggctttttctatatatagacaagattattctaaaatgcatatggaaaggtaaaggaactagaatgccgcatgtctacaactatccgatctttgacaaacctgacaaaaacaagaaatggggaaaggattccctatttaataaatggtgctgggaaaactggctagccatatgtagaaagctgaaactggatcccttccttacaccttatacaaaaatcaattcaagacggattaaagacttacatgttagacctaaaaccatcaaaaccctagaagaaaacctaggcaatatcattcaggacataggcatgggcaaagacttcatgtctaaaacaccaaaagcaatggcaacaaaagacaaaattgacaaatggaatctaattaaactaaagagcttctgcacagcaaaagaaactaccatcagagtgaacaggcaacctacagaatgggagaaaatttttgcaacctactcatcttacaaagggctaacaatatccagaacctacaatgaactcaaacaaatttacaagaaagaaacaactccatcaaaaagtgggtgaaggatatgaacagacacttctcaaaagaagacatttatgcagccaaaaaacacatgaaaaatttctcatcatcactggccatcagagaaatgtaaatgaaaaccacaatgagataccatctcataccagttagaatggtgatcattaaaaagtcaggaaacagcaggtgctggagaggatgtggaaaaataggaacacttttacactgttggtgggactgtaaactagttcaaccattgtggaagtcagtgtggcgactcctcagggatctagaactagaaattccatttgacccagccatcccattactgggtatatacccgaaggatcataaatcatgctgctataaagacacatgcacatgtatgtttattgtggcactattcacaatagcaaagacttggaaccaacccaaatgtccaacaatgatagactagattaagaaaatgtgtcacatatacaccatggaatactatgcagccataaaaaatgatgagttcatgtcctttgtagggacatggatgaagctggaaaccatcattctcagcaaactatcgcaaggacaaaaaaccaaacactgcatgttctcattcacaggtgggaattgaacaatgagaacacatggacacaggaaggggaacatcacacactggggcctgttgtggggtgaggggaagggggagggatagcattaggagagatacctaatgctaaatgaggagttaatgggtgcagcacaccaacatggcacatgtatacatatgtaacaaacctgcatgttgtgcacacgtaccctaaaacttaaagtataacaataattaaaaaacggaactagactagctaaacaattttgaaaaggaaaaataagtcagtctccctggtttcaagttttattatataattacaatagtccacaatatgttatactggcagaggaacagacacaggtcaatggaatggaacaaaaaactcagaaacaaaaccacataaatatgcccaactgatttttgacaaaggtattaaaacaattcaattcatagcctttttaataagtgatattggagtaagtcatcatcagtgggcaaagaaaaaagaaacgaatctcaatctaaacctcataattcaagctggatcatggacttaaatgtacaacttgaaattattttaaaattttaggaaaaaatagaacaaagttttcatgactttggactaggcaaagagcacttaaatttgacaccaaatacaagattaataaaaggaaaaaaattgtaaatagagcttcaacaaaattaaaaactgctctgtacaagaccctaaaagaattaaagaaaatcaacaaaaaataagctacagactgggagaagatatttgcaaaccacgtattgaacaaaggattactatctagaatatagaaagacttaaaactcaatgtttaaaaagaatgctcattagtatatgggcaaagtcctggtcagacatttcactgaagggaatatactgatgaaaaaaaagcacataaaaaaattccaacattattggccaccagggaaatgcaaattaaaaccacagtgagatagcactatacccttagcaggatggctaaaatgagaacataaataaataaataaataaaaccaccaccagtcatttatacattattcatgaaaatgtaaaataacctgctaggttattttacataactccaggagacaatgttaaggtttcttggtggaaaaaaaaattgccaaactacattttccactatcatacaatacagcaatcactctcctgggcatttatcctagagaaatgaaaacttctgcttgcacacacaaaaagtgctagaatgttcacagcagaattatttgtcataatcaaaaaccagaatcagatcaggcatccttcaattggtcaatgtttaaacttcagtggatggtatatccatatcaggggacagagatattgatacagccaacaacctatataaatcaccagagaataatgctaagtgaaaaagccaaacccggaaagtcatatttgtatagttccatttatagaacattcttgaagtgacaaatttataggaatggagaacaggttagtggttgtcaggggtcagggacgtagtgggtagggaagtgaatgctctaaaaagtaaacatgaaggatctttgtggtggtggagctgctctgttcttgactgtattagtgtcactacactggctataatttgtacatagttttgtaaaaggttaccatttgaggaaaaactggtaaagagtatttgagacctctctatatatttctcacaattgcatgtgagtctacaattatctcaaaataaagggtttactataaaagggtcctaacatcagcaacctggcttattaaaaatgtcatccgaagactgtcatatcacattaatcataattatgtcaacaaaaacaaggtacatatattttaaacagactgtcatttttaaaacaaaaatactaaatcttatttgttcttaatgctctaactgaagcgtaatttttacttatactaaaacaaaaagcacctacatttcttatatgtgagctattttctccccctagagagctggaaatatggttgataacaacattttaaaaggcatgtggaaggacataaagtgaatgcctggagctcatattgtcttctaagattcttggattgaacatatttctattttaagtttaactatttttggcatgttttccaaacagtatctaggctaagaaaaatgtaacatgccaaagtaatggtaattaataattccagaggattatgctttaaataaagtcataacaaagagctaacatgcttttattaaaatgtgtaagttatttgcatcaaggaaagagctagtggatatatttagcaaaccggatatgcactgattttgttattcaagaacattagataaagtgcacagaagaatcctgtttgggagctctggcttcctaaaaaaaactcaaaaataagaggctgccaaagctaataactagatttgttgcccctgattcccacataaagacaagcctcttttgtaatgaatcctgataggttatccccttggcaacctgtcattcaagttcattagttcatttattcatctactaaatatgttatctgcaacaagggcaacttttactttgcatgggtcacttactactaaagcacagaaccagtagagatgagtgtttaataatctattgcaggacattttaccactgattatattctcctgtattttcacttgtgtattttaacataaatcagagaacctcatccttccgttcaaaaccctccaaaggcttccatttttatgaaggatgccacactattcccactgctcagaatgcttcccccccagagagccacctagggagcaccttcatctctttcagatcattgctctaaagtcctcttctcagtaaggctcacccagagaaccttatctaatattcaatttagcctatcttgctctaacacattttagggttcatttacttttcttagtgtccatctttacatttcctttataggattttttttgtgttcttgttcactgcactatcccaaaaatttttctcatgacaagaacagaatatatgctcaacaaaaacatgttaaatggaagaacttacgtttttcttggtttgctatgctttctacaaacacttgcttactatttataatgtaccaggcataattctagcagtggaatcaactacatgctacacaacccttgctctcacaggtctcactgtggaggaaaatattgcagttggggtgagaggaaggtattaaaaccggacggataaccgcagtacaatatgggatatagtgccgggcttcttgaaaaaccccgggatataaaaacaaacaaaacacagcacagtccttgaaactcttatccttaggaatctaattacctaatgagggaatgccatttaaaagagagagcagggtgaggggggaagataaataaacagaaaaacttttaaaagcaatgtaatatagcatgcattgagatgaatgcaaaaaatggggattcttaaagcatggaaaaaggactagctagatggcctggagaactctaagaataacaatgaaccaagtcttaaaagattaatggcaaatttttaaaggtgctttttaaattataaaactaggatgagttttaaaggaaatctgctaagaccccgtctttgaacatttaaacaacttattattattattttggagagtgggagagtaaattgatgaataaaatgtagttgtggtattggccagaagtaaattgaagctatataaggtttgtgataataaatttaagtaaagccagtcagtagtgttttgtgtttgatccagccctgttgagtggcccaggcacaggtgtaaattaggcagacaggtagaattagccaaagctggagttgctccagtcaagtatggtggcaggtacatgtacaagggaatatagagatatcccaataagtgattctaaagctgaactggaaatataagctgaataaggtcggagtgaaggcttaagaaggataatgaacattgaagggtaggcaagatcaatagtgagttgtagatccttttgagatcaaagaattattggagttcagggtgttgaagaggtataattcaaaataaatcaaatagcagaggtcttcgcaaattaataggtactaaatgctatgttttcaaatgaatacttaacaactttctcttaaatgcaagaggctggaccaaatgatctattatcctctatgataaattataagagagatgtctaaggtaggtttttcatttcattcaagtttaaattgtttgctgtatgattttattgggggtagattattaaacacaaataatattttaaaagtctctaatattgacatttatatgctggaatttaaatgacattgaacttctcaaattattatagatttgattatctctgtcaaaaatctcttatacttggatcaaagagctttccttctttaaaatactttcttactaagcaggattggggaccactggtgagtacaaagtttgggcacattatataaggaaagcttatggaatttgagaatgcttaacctgaaacaaaaagaaaaaatttagcagtcctaagatgttgaaagtgggcatgcacaaggtaagatctaaatagttccgaatttaggctctggaatcatttagatctacatttgaaatgtagctttgtgacttgggcaagttacttatcttactaaaaattattttcctctttctgaagcatttctgaggaagtcatttgcaaggttggtgagaaagggaatttgattacatgaacttaaatctacaattatttaatcccatatgcaaatagatgaaatatttatgtttttgagactagaagcctgtcttctatttaaagacactgtccttcaaacagagctcttcttcgttcctcagtctaatcaagaactctaaaaccaggaaaaacagcatatgggttacatgcaattgaaaactcaatgattccacctccaaaactggaatacattttggcagaccagactgcctctaggcttaggacattactgacttctctgactatgggatttcacagctgggagcaggaccaacttagcaaaactcttacatagatgaaatctatctttggatttatgctgacaagtaagattctgcaactggtttttaaaatattttactaaattttatgtgtttaaatgtaagtatgaaagaaagaaatttgaagttgtcagagcttgttgaaagactccttatttaagcagaagttgacaaatttattacattgtgtaataaaagcaggctatacatttcatatcgggaaggaattggaaagagcagaaataacaggagtcaggaagaaccacttgcttgtattagtttggcttggcttggagaaaatatccaatttgtcaagctagggtcaggaaagtcaaggtgtaattttccgtctaacaatggatagttataaagggccaaacaaaggtaacagtaatgggaatggatatattataatctacatcgaatatctctggattcagaatgcctttaatgttgaattctggagtatgttaccttagataagttactcggtttttcctcagctataatatatctatttttagagattctgcgagtattaaatatggcaaattagtaagtatttatatctgtgcctggcatttaggaggtgatcagtaaggtattaccagtaatgtaacggtggatgccttcagtgatcattggccagaaatgttgtacgaaggatacagggaatgtttgagggcttgatttaaatggttatcacaagcattcatttaatttaaattttgttgctcacctaccatattgttgtcattttgctaggtattggaactatacaaataaaagccctattccttgtatttaagagtgcagtctagtagagaaagaataaaacaacaggataacaaaatgtgctatgaaagcacaaaggacagatattagcaaagaccggaagcataaaggggcagtcgttgaaaaaggcgtccaggggtttgaaacaatggaagcgtatttcaagttgagaaaaaagcaaatgaaaagttataacatgtaaaaagcacagtgttgcagaatacggaaagagaacagtatagcagaaagaggacgtaatttataattaaagaacctggtttccgtggcctggctatgccatatactgccacaggactaagcaaattgatacaacttatctaagtttcaaagtactgatctgaaaagtgagattcataatatctaccctgccatagttgtgaggcttaaatgagataagttatgcatttacttcagaaaagtatttctttttatacccactatttccaaatgagctgacagtcttcctttcttttggactctagtcattaactctaactctctccctgcttccacctggacccctgctcctaacccattctccaccatccaggctgaagaacctaaatgcacaccagatcaagtcacatccccacttaaaagcccccaatgacttcccattgctcctaaaaccaaattattaatgatgggctaacagatcattcatgatttgtcccctgactgtctcactaaagtcattttcacgccttgctttcctcactctctgtgcaccagccactttggccttctttgagtttacacatatccatgccccttcctgctatttgtattttgcatattacctttaccttgtccttgtcctcctctttctcccactttgcctatataatttcaaatcttttttgttttgttttgttttgctttgttttgttttgttttgagacagattctctctgtcacccaggctggagtgcagtggcgcaatctcggctcactgcaagctccgcctcccgggttcacgccgttctcctgcccaagcctcctgagtagctgggactacaggcgcccgccaccacacccggctaattttttgtatttttagtagagacggggtttcaccatgttagccaggatggtctccatctcctgacctcgtgatctgcccgtcttggcctcccaaagtgctgggattacaggcgtgagccacggcgcccggcccaaatcatttttaaaatcttgcatcaagtgtgcctatcccacccttatttattaggccacatgcccctatcataggatctcccaggacttgcttcctttactttttagcacacaacaaagacaaaattttgcatttgttaagtgataatttgcatccttccaaccagaccatgaccccaggagagtagtgaatatttgctttttcttgtactataacaccactgttcttttcatgtcagcatatctctctgctaagtttagtgccaagtatatagtatgtgttcaggggcatcttttgagtggaggaatagatgaaacttcaaatccagtgattggtcacattattaataatcaatcaacaagagtgattttcattactgccattatcattctgctgctattttatgtttagggtttttataaatagagcatagatgcaagacaagaagggagaaaagtgatgctgggggaagtacaaagagactagataggtaataaaggtttatttgttttataccttgttaggtcatacgggttttatccaagtgtataagaggaagaattaaaggggcttaagcagaagggcatgatgaatagctcaatgtttaagaacctctggtagcagaatgcaaaattaattacaactatgaagtgaaggcagggagggcagttagaagactcttatgaaatcaaggtgagaagtaaaagaaagtactgaatgaagactgtgaatcctcagtttctgtagttttctaatcttcctgtgtttaatgctgtgtcattaataatttcacatgattggtgaaagtggcaacctttcattccttgtttaatcactcacaatattaatgtatctataatataacttcaaataaagaaacacagtcctggataatacttaaaatttgaattccaaacttcaataccattgtatgtactcagaaagaaactatctttgttgtaagaggagaaatatgtaatacaattatatgttttttttctgagtcttgatttaaaaggaaactgtgaaaaaacagtatggcataaagatgaaaaaagtctctttggaccaaaatttcttctttgaaaacctatgctggaaagaattcgtatgcagtgctgacatgtaaattcaaggatatataatgtttactacttaaaccatttactttactaaccaaaataaaagacatggttagctggattatcaagcaaatattcaaaataaaattaaatttaagtatgctcagatctctatcataaatcataaatttcctctggtgttatttctctccattatatgtaaatagacaaggactattcctgcaaaattgttttaccacacagtctgtatttatgcatctaaaatgttattcttcatggctatgtttctatagacatcaaggttatctaaatttgattttgataatagtatatatatccaaaactatgataagtgatggttcactagttgttagtacttttgttataattgaactcaaagaacacaatcatgttgttactggtttcatcgtaaggttaagttctccagtataaaatttcattactaggcacttatgtgggagaaaatagtttggtctactctactgtctttatatactctgctatttctaattcaaactcatgaaaaaaatgtttcttcacattacactacaaatacgattaccatccataagtaatgatttacagtaaaaggcaatcaagaaaaatcatgtttagaagatagaaggaacaataaatatgcataagtttttgaagaatattcttgcattttcatttgcctctgttattcctttagtttgtttcttaattaagggcattttagcataattttaaaaacataactgacaagtgataactttttacttacaactaattaggagcctaatttacctttagccctattgttttacacacctcataaaagataacatcaatgtctgatccctcttacgcatctcttccttctttgtccctctacctaaaaataaaaataaaaaaccttaagatgtataagataagcaaaggttttataagttaattttaagtgtataaatgaataaatttgttaacacaaaggtaagttgacatattagcataccaagatgtaatgtcactaaattgtaaatcaagtaattacacagagtttattcatacctcttttccttctttggtattccttaaccttttcaagtttaatgagctaatttcaattttgaaaaaaggaattgaaaattagataattacatccagctttattttaaccactaattgacctaagtttcttagcagaccattgagaaaattaaagctcagagaaacagaggaatttacccaagattatcaagttaacagatgagaaaactaggactcacatattggccattatattcattaagtaatataataaagtatgtatgaaattgtgcagaatacaaaaagtgtttaagatctaaaagcaatgatctctaagccataaaataaaaacacaaaatcaggccgggcgcggtggctcacgcctgtaatcccagcactttgggaggccgaggcgggcggatcacgaggtcaggagatcgagaccatcctggctaacacggtgaaaccccgtctctactaaaaaaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaaaaaacacacacaaaatcaaaatgtttacaattgtaataaatatatttaaattgaaacatcaattagctacaaactccacatatgtatatacacacatattatatataatatagttatatattatatgtatacatgtatattaacatatatatatgtacacatgtatatggccatatacattacaaaggattgaggcaaatattgagcaaatgattattaaatgtaaattttcaaagtcttaagatcatggcctattatacacgattatatgcaataaaagcatgcccacagaatactctcccttaaagttagagtgtgaatatatgacgtaaccatgatttgcattgagatcttttggattccaaagtctaagattttatcatgacactaccctataaacatggcccacagaaactgtgtaacttggtcaaatcttacagcaaattcagagctagagaatgtgtaaaatatacataacccctgcttcccaataaaccctatgagtataagctatttgagaaggaatttaaatgcccaaggatcacagaattatgaaggtatcatgtggccacctagattagggtccttagcctagaattcatgcaactgtaagggatttagggtggcacagaattgttaaaatgatatatagctgtattttgtgaaaatttcatgtttatgccaattaaaattatagacaacatgttattcttaaagggagttataattgttaaaagtttaaaaattattgatataaacaactttttagatgactaagtggaaacacagagagccaaagtgactgtggagaaccatacaactggataatgggagaatagttattagaacgtaggtttcttccttcctttccctcctcaactgaccatgtcatggtgccatatgtattaagccacaccatgagcttgcaaaagcaaagctaatatctgcagaggatggcacatgattatgagaaaatgagaagccttagtggtctgaggcatcctgatggactctaggtaacttactcctttgctttccaaaagagtaataagaaaagctatatttaatttaatgtggttccatttgtagagagaaataatatctgcttctttattaacttatggtgcaaggataactcaggccattttctaaggaaactcaatgagttagaatctgctaacctcagtaaacaaaacctcagttagctgtaattaatgttcatagtgcatctgcttaattttcctaatgcactagcccttttttctttcgttttcttttttttcttttaaaacttctgtaattcttcatgagctttactttcagtaacttatggggaggtttcttaatcttattttaacatggtattgcaatattaatttgaatttttttgatggtggagggattttaagaaacaattttaaaacaaataggtctattcatcaaaatgttcaggctaaaacagttgtgaatatcgtgggaataacttataagggagacgacatcttcattattagttcagtggtgtctagttgaaaatgtctatattacagagaagttggcaggagctgctaaagaatgcttcagcttgtccacaagtaagaattaatcctaactgattactgaaaaccagagctttgcacaaaattgccttttcattcatagtggcatctcaacactgattacgtgaaatctgcaatgtactttcaaagaaactgagatgatatacttgataaggcataaaaattgatctctgccaccaccaccaaccatgaagcagcctacagcatcttgaccattaaatgaattgattattaggggccagacagtctgctaaatacattgcatacattattttatgtaaccttcatgggattgctattatatagatgcaattactcttaatctatctacattatagcaatgttatttcatagatgttttcatagatgaataaatttgcatttaaggagaattaaaaatttgatcgtttcacagaatgattaagggaagaaattctggatttgacctcaaattaccttgattccaaagctagttccattaactatcaagttacatcctttcccattctgatagcaataatgcataggctaatggatacattttttataatgatcaaaaaattacaatgaaagaaaaaaagggtgggaaaaagagagaatggagggagtgagtgaagaatggaagagacaaaagaagaaacaaataatttagaagcagaaaatcgacaatcagaggagaagacattgaagataaaaataaacagcaaagtaagagtagactttttgttgccatggagatttcggaaatgaaggtaaaatgtatctgcatataatacttgcaaataaagatctgtaggggtagcaggaattcctcatgccaatgaagtaggtgcccagcaggaggaagctgactcgcactccttacatcagagcatcctggcctaatccagcgaattctgacatcaagctcccgtgagcagagtctgaaccatttaacctagcatggtgagagagtctatttggtcatctttattgttgcaaataggggtattttttgggaaaatgtatgatgcgtaaaaaatataattaccttatgactctacattgaatgcatacattattctctctttaggatcaaatccactaagagaatcaagaactgctgcacagaaacctttgatagccaatgtcctaatacgaagaagaagtaaatgaacagaaggagacatagacttaaagctctcgcaaaattgaacaatatttcaaggccctacattgaccaaacattaacgttaaaagagcctcaccatgtcagcattccagccagcccaaatcgtcaaagagcaagaaagcaatgctaaagaacaatgtgaaggaatcattacataccgtttgaatagtttcctaaattcactcagtgctctatctattattagctatagcacagagaacttgtttcctattacagatggtagagaatttctagtttgcataaaatcaacatcctctaaagttctgaaaaaacatatgtttgcagacgcttacccaaagatagcaacggaacattcattattcattagctgtttcatttcaaattttttatgatctatttgccatatttcactgaatctaagatcttgcagacaaagttgataggtactccctttgtaatacagttaagatcagactttaagatagcacgtcgtgttgctacatgtaagagttctgtaagtctaatgcgatagatgacaaatattggaagctaagcatatgtgttatttttctgcatttgtcaattactattttagaggaaatatttaggctttccttgctcatgttcctgacttggtccacagagaacaaatgtccacaaataatcttgtctttatgagaatattagaaagaaacaaataacttctttttcattttatagctttaaaagcacaagaagagggagggtactacttcattctccatgtatggcttgaatcaagctggtttacggatctctgcattgcacattaggagcatcatatattggtcagaatcctgatggtgaagtcaacaatacaaattcaggcgtcaagcctcactctcacacctgacaattctgtgtattttgaagcactccgaaatctttatgagggcagacttgccccatactactatcagggaagaattatcttgcttctcagtgcaaaaatagttgtaaactgtcaaagctatttatcttctcatgtcaactccctgctcattattagaggttcagggaaatgtcatttctactgagaaatggtttttacaacccaaatccaaatccaatgctacctcttctgtgatcccttaacaattttaatcttattttagcacttatcacagcctaccagatagttattaaaattatttgagcatgcaccttgctcattgactagaagtgaatccctagtggttagagattaggtaacacttattcatgtagcctcccacttcttacaaagtacattacgtttgaaaagtatggaaagacttgaatctttaaggcttatattttttattctagttcagaagagacagtgtgcccaacatcagtaagtcaggtattctggagatatttgctacatagtcacaagtatatccattatcatatgcacacatacatatacacaaacatacatatatatgtttgtgcatgtgtcaaatacacacacaaacacataatcacaaatacaacactacaggtatcttcccttttcttttcacaattgttgctagtaactccacctctatttcttaatagaaatttagactacttaaggaaagaaaattgtagagatcatagagatctaccaagaccattagtatcacagcacatggtacagaaaacagaatttgtgttactactcaacagtgccggctcatcataaaagcacaaagacaatttgctgagctgagctgagcttggtttcaatgctattacttcaattcattttcccctaaagatagggctgttttttttgcctctttcaattgaactaatgtacatagagagtagaaaaatggttaccagaggctgggaagggaagtgggggctctgggaagtggaggcacagatgattaatgggtacaaaaacaaaatagaaagaatgaataagacctactatttgatagcacaacagggtgactatagtcaagaataacttaattgtatatttttaaataacttaaaaatgcaattggattgtttgtaactcaaaggataaatgtttgatggaatggataccccattttccaggatgtgcttattttatattgcatgcgtgtatcaaaacatctcatgtaacccataaatatatatacctactctgtacccacaaaaagtcttaaaaataattttttaaaaattttaaaagctttgcttcaattagtcttgaatgcttggttctggcaccgcctacttcttgtgggcatagtgcccactgtacgtgttcaagtgagctgcactcatccatctttcactagggctgattcatagggcggccagaaccctatttagaaccatagcttgctgcttacataaatcaatgaaatcatatgaaacacaatataacatggtttcattgaaagagcacaggtgtcaaaaggatgtgagtttacatattacataacttaatatttatttgaacttggactcgtcacttagcctggttgaacttcaaatcctttattggtgaaatgagcatccactcataaaatttcataagcctatttcaaaggattgctaccttatataattttataaactatgaattctcatacaaaagtcagtgataccagatcacacaatttaaaatttataggcagacacttcactacttttgcttcccttcactgtgaagtaacacatgctatcaccttggtggcactcgcagggtatctgttggctggctgttttattgggcttcttcctgccactcaagtgatcatgactgagaagaaatcaatgggtgtctgttggcagtgtttttaaagacatattccttaggtaatacaggtagtcactcataaaaaaaactttttttctggatattagtctgccctcgtggatatctcagggcctcatacttcatcaggcaatggccagttcatttttttaatccaaagctacacagagtgaaacactttattctgtgtgtgttttaaaagcccaggtagcactaaataccattttccaggaagtgtgccaagtactttggaggatgtacattgaacttttcattagaaaagcttcccaaatggataagagttatctgacagaaaatagtttcatatctcattatacctttgagtgtgattacacaaaccagcttggaagactaccaggcagcacctggctgttctcaccttgactctaccattagctaacaatgtgagttagggggcatgtcatttaacctcatcgcttttgttttctctcctgatctagaaggcatgatatatttgccacttgaggtcctccctgtttctaaaagtgatcaaatgtggtttttagtagagcagattgcagatattgaaacaatcaaaacccagttggaaggaaagagaagatatcagtgatctacagggaaaaaaacactagattcaaaaatttattttagtgctgagctttctagtgttaaggtaaaactaactaaacacatgtaaattatatctatatataaatatgttataaatatatagaaccattatatatgttatgtattatacatatatttatttatatataccataaaacatatttgtgcttatctataacacataacatatataatatatattcatctttcatatttattatatatacattatacatatatgtacatgttatgtgcatgggaataatggtttttcatatagacagatattttcataaaatttgtttcaaaagtaatttttatgctgacatgtctttatataaggactttgaataacaatattcttgttgtctttaataatagtcttatagaaagaaattaatattacatttccaatattttgtggtggtagtatttgctaaccaatgcataatcctttatatacactgtctgttgttatttaagtgtccctgaaaagtaattgttatctcctgtttgagaaaggatgaaattagcatttagagaagtcgagtgattttcttattgtcaattagcaagtataacagtaagccattatgatgtggctgtttctacacatctgggtgtactttagtgggcatgcttcttttgtgaggccaagtcaataaagaccatgttggctcctgaaatttagtatatgcatactaaggtctacctctagtgggataggataaaacagtcaggaagatattttcctaaagtaaatactgtttccactcagtttttcattgcaaactggataatagccatctgcagacaaaatttttgatgggagtacatgatgagagtactttaagttgtttgtagaaagaaaagctatacattttaactaccaaatacaggtagcaaggctagcactatcattaacaccaagaagctttcttcatattctctcatttatgactacacagaggtagatataagaataaatttgatgagctctcaagcccttccaaactttaacattctgtcaccatagaataaactatatataaactaagcaaacgtttgactccactaaaaatatgaaattcatcagtgcatccttgttctggtatgaccctcagaccaccaaggtttaactaatggacttctgagtattaccttggctctagtctgtagcaatgctcaatgaatagaagataagtagactcttctgttaatactagtttatgccctacaaaataaactttattgagaatgtcattcttgagacagattcattcaacaaaattaaaaaacaaacaaggcatagcataatgtacagaaattgaaagctggccttcagcacacctcctccttccaccagctactgtgttttacttctctccacagatgtaatgaaaatgcctcttaccatttatccaataaatacctactctgctctcagtacttgatacctatgacttaatccttccaacaacctttcaagagaagaatgataactcccacttacaaaaaaggaagcagaagctgaatggccaaggtaacagagctactaatggcagacccaggatttcagtccaagtgtatctgattccaagcttgaaccctttaacacaatatgcttcttctcacaagtactatatcagatgcactgttgcttcctgttatttgttgagtacccaccatagagtttctattccagaaggaaaataagagatttagaagaaaatctacagaatgtttggttttcagttcctacagagaaagggtcataagtgacccaagcatttagataaaagtctaggtcaatatgcccatcactagcactttgtttttacttcttaccacctctttctccagtacctccctcctactctttcagttatatatccactgcttggcacatgataggccctttaaataaaattacttaaactatctgcctcaatttcctcatctataaaataggataatttaaatttcaggtttgttgcatggatgaaattagtacaatacagcatctgacacaatatatggcacataattatctaataaagggtagttattgttgtcattgccattacacatttgttgaatgatttagtgaatgaagctcacatgcagggcacatgtagtgtctataggccaaatagttgtgcttaacaccaaggagtatctgtgtaccaaatccaacccccagaatagagccttgcccctcagaaacaagccacttgtcagtaattatgtcatcagtgatgcaataatatgtgaaatgtactgtggcgagatccctcagtcattgttcttttcaacatcatatcagtacaaaggcagctgatgtcacttgctgggcttaatatttctgccccttcagttactaattcattaaaaaatgcatttatttgttctaacattgatttattcaatatttttaaaaatttattctactatgtcttggacatttatctatctatctatcccaaatgctatgagaggcactgggatacggaaattaaagacctgtccttgaagaacatttagttctgtgaaaaaatggtcatacaatgcaataaggactagagaggagggctgatacaaaccatggtgatgggggatagtgggaagttatgggattataggattacataaaaggttaggcttcctaaaagagcacccagaattttgaaggataaataagaaaaataatattttaaaataaacttttcatttcagaatagttgtagatttatagaaccactgtaaatattgcacagaaagtccctatatactgcatacccacattttcctgctaacatcttgctttaatatggttcatttgtcacaaagactaaactaatattgatacattattattaactaaagcctatagttagttcagacttccttagtgtcttcctagtatccttttgcttatctgagatcacatccaggttaccacactagatttagttgtcctgcctccttaggctcctcaaaacggtgactgattgtcatgtttttattgttttagatcaccttgacagttttgaggagcacgaatcgggtattttgtagaatgtccttccattgggatttgtctgatgtttttctctcagattacattggggttgtatgttttggggaggaagatcacagaagaaagtgccattcttatttacatcatattgagggtatgtgctgtcatcatacccttatcattgtttatgttacacttgatcacctggtattagtgtttgtcagctttttccaccattccatactatctaggctttgtatagaaaaatgtcatatcaagaacaaaccctttcagctgggcatggtggctcacacctgtaatcccagtactttgagagcctaaggcaggtggatcacctgaggtcaggagttcaagaccagcctgaccaatgtgatgaaaccccatcactactaaaaatacaaaaaaaaaaaaaaattagctggtcgtggtggtgggtgcctgtaatcccagctacccaggaggttgaggcacgagaatcacttgagccccggaggtggagactgcaatgagccgagaatacactgccactgcattccagcctgggcaacagagcaaaactctgtcaaacaacaacaacaacaaacatacccttttatctccaatacttcccaaatttcggagtggaaggattatttctgatgccagaacctgtagaaaagtttctgctataaaacaggaagacaaatcagacacctttggtttaatcattcatatgattcaatgaaagaggctgtactgcctgagagatgtgacatggctctggaggcccctcttattatgattttcttcatacacacaaagagctgttttatgggctgcagctgcagcaaccattaggaagtacctcataatctcaacagtgcaaaatctgggcagggacagggtgagttcagccatgcatggtttatgcaaggtcagggaggtaagccaaagcattaccaattgttaattctcactattccaggggctgaatataccttatctaatttaatttaacccacataattaccatgtgagttaagcatttctggtcctatttatagtgtacaagtgaaagtctcagataacacaaaatagtaagtgcagaattggaatttaagcccaggtgtttggacttccaatctcatgtttatagcatcaaaagacattttaggcaacaatccaacattaataatatgtcacatccattttccaccacagattgttcagagcatgctcccttacaggaaacattcttaagctaagtcatcatctttcctgtaatgggagaaatagtagaagtccatactaagaatgtggaccacagtagaatttagtgatagactgttggaattgctaaagatcagtgggtgctgacagtcagagaattaaaactataacactgttagaggagtaaaaacaagccaaattatggccatgatggtcctcattcaattacactagtaggtagtccacttaaaaaactccatataatctggtctacatgtcctagacacagaaccggaggaaccatcgattccagcttcatgcctatctggtttttgatgaattaatgatccattatccctgtgagaccattcattacatattattctatgttaaaaataatgtgtgacatacatttatgcaatatatactatgtgccaagcatgatccttagggctgtattaatcattatctcatttaattctcaaatatccttccatgtaatcacaatgaatcttatttggcaggaaaaagaaaaaactggcttagtgagattagtgctttctaatggtggcagaattagggctcaaatccaggatattctgtttaccaaggctatttcctttccaataccctgtgagagtctccatgaagaacgataaataatacatttgaccacagtcccctcatttcaccatctaaattccaggtcatagttatctttacacaacttcattagtgaatactgaatggatttgttattacaacagtctgatactcaatattttgaagctaatgaaaaaaagaacagaagggattcagtggatatttggagtcctagaaaaaagaaaaagctttatgaagttcctcagaagtcctctgcttccctcaatgtaataaacagaaagcaaaatgtgcaggaagaaataaaaaagaaaatatcactaacaaggtcactccatcacctgcacaagcctctttaaaatcagcccacagccaaggttcctgctgtcagctcactggactggcaactcattggataactgcttccttaatcctatctttctgcttccttgattctcaaggaagtttccaaaagctggggctgtatataccagaattattgggagaacaggtggtatgtaaggttgcagtattcatttcaactcaagaaaatgattaactgcacagctcagcacaatttggagaagttttcaagtgcaggcagtcagtactaaaaaactgcagctcaaattcccgtgatcccttgaaaaaactggagacagatatgttaaaaggggaaaaatcatgtgaagatgaacggtagagctaagaaatgcaatttttagaattggaaagaattgagctttaaactctagactctatattttttgggcatgtcacttaagttgtcagagtctcagtttgtctatgatggggttataacgtcttcctcacaatgttactcactctttaagtcattcattcattcagaagtatttttttccatagatattatgtaccaggctgcccctgacatttgggatacaactgttaatatattagacaaagtctgtctcatggatttgggaaaggggcagacaataaacaagagaatgagttaaaccacatgagaatttgagatgataacaaacgttcttaacaaaacaaaacagagttttgtgatagatcatatcctgggaggggctggtgaaatatttttccccagcatatcacatggggcctggtttatagcagttattccatttacattttaactaaacacatgcctggactctagtaagtgctcatttcatgcattttctttctatgcttgtgaaagctggtttttgtagcctaaaggagccaatattcactatacacactaaccgtaacttcaactattttgatattatagaacttttactccatattcatcatataccaactacttaaatatgaatatgatccaccacaaggtagaagttatgcaagattaaaaataaaagaataggctgggcgcggtggctcacgtctgtaatcccagcactttgggaggccaaggggggcaggtcacaaggtcaggagctcgagaccagcctggccaatatggtgaaactccgtccctactaaaaatacaaaaaaaaaaaaaaaaatagacagacgttgtggcacatgcctgtaatcccagctactcaggaggcagaggtaggagaattgcttaaacctgggaggcggggattgcagtgagccgagatcgtgccactgcactctagcctgtgtgacagagggagactccatctcaaagagatagacagacagacagagagacagatagatggataaagagtattttactcttttttactttccttactagtctggcctgggaggtaaaatgtgctcaaatagaactgcaataaacgacagtgcattataaggtcctttagtataaaatgttttctgtgtcaagaagtggatcacttgtcatggggctagaggagggttcaagcaggaaatgggttttgaactaggtcttagatttaaaaatgaaaatgtaggagcaaatgctttgtaggaaatctgtttaaaatgtctcatccccagagtttctgattcacaaaatcagggatgggtcccaagaatgtgtatttctgacacgttcccaggtaattttcatgcacgtttccagctatgtttttttccaaacagtgatgtattatacttggaaagttactgtatcactgcaccctcctgtactattatggggcatgaatgaagtatatgcaaagagtgtgtgtgtgtgtgtgtgtgtgtgcgcgcgcgtgcacatgtgcgttcattgtgtgggtacatggaaaatatcagaataatgatgaagaatctttcatacaccatcaggggggtaattgttatccctttcttttgtctctgctttccatcttacacaacatgacccccaaacactcttcttctgctctcttctccatacttcccagacgcatcctacctattataatgttaaatcaatggagtattgctatcaagttgagattaaaaactgctggggtccttagaacctctgtagtctcagagtaatacagagtagatcacaaatctagtcccagacataccagggtctttccttgtccagccatgcgtgttcatcatttccttagtattttaccttacagtgggtcagttaagaaattttaaggccaggggctgtggctcacgcctgtaatcccagcactttgggaggctgaggcaggtggatcacgaggtcaggagttcaataccagcctggccaacatagcgaaaccccgtctctactaaaaataaattaaaaaaaaatattcaggcatagtggcacatgtctgcagtcccaggtacttgggaggctgaggcaggagaattgcttgaacccaggaggcggaggttgcagtgagccaagatcacaccactgcactccagcttgggcaacagagtgagacttcatctctaaataaataaataaataaataaataaataaataaataaataaataaaaataaattttaaaataatgatcttaatattaaagttgtccatcagaggccaggcacagtggctcatgcctgtaatcccagcactttgagagatggatcacctgaagtcaggaattcaagaccagcgtggccaacgtggtaaaaccccgtctgtactaaaaatacaaaaattagttgggcgtggtggtccacatctataatcccagttactcgggaggctgaggcaggacaatcatttgaacctgggaggcagaggtcgcaatgagttgatatctccacggcactccagcttggaggacagagtgagactctatcttaataaataaataataaagttattcatcagataccaagtatcttttttaatcccaaagatactcattgaaagattacataaatacaggttcagacagctagccctgccgggccagagatactgaggagactatgcctaatgatccctcaactgcaccatcactaaattatctgcagcctcctttaatttcagactcttatatcaggatcttcatagcaaaaataattctgatcatctaccaaattaatgaagaagtttattttggcattaaattcatttttaatttgcttcaaataatgtaagttttcaattgaggtagagtttattaaacataaaatactggcagggatgtttatgtatatcttatcacctctttagctcaaagatctcaagatcaaaataacagaaaatatttgtattctattataatatattatgaccaaaaatatcgggaaaacaaatattttctactttgtccaactttcaatgacatattttcaattcttatgtgtattactggaaaaaacaaatctaataccttggccaataagcttgaagtatgaatcaagctttgaaatataatattggaccttcacagtctgctaacaaattatctacaccttggcccagaattgcttcatagtagactctctaaataaccataactgactgttaaacaagtgaatatctcaaaggacaggtaatcaaatgagctctacaccactaacagacaatttttccactaaaaaagatttatttatatcttcttaatgtctgcctcaagccacaaatctatacaatgttagttagcaggagaagctgaaaattaggtgtggtaagaatgaaatctagaaagtcatcttcacgttatactggcttcattttttcttctgtatcttgtaatgtgaggatgtgggagtactggcataaggaaaaaaatgttatgaaccatccttttctagtccgaagagaaaacctccatttgtgtctctaactaccaggaagcaaccttaactctgttcaagagatatcactagactggatctgccctggtggctgacaataaattgtaagctcagtggctcagatggacagcaaacatgtttggaagttgctaaggatggcaacaagagacaacatggaaaggtaaagataggtcatattgatgaagacttcagtgagagtgaaaatatgagaaaggttaatgcagacataaggagagtagagtcaatatactctacactctttaattataaaggagcatgcaataataggaactacgcaataacctggaagtgatctatgcttacaaaatgcatcagatggaattgaaaacatgttcatgatatatcattattgttttttaaattaagtcacaaaggaaggtgcaaaaatcaatctcaatttttgttcaaatatgatttaataaaatataaagatagagagggaaggaggaaaagaaatggatggtgaaaatttatgctggcaaggttgcatagaaaaaagaatacattgctggtagggatataaatttgtttagctgctatgcaaaacagtttggtgatttctcaaagtacttaaaacagtactaccattcaacccagcaatcctgttactggttatacaaccaaaggaatataaattgttttaacataaagatacattcatgcatatgttcctcacagcactattcacaatagcaaagacatagaatcaacttagatgctcatcaactgtggagtagatttaaaaaatgcggtacatatacgcagtgaaatactacacagccataaaaaaagcaaaatcatgctctttttggcaacacacattttctaagcaaattaactcaagaatagaaaaataccacatgttctcacttgtaaggatgagctaaatattgaaagcaaatggacacaaagaagggaacaatagaccctggggactacttgagggtggagggtaggaggagggagagaataaaaatctactcactgggtactatgcacattacacaggtgacaaaataatctgtacaccaagcacccacaacacacaatttacccatgtaacaaacctgcacatgtaccccctgaacctaaagtaaaacttaaggggaaaaaatttagagaaaaattagaaaatttaatgtgaaactgccaatagtagttgactccatgagtagaattgagggtcagggtttcatatagacactttatacttctttagcatctgcatttggaacactgaatatagatagcatggtgtaatagaaagagtctttggagtgagaaacatctaaaataaaattttgtctcaagtttactgtgactttgtaatattacttattttctctgtaccttagtttccttggttcctataaaagacaattatatctgcattgtaagacaatgtgaaaataaaatgagattctatatatgaaaatactaacacatgagagtcattcagtatatgcaatctactattatttctcatattctaagccctgctggaaggaaggaaaaggaatacattaatcactctttctttacctttaaatggaatacttttaagaaaagagaactccatagggcaacagggaaagtcaccctggaaaattaatcttatgactagttatttctgtcttctcacagtatttcacaacctattgaagtcatatgttttaagtaacccatgtgacgaagtggaggtgttgaagtaaggaatggtcaaatgattgcacatgggacagaagaaaaagggcttcatcccatcttctcaagagacagagacaagttttcctttccaggtgtttgccttctcttttatattggatgcttgctcactggccacccccacaaagctgtaccacattttctttcttttttcttttctttttttttttgagatggactctccctctgttgccaggctggagtgcagtggcgcaatctcggctcactgcaacctccgcctcctgggttcaaacgattctctggcctcagcctcccaagtaactgggactacaggtgcatgccaccacatccaacaaatttttgtatttttggtagcgacagggtttcaccatgttgcacagggtggtctcaatctcttgacctcgtgatccacactcctcagactcccaaagtgctgggattatagacgtgagccactgcacctggccggcattttcttactcactcaaatatttttcaaagcctgaaggaattagttactaagttacagtgccaaacaggctactgaaacaaggaagactaggaagtttggtttattagatgaaaatagtttatgacaaagcttctgattttcacacttttacattaagtaaaaaatcctaaccctggggttgcagtactgaccaagctctcataaattagtcaccctggtctagtctacaaaataagaccgtgacatctaaatcctgaaaggaaacacttccatattatttagcatttctgttttcattaggacatgtgaacgtatttaaattcaacattgaataaatataattcagtatgtatttatttgacctccatgtactcaaaactatggcaactgctatgaacaatgtcaaagaaatttaatatcactgctatggtctgaatatcctctccaaaacacatgttgaaatttgcccttgtggtggtgttaacaggtgggactttgggaggtgatggggccatcagggctctcccatcatttgtagaattaatgccattttaaaaaaatgaattaggcccccatttgccctcttttccttggatcttctgccatgtgagatgaagtatttcttcctccaggaggacaacacagcattcaaggcactatcttagaatcatcaaatctgccagcgtcttgatactggaccttccagccaacagaattgtgagccaatacatttccgtttataaataatccagtctgtggtagtctggtatggcagcacaaaacaaactaagacaaacccttactacaagaagcccacatcctcattaattataactaacatccacgcagcacttatcccaatttttattacctgtttttttaacaatttaagtatcaaattttggcagacatggtggctcctgcctgtaatgccaacactttgggaggccaaggtaggaggatcacttgtgtccaggagtttgaggccagcctttgcaatatagtgagactatgtgtctacaaaaaatgaaaataaaaaattagccaggagtggtggtgtgcacctgtagttctagatcagggactgagaaagaggctgagacaggaagatcacttgagcctgagaggtcgaggctgctgtgagccatgatcatgcaactgtactcagcctgagtgacagaataagaccttgtcagaaagacaaaaacaaatccaaaacacatttgaagtactataatttttagccatatatcacatgacgaaagtgtttggtaacccttaataaacacacaatgtaatgatcttaaaaaggaaagatgcctcagtacatctctaaaagaattggttgatttcattttgttagtaatagaaaattaaattaaccttttctgttttttaattatactttaagttctggagtacatgtgcagaacatgaaggtttgttacataggtatacacacacgtgccatggtggtttgctgcacccgtcaacccgtcatctacattaggtatttttcctaatgctatcccttccccagtcccccacccccctacgtaccctccctgttctccttcccatgtccatgtgttctcattgatcaactcccacttatgagtgagaacatgcattgcttggttttctgttcttgtgttagtttgctgagaatgatggtttccagcatcatccatgtccctgcaaaggacgtgaactcatcttttttatgcctgcatagtattccatggtttatatgtgccacattttccttatccagtctatcattgatgggcatttttctaaccaaaacattacagaatttgtaacacaaataagcttaacatgttaatgagaaaaggaaaactacaagttatctggtagaaacactgttaaaaaattttttggattattctgtcagtataatatttgaaggaatcattcaatataataggaaataagctgtgataattagtgacataacaaagtcagataaattaactcaaccatacttagtgagaaggttgatagaaaacttaagtctccttaatactagtgctttgttcttcagattctggtataatttgatagcaggacatatacatacatatagcatatatttcaataaatctatagaatgcttttctagttttctatcaccagcactctgaacattaacattacacatgttaaaatttaagcgttgagtttattgaggctttcttcaagttttcttaacaccagaatgctgtatacttgattattccagatgcatccctaatgagattttacaggagtcattgtggttgtgcatgaaaaggatgaggcctactgaaactttttatttcctaaatgccttatattaaaaagtccttacatctcttattcaagatttcctactaaattgtttacaaaacttccttgctgaataatcacggtaaggtggttagctgggtagtagacactaaggaatgctgggtttccagggaaacagtgccacgggaagcaacaaaagagacaaccaaagctgtagatgtcatattacacaacattttattttttactactgttatattgttatactttgttattcttgctttttccttctttctgggagacattgtctctctttaagaactctaaaattgacaccaataacaacacacaaagcatgacattagtataaaatctattaaccagaattcatcttttttcaaaataatacaatgacaacgggtgcaattatgaaacgtatttttttgatcagctgaccctaatgtacttcctaaatgataaaacttggatatttgacttcttccctaattcttccagtaaaattctttttcaataaaagtgtcttcagaatgattggcctttataagagagcccaaatgctttttttcttatacaatatattgtgtctctttggctttatcagtggttacagagctttgtggtaatctcaaaatatcaacaccatccatcctggggaagtattttctccagcaaaaggagaaaaagcaagacagaaacaatcataaggccatgtgaggttgactttctccgggagcactttgataaatacgttcttttatttaatgtctttgtgccttcatttcctcatctggtaaatggtaattaaaagtacttaactcatagcattattgtaaggactaaataaaatagaaccacaatggctggaacatattaagcagttagtattagctatgacaataaaagtaatcatatatttaaagaataactctttaaaaatatataaaaacaaagtccttaagatgggttgtttgatgttctcaagttagtataaaattgagaatcttaggaacagatgatctgattcaaaattctatgatcttatgccctattatacttaagaacactgaattattggtaaaatattctaatactatggacaaacaccctatagtttacatgcgtatttgactaactagtccatggtggaagtaaaactaaacatgattctaaatataaatgtgtctaggaggggaaaatttatccaattagatgatttaaagaattattggaagagttgaaataaaaattacttgtagagttaagagtagaacttatgaagaaagattaaaggatgatttaccttagagttgaggtctaacaaaagtttagtaaaaatcttactctggatatatggacacattatatatttaaaacttcaaaattatattttgtaggacaaaaactttatttcaagaacaacttaaagtgggatatccatgggaagggataggcacaatgttttctttcttaagccagtagtaagatgagtgtttttatactaactaaactttttatgccagcaattatttatttaaaacacttacaatattgctattataagtaataaatcttaaaaactattaatatattttcaagttgtacaagaatttaatctttttgattatttttgtttttgttgttattaagttaattagattttttaaatacagagataaatatcacatatttatgttcctttatgtgctttttggaattgtgaaaaataaaaaagactctgagggctcccaaactggcaatgttgtggagaaaagacaggatattataatgccacgaataacaatgtccataaaaagtatgaataacaagagaaaatgtgctccttacaatgctcagtaaaatgaaaaaatgcaaacaaaaacatccaatattatgtatatagctgcttttttaaattgtgcataagataattagaaatgatgataaaatgttaaaaggttttatttctgttgcaatattagtgattaaaaaatttttcttctcttatttcttttctaaatgttaaataatacctagctattaaatcacttttatatttggaaatcatgtatcttttaaaatatattatttgcatcctccttattttcacttaatacatatagtttaagttgttctcagacaccagaatattaggagaataattcaaaatgcaaagaaaggactcgagaagttacagttgaaaccatggctaggccaaaacaaaaataagaaaaatagtattaacagatagcatttattgactgcctattatatactacacatcataaatattgcatacatatttttaaaaatactattaatttaatttgcataaatattttatgtttgtttaccattattttcattttctgtgacttggtttaaataaattaatgaatgcaatgtgctcagaaaactgcctggacacctgataaatttcatgtaattgttttctagcagtagcagcatcaatcattttacaattgatgaagttgagatttacaaaggttaaataagttgttcaaattctagtttatttaaccatagagtctagatctatgtccttaaacacagtgataaaaacagtaaactaaaaaaagcatataatatatatacatacatatttcaattataatagaacatacatttgttgtgagaatgagtgccttaaaataaatattatctgaatattaagcatattttcccaacagtaccctggcaccaggagcctcgttctgtgcaagcactcctactcaccagctctgtgaccttagacaagttgtttaaatttcctagacctgagtttcttttctaaaaatgaggaggttaaaaaagaacaaatactagcaggaactaacatttttgaacccttattgtgtgccaagtattacgctaaattaatgatcacaactgtcctatgagccaacaatattgataatcatcccttttttgaaatgtggtaatttaggcatagggaacttgcctcatttccacagcaaatagtgatggaccagcaaataagataacacctggtatttaaactcaagtgtatctgaattcaatgtctgcactctttcttgatgactactcagagctcccactgttagaaatctcagatctgtcccttccagatctgaaacttaatgaatattgttaattactgatggagcataaatatgtgaaaaaggagtttaacttcttcccccagccaatcaatatctcactatttttgctgttataaagacaccattaatgaagtctttgattagcacctaatttccaaagtactgtactcaatattttgtaagaaaacttaaaagcctagtccaagtgcatagatcttggcacatagtgagtgttcatttaataattaatttatcaggcagtcttacacttacaaagtgcattaactgattattcaattgaccatcataacaaaacattagtacagaaagtgcaggtacagccatctgtcatcttgcaaatgaggatctgtgtatttataaaggttaagtgagctgcccaaggtcatcccaaagtggaaaataaaatatggtttccagagcaattccaagattaatactctttccactgaccttgaaaccaaattgtttttattttataaaagtatcagaaacaaagttttacatattcaagctgaattacttcagcattaatttctgctctttcttaggaatggttaaaatttatttcatttgcctatgattagaaattgtgtacaatctacaaaactccactcatgtccactttagtatttcacatataaaatgttgaatttttaaatttttcttttttgtgtttctaaaggacatttttttatccagctaatggctcaagtgttatactctcttcagcctcttcaaatttttaaattgtatgcattaattttccatgtattgatagattgaaggtaaaagcaaaagtatgtaacaggttttgaagctaggagaaaaatttccagccaaacatactcaaattactaatctctaaagtcacaaataatgcagtctcctttaaaaaaaggtacattccaaatacgtgaaagcaattcaatccaaacatcaattatattgattattcaaaagaagagaaaaagtaaaaagctaagactcagaaaaaaacaggaataaaaataagattgagaatttcaaaaaagagacagatatcaagaaatatttgagattatgaatcaattcagtcaaagatgttaaatttataccaagaaaaatgtagcatggttaaaatataaaaagtgtttatttaagtctttccagagttccacacagataattagataattattatgaggtcgaatagtcctaaaaataaattgtttcactgttaaataagccagagaatatcttaattacttattatggattttataggttattgtttaaagttgtatgctatatctgtcagtgtggaagatttaaaatctcactcttttataaaaaaagatattaatggtgtgcaactcagacttcgtatctcaaagggaacagtactgatgatcttcatactgaatcagagccattcaatagcataaacaaaaaggaattacttactacaccatctacggtgctctaaatgatataaaataacattatattaaacaaaaacacgacacaattttttttacttcaaccaaagctatccatacatattctattcatctcttgccatatagataactttgtgagtttctgcttacatatgaacatattctttctatgaggggaaatgttctatttttatgcagccatggctttgtatatatctgagaaaactcatgtgctagcaagtgcttccagttcacttttttcacagtatctaccacagagctgagtacagagtatctacccaataaatatttgtagactaatgaataaaataatttatttgtggtagtatcacatggacctcaagctctatttggtgtgctttcatggactatatatttgcattgaaatgcaaatatctgtatttcattgaaaattatattttgtccaaaaatttctctcaaaacacaagttttaggttatttttataagttcaaaatcttgtcaaattaaagtactaccaagccctcaaatccttttttttttttttttgggagggaatgtattaggtataagaggctttgctgttatcaattttatataaatacaaagtcgtataatattgcaagcttgatttttagcatatgtattttaataaaacctatagttttaacataatatataatggaatctatagttatttacatgtttttgtatcctctgagcaaaaaattaatatcagttattctcatccaaattataagaaatgaatgaatgtattgagaattgaaaacagtagaattcaattttattacaaataatataaccagagagtataatatttctgtcttcatgtatttcctgttttatgaaatcatttccataaaaacatattgtcaacatcatttgtagcttttattatactttaagttctagagtacatgtgcactaattccataaaagtgaaattaaactgacatgtacttcagtatgtcttacttaacttttatattttttcagcttctcaaaggataaaatgctatcatatgtaattcagtaatatatttttcattaacaaaaatggcactctaactttattagggaaagtcaaggattgaaatcctaacccaaatctagtgaaggtcaaatatatgacagttgaaaagagggtatataaccaagcaatatgaagacagtttctgaagaaatcattaaaaatacaaataattatatttttattgttcttgaggaaaggaatgcagaaatatcttttcattctatttttattctatctacttttcattgcagctatgaatgagactactgactttcaggtagtattaataatatattaataacagcacgaaaatccaccttgatatcactttatagaataaaggaactttgacaatttctgaaaataaacacttcataaataagttatatattcattgttataattggaactacaacaatctggcagagcatttaatttagttttcaaactaatgcagcaattaaatgtaatctgcctatttcctagggtccatgttattttttttggttttaaactcaggcccatggcatatctcaatgtactacaacttgtttctaataacgaagtttctagttggagaagtaaaggcacataagcatgtccaatttgaaatttacaaagaagttatctatctactgcttgtacctatttttttcactataaaatttgcttatgcttgttgaaaatgtaaaaaagaattcaaaagtacttgaagtatagcgttaagtttccatctttaatcccctctagtttcatctcctacacccactcacatcaaagataaccatgttcacagctctggaactgtccaggccttgctcatcttaccacagcataatgcctctcaacatatatcaccaattggaggaggaaagcgtggggtgtatttgtacttatgccaaagcaataagcaccctacctttttcgtgcaattgcaaacttatcttctaaagtgaaaattagtaagagtctaaaattcactacatatattggtaactttcctgaccaattctccactccattatgttgtcaattataactgggcaatgatgaattgaaacatcatttatggtttttttcttcaaggccaagataaggcaagacaggttcttggcaggaaaatttagaagatacttactgaatgttttctgtgtgccaagcttgatactaagtgctttatatttagttttcaaaacaatcttatagggcaggtatttttatctcaatttgataatgaggaaattaaatgtacttgtccaaagtccctcaactggcaagactattaatcagtatttgtactcaaatttgccccaaagtccctcaactagcaagactattaatcagtatttgtactcaaatttgcctgggttcatcctactacttaaatgagaattatttcaaagcgtcaaaaaacagattccaaagatatttttgcaacaaactgtgaatttaagttattgcactgtaggttacttatttcattaaactacttttataatacttttaaaagcacactctcatatattatcatactatattttacccatagtatttggtccaagcttctcattctcaaaagaagtctaaattttagacttgagtatatatcaaatgaaattattcatataatttttgggacactcagagaatagtggaagactgccactttatatatttaaacttgtggcttattacacgtagtgcacatgtggtgcactatgacttgtttatatagccaaaaagttatcttgtaaatggcacaaatgccttatattttatgtgcttgtacctgtatgtctctgtgtatgtgtgggggggagttagaaatgttaatttgttaaatgtaaatgtttaatgtcaaaataataatatttttggcatttatttcttagtgtactacattgggatattaaaaattaaaatgctcccagcctgtctttatcattgataaaaactaggactagaaactcgcctgacctccttgtctagtatccactccattgtcctatcctgatgcgtataccatttaccaaaattataccaattatttacataattggtataattgttcaatgagtaacctacagtgcaataacttaaattcacagtttgttgcaaatatatccttggaatctgatttttcaccctttgaaataattctcatttaagtagtaggatgaacccaggcaaatttgagtacaaatactgattaatagtcttgctagttgagggactttggacaagtaaatttaatttccttattatcaaattgagataaaaatacctgccctaaaagacagttgttcaatgcttctatcatttcctaccatgggtgccttgaaatttttgctcgttttaaatgagacctaaaacccatcactccagaaaatataaattaaatgacattgtcacagaataataaattcatgtgtatcggttacatttctctagaaaagtatttaggaataacatgaaaaagagaagtagagtaagtcacttttaaacttttaattttttagcttcaagacacagaagaaatatattttaaatggtaacccacaggctatttatggctatgtgtaactaaggtgaaatttacaaaatacctaacctatgatgtaatacatgttgatatttatattttactctagtctattttaatgtattctctattaaattctgatttcaaccctctaaattggttttacaaataacttatgagttatccactatttgaaaaaaaagaaaaacaccgactagataatctctttctttagaatctcattgtgtgtgtgtgtgtgtgtgtgtgtgtgaaaatcaatgtgtaaatgtaacattgggctgaaatcacattacaaagtcccctaaaataaatgtatttgactattacacctcttgccaaaacatctcctcaattcaacatttgaatgtttgataaatctttctggagtatttgcaaatgtgccaaaatgagatttcataacccacaaccctgatgaattccaaagaattgcctttcatatataaggctacattatttaacaatatatcctccagctcttaaaaaattctgtaccatattgcttcctgctattattggcatctgaaggacagagtgtggagcctgtgatggagatgtaaatagaaataaccaagcacagtctgtgcttttcatcagactcacaaagaggtcttctgtgaggtcaacttgttaccacaggcctcctccttaatttgttttcttttcactataattaacccattccatgggaacaaggaaaggtgctgctttcaaagctagataaaaagacacaaaaatatgctcaaaagatactctcagtggagaaacaagtagggttttttgtttcccagggaaggaaaaagaaccaggtgatgtccatcctacttttccttggagccacacctactccaatgtaaaggaatgagatttagatttgtttcaaaggagttggctttggatctaaatccttgctctgccactaactttagctgcagaaaaaaatcactctttacttgtccattctactaaaatggttaccttatcagactgtgttatgaaataaacaaactaaccaaatttaaaatatagtatatatggtcaggcgcggtggctcacgtctgtgatcccagcactttggaagtccaaggcaggcagatcatgaggtcaggagatcaagaacaccctgactaacatggtgaaaccccctctctactaaaaatacaaaaaattagctgggcacggtggcacgcacctgtaatcccagctactcgggagactcaggcaggagagttgcttgaacctgggaggcggaggttgcagtgagccgagatcgcgccactgcactccagcctgggcgacaaactgagactccgtttcaaaataaaaaaaaaatatatatatatatataaagtgattatgtttcaactcacaaagtagtaagatcccaatggcaactgattgtcaacattgggaattatcagaagaacaaatagtccaacatcgttctttcctcaactgaggtttaagtccattttccagagtcctccaagtgattgtccattgcaggtttgtgcacaaggagttacagagaactaactcactatctcctaagagtggcaattcctttattgaacagttctgctaataaacaaaaaaaaaattttttaaattaaaccatactttgttactcttgtattttagtaattagctgtctctgtcaactgctggccagagtgaacctagctcttttccacctgaatttacaaatatctaaataaacaaaatatgtaaatatatcagatacctaaaggtagcagtcagggccctgctgtgtcttgtcttctctctactaaatttattctgaggatatgatttcaaattgcataaccatttgggctactctcctttgaacaggccctgcttggttgcatttgatattggtcttgccctgtcacccaggctgagtgcagtggtgcaaacttcgctcacttcagcctcaacctcttgtcctcaagtgatcctctgccacagtctcccaaggagctgggtgcacaccaccatgtctagctaatttttctttttctttctttttttttactttttgtagagatagagccttattatgttgcccaccctatgtccaacatttaatgtagcccagctgtagtctgcagaagtttgagcatagcaagtcacagaaacttagtcttgaaagaaatctgtacgaacattctttgtagtgcctgtttgtataaaaaaaaaagatgcaaggagttgaagtgactttcttggagtcacagagtaaaatccttagttctcatgtcagttatcttacttttagcacagttagtaattttaacttatttttccaactccaagatagcattaatgtaatcatcatattttatctattcactatcaaattaacaggataatgaccagacttacagaagagcctgcaaaaacaaaaacaaaacaaaacaaaaacgcttccagataaaaagagatgaggaaaaatgataaataagaaagaaagacaatgtcggttgtcgtagctcacacctgtaattccagcacttcaggaggccaaggcaggtgggagtttgagaccagcctgagaaacacaataaggcctcatctctacaaaaaattaaaaaataaaaattattcacacgtggtcacatgtgcttgtagtcccagatacttgggaggctgaaccaggaggatcgtttgagaccaagaggttgagactgcagtgatctatgaccatgccactcttcttcagcctgggcaatagagagagaccctgtctcaaagaataaaaaagagagagagaaagggagagagacaaagaaaagggaaggaggataggaaggtaagaagttataaaggaaggtaggaaggaaagagaaggaggatggaagaaaaggaggagggaaggaagaaaaaaaattctcaagatactccctctagagttttgaggatctctattcttgctttctcttacatgcttgcttagtttatgttgggcagaatttactgtgcataatttgcttttcattctgtgttttatgtgtttcaagctgtacactggaacataaacatctcacagcatgccctctcattccccagcattccttatgcagaagcaacttcaacagaagtggctgaacactataaacctagaagctaaaaggttttaatgacatctggaataagagtgaccaagggaaaacatgcatgtgtgcagctgccatccataagatgggtaaatactgaatacctgataggctacatcctaagagatgatcttcacatttaggtaagcatctgattatttagaactgtggaagtgtccacaattgcacatcaccagagatatttctgcattatgggggagcagtgcagtgaaatccgctgaaaacaaaattccttttaactcagcttagtcatcctggacatggagtatttgtgggagttttctagtattttcagcaattgatgacagcaatggtgcctaagagagaggaaggtgggaagctatcccaggcattagtctcttataggtgagccagagtctaagccagaaattgtatcattagaaatgaatctgaatatagaagaaacactgcccaaaccacatgtggatatgtcagcaagctctatatttttctctgaaagaggcaataataactctcttagaaattatttactgagtccatagactgttccttctggaagggaagaggagggaatgcccctctaaacgctctttccagagctatctgtatttttttcactgctagcaatgaagtttctgacagtgatatatgaatatgaaaaactgtttctttacaattagagttgcccactgtgtttcccagattacggatccagatccaacttactaaagaattcccctaaaagtttctgcatcttctaaattgtatatattgttaagtcagtggtaaccaatataattatacaatcaatccataatttcaaagatttctggggatctcatgttttcagaatttttgtggagcaaaggaaaatctttcagagtttccgcaaaccttcgatacgacccaggaaaaggagcacttcatctaatttacagatcaagagcaaattgatcatgctatttctcaaggctaatttttatttttattttttgagacagttttgcttttgtcacccaggctggagtgcaatggcatgatcttggctcactgcaacctccacctcccaggttcaagcaattctcctgtgaaggctaatttttagatgaattatttcatttgtggtcccttctactatttcagatagttattaacactttcagccaattgtttagaaatattggtgccactgagataaagggagagtgaataaaacaatgcaatggagaggtagaaaaatggcaaaaaggaacctgactaataatctccagcaatgttttggaaaccaagttctggacagaaatcttgagttccaagacacaactctgcaactaattatctgacaagcaaggtagagttatgtgacctttctattttagtttccttaaccgtaaaatacagaagattaaatgctggcctgagacacagtgttaacattctatggaatgaatagtaatttatgtgtctttattattaccatgatcatcccaaaatttgttttaactctcagcactgttcaattcctggagaaacaaaataaagtccttttaaaaattattcagtagcttccacagtaccatttattatttttccaaggtaaattgtcttgtgtaatgataattagtagaaatgctgagatgggaaaagtgtactcccagtttttagaagtcaaacaagcatatagactatgaatcatactgaagttccttcaatcaaagctggattgttatcacatttttaagtaaataactgatgggaagtcatattataacctgaaattgcaatctctaggttaacctgaagaccatatcttcaataatgtatgctaccagtacaatttattggtacatttttctccccagaacatcactgatttgttttttgctgtaacaaattaacattcctgtcattagacagaaataataaattcaagaaccagtgaaaacagaaaatgaagtgtagcgtgaacaggattttacaattaatcaagggagtcattttgacacctcatttttataaagaagcaaaactaaaaacttacaagtgcctgctatttatccacatactatatagtcataaatggtgagctacgtacttcactaacacaaattcctctattcagcaaatagtctttgagcacatattatatgatgggcactctaataggccctgtggatatgctgtagattttcaactaaagtcaggaaaactagtgaagtgtgaaatcttgtcaatcacccaggaagtacaatataaaatttttttttgtataaaacacaatacaataattacttttcttaatgaagttgaactagatcaaggtaaagaatataataatgaaatatattcaagcgcttaactatttgaaacattcagactttaagggaactatcacatctctagccacagaagtataggcaaagcattttaaatattctttcttgcccacagcatatattctgttttatttcatattcgaatttcaagaatattaatgcatgttatttttttttttttgcttttgaagtttaagcaatagtatctgatttgggagaagggaagttagagactaaagtgagagggatgagtatgtttatactggactccatcctgaaggcattttttattgctaacaataatagtcagctgggtaatgttgagggtttcagctgggctcaattatgtgattgcaattagctgtgggttggaaaggcaattttgttgatctgcattgcacgctctcacatgtttgaggtcaactggtctaagatgcactcatttggaaaacctgggtgctctcatacttcacagggtgacaatagggttccaacacaaactaggaagaaagttctcacgtcaaccaagtgctattggtcaaagtgtcagaaggccagtgctacatgaaagtaaaagggaattatcaagtcaaaagcaaatgatgtgaatacagaagcaccattagtagacgtcatcaatgcaatctgccacactgctaaatgggcaagcaccatcaatcctgtgtcatcgtgggcacatgtatcaaggtttgcaaaagtactaaggcaaaggaccctttacatttccttagtgcagagagagttcttactccattaaaagaagtgattttacttttcttctgagtcattgcatattcctttcctctgcccagttgaagagctagtttgatctgctctttaaaaaatgctttcttttttcttcttcttctgttttatactataaatctctttgcctagaagttccaggcataatttctgtgtaatagaacaagccacagtaaatacccagtcacacagcctactaaagccataaatcacaggaaatagcaagtgtaagagattaacatcgaagctgaaacccagttttccttgtacactcctctggaattctgtgatgacatacactttcttgaaggaacatcttgtggtacccgtgacacagtacggttaggtttaagtataaaacacataggcaattaggagaaaaaatgttttttgaaaataggaccacatcttttcacagaccttaatggttcatgtgaaagcatttggaaatttccatactcttcaagaaagagaatattgatggaacaaaggagaataattataagaatatgaagataaattatcaagtactgggattaattctcctaatgctagagaaaatcacctcaacccagtgagaggaagagactggatgataactgacactatcatttcatggaagatcccaccaagactttctgaaaaaccaagtggggaggaaaaaaaaaaaaaagcatgaccttagagagttcccacagtacccaacaaagctgtatcctgtttgactctcacttttctgatcctggaggtgagtttcaccttgtgaaaattcctaccatgccattcttgtactgataaatcataagacttaacactacataacctcgttattcacatacttgcttgggatcaaagcaagataaatatttcttgacacaaccacataaacagtaagcaaacgagtatttcttccaacctttgaatgtccaattccaaggtttgttctctcctgaatcctggtggtacaacctaaatattttgcctgaatttggcattgcaatttctattgtcttttgttttcccacaaatagaatgttttcatgtaattgttatatttcagtaggtaaattatgtatttaatatagagcttaaagtgtatgtatataaaaattatgcataaaatattccacctcatttcttaacttagatttcttctcagaagcagcaactcttagtagttttgctcttctctgagaacaattctatgaagatccaatcaaattgtttgcataaaaaccccttttagaaaaaataaaatgttatatatacagaaatgccccttgttttattcacctaagatgatcttggaaattataatcattacctagtagaatgtctcacttattttaatagctaaatgataatgcattgtttgaatacatcataacttattttattaggttattagattgttattggggtaaatttaggataaaacaacagtttaaactagtaaaagccaaaggtcatgactaagagtttcacttggggcacaattgaattagcacttgccacaccgtgaccaagcactgatcttctgaagctagaagggagtccctaataaaatgcatgatttatttgatgcaaaccaaaacatacctttacaattggccttttcaagcacatttttactttctcacctagtcatattttcttatgcttttcactgaaagccatccctgctaattttcaccaattgtcagtattcttcttgttaaatttcaattgtcaaattccatttccttctgtaagattcccaccatgacccccataaccacagaggaggaggtgatttttttctccatcaatttcctttagagtcagatttgtaacattgtgtcattttgaattatgattatgtaagtatttgtgcatgcctcatctcctttgccagattgcaatcccactgaagtctgtgatatagaaaacaaagggctatcattcacaggacggtcagagagccttgcatatgtatttgtgcataatatgtgttgcataaatatattcctaacctctgaagtggggttagtaacttaattccacattttaccagaccgaaatatttggactatattgatatgttaatgcagaattttaagaatctcaacaaatacaataattcgatgatttataaaaagtattttgtatcttcttcagtattctatagtgtttaatatacacatttttttttttctagaagaagagctgcataacaagcgagtctgcccatttgggtcacaacctctgtaggtcaaaacaaattttttccaaacagccatggtcaagaactaatgatttttaaaacaccataaaaaacaaagggctacttattattaactattataaaacatcagtcagatttttctttcctcactattcttggagcacaaagaagcaataaattttaaaacaaacatgttgaattatttaaaattatacttctcaaatatgttctatacaaggataaaattaatttattcttatctccattttggatttgaccatgaattcttctgaaaaaatagctgtaagaccaaactttttggtaattctctataacaacacacctaggttagaactggctactaccttcaatcctatgtgtatttatgtgtaccttgctttaactattagaaacaataggcacctagaacaatcgcgaaatgacaaaaatatgaggtgttcaatgaagatatagagacttgaaaacctctagtaatgaatataaaaaatcattagagtagaagtataatatagcatcagtatagcagaagtaaataatgtaattcacaatgaaaacaaaattatatttcaccaaatattggccacatacacccttctgtagtttaagtctttgtctctctagatatatgccatccagtctgttcttatagtactggtataactcggacaattcaaaatatccaaaataattaggaatagtttactcttcccaaacctgaaattgtaactgttgagtgcataataatatatactcgatgtatgcaaaggaaacttaccttctgtgtgcacggctgatacataggtccagttgtacctcttcactatgtccaccatggcccttgcctgctgagcatctgaaggcacaaccctcatgaaatatttgaacagagtcttgtcactcagatccatgctggttgctgagtaagcaatctgaggtatgttgaaaagctggagcaaattctggacctgaatggctacagaactggagccaggcccaatgacccctactatgggcttcttggagcggaaggaagaggaggagccatccacacagcgtaccaagccttcttcctcttctgaagaaatgagggaatctcttatgaactcaatgctctgctctagggccacagccgaatgccagcaggagtcccttatctcacagcccagtgtgatgttgggcaagagtgtggggtctgaattgatcctttccagggtatgcagcatggcctccactctctgaatgccatactgttcacggaccgccccacacttcctctcatgaactttgtccacagtaggctggtgatgaacagaaaagagagctccaataatgatgtcacccggcatgtgagccaccaccctcctctcactggactgtgcactcccacggacatcttctttcaaaagtaagactgacaggatcaacagaaggaccattttaggaaaggagttcaagccaataaagatagcatggtggggaaaattcaggagggttctgatagctacgaacaagcgatgtcctacgttgagtcgcaaatcaagaaattagccagcaattcagatgtattttctaaaggaccattttgtccccatgtaccatttagttagatgatccatgtggtcatgatcttctaaacctgaaaaaaaaaaaataacatgggtctttaacaaacataaatgcaactagtttggggaagttctataatccatgttagcagagaaaatattttgatgatgcagataacgaagaaaaaaaattcaaaaacgtttctgactttcctttgtctgcttcctttgtgatttgatgaagcagctgatgtagcttcttgaccctgccttgcttagattaatagtctttttttgttcacctgcaatacacaaaactaaatcttgagtgtggcaggcagaactgtattgtaatctcaggcagagatgacagagcatcctagaagcaaaactacgccatgaacagaaaacttcaagaagtatgcaccccagaatattaaacattggtgatctcttggtaatgaaagtgtggataactgttgttaaattttcattaggctttcttttcttttgaaatctttagccttgagcatgtaattaattatgcaattacaaaaataaaattatcttttcaaaaatacctcacatattctctctccaaatacaatgtcaagcaagttgaataatcttctcaggaataaataagtattgtctaattaatgtggaagatataataaaaacaaatgaagaaaggtgggtgtttcatgttaaataaactgtagaagagaaaggaaaaggttggggaattatagagtacaacatcccccaaataggctgcaaggaagagtcaaattagcaccaatttttagagaaaagaatattcacatttcaatccctgttcttatattaagaagtattagtaaactgtttaacctcttggtaccagaatttgctcacctgaaaaatggggatactatgtgctaggctgtcccttatgggaatcaatacaagatatcaacgaaataaacgctttacaagttaaaaagtgctatatatattcaaaacaacatcttgttgttattaaattttcaagggcattttgtggctaggtcatgaagacagaaaattctctggcaacctacttggtcctccagagagtcttcaaagtaattacacagtcttgcaatacatttcacagtaatcagtcctctagccctgatccagaaaaacattccacatcactaaggctcaaaggctaaaaggatgtatgtttggaactattctgccaggtagaaatttagtatagctatgaatgtcatcatctatttcaatttaaattcctgggaagaaagaaattttgtcccaaattttccatggcaaattctagcataatttgtaaaagagaattgacaaattagtgatttgatcacttaggggaattgtgtaagagacttactttgttatcaactttgccagccaaggatctcaaattattttaaagtgactaactttctaagcaccaactttcaaatacaggtgatgtttcttcaggaatgtatgtaaatatcgcacttttacaagaatactaatggtttcaaaggtcatcaaatctacaaaaagttaagtccagacacaaaatgaatgtaacttgaatcatgtttctaatcactcctaccatcattttcactatttccttctactgtttcctatggcaacagagaaagtcttcctatgtacagtgacaaaagctaaactttttaatatttcatcaaataaccagatgttccagaataactagacatttgggaatatatagaaaaaaatagttttggtacaaaagttggcattgtagatacagaggaagaaatgaagactgttagatttttcattggcaagtcatttgaatattaccaaacctttctttcactttccttagacccaagcttaaaataattattctcatggtcatgtgaattctgctgcagacaaaaagaaatatctaaagttaaagaaagcacaatttcttattaaatcagaatgttagcgagtgaacaaataacaaaacacgactcattttttatgtaagaacatcaaagtgatatgagagacctggtgtcctgtcaggctcgtgtggctgaaatatcaatcccatgcattttattcatttaagttgttttatgaaacccctacatattgagatacagtatacatgttaaaacactaagatattgccttttgaaggtatgcgaagtttgttacttatttaacaaaaaattattaactattcagtgaaagagactagtgtaacaaagaactgtaataatatacattggtaagtatcattattatctttcattgagcacctaacatgccccatctattcattaactcacttaacaaatatttatggtatgtatatgctataattctgtcctgggaattgaatattcaagtatgagcaaaatatacaagctccctatacttgtgggccttacatatttgtattctaaagggtaactttagctgaaacctggtgaatacaaagaaaaataaagatcaaatggtatttctgtctttaggtctttgaggaatcaccacgctgacttccacaatgattgaactaatttatactcccactgcagaaattctattcaaccctgcaatcccattactggctatatacccaaaggaatataaatcattccattataaagacacatgctcattgcaacattactcacaatagcaaaaacataaaatcaacttaaatgcccatcagtgatagactggataaagaaaatgtggtacatatacaccacggaatactatacagccataaaaaatgagatcatgttttctgcatggacatggatggagctggaggccattaaccttagcaagttaacacagggacagaaaaccaaatactgcaggttctcacatgtaaatcagaggtgaatgatgagaacacatgtatacatagtggggaacaacatactctggggcctgctggagggtgggaggagacagaggatcaggaaagataaccggtgaatacttgacttcatacatgggtgatgaaataatacgtacaacaaatccccatgacaccagtttatgtaacaaacctgcacatgtgcccctgaatttttaattttaaatacttaaaattaaagttaaaaaaagaaaagatagtcccagctactcgggaggctgaagcaggagaatggcgtgaacccgagaggcagggcttgcagtgagtggagattgcgccactgcactccagcctgggcggcagagagactccgtctcacaaaaaagaaaaagaaaaatatacagaagaatgaaataaaggcagtcacgtaaaaaatatgcctacaacatgaagaacatgggaggcatgatgatacaagctgaagatggaaaggcaagaaaggtccaggccatgcaggatgttgcaggctcttataaaaaaaatttaatgttggccaggcgcggtggctcacgcctgtaatcccagcactttgggaggccgaggcgggcagttcacttgaggtcaggctttcaagaccagcctgaccaacatggtgaaaccccgtctctaccaaaaagagaaaaattagctggatgtggtggtgcacgcctgtaatcccagctactcaggaggctgaggcaggagaatcgcttgaacctgggaggaggaggatgcagtgaaccaagattgtgccactgcactccagcctgggtgaaagagtgatactccgtctcaagaaaagataataataataatgttaattacaacagaaagccattgaggagatttaagcaaatgactggaacaattcaatcttagaaaggattattctggctgctcattttcctggataatcaattgaagaaatcttataaagaaacctgtaataatctagcaagaaatgatggtgacttctctatgattggcgacagtagatattgagaaaagtggtcacagtcagatatattttccaagttgaatcaactgtatttgctgatagactagatgtgagtagtaaggtagagagaggaatcagggtctactcctagcttctagtttgacagcctagtgcattttgacagcattaatacagatagggtagactagcacataaacacgtgaggggcagaagaaaattaatgatcttcttttgcaaatgcaaaatttgagatgccttggagatatccatgtaaagatgtcaaacaggaaagtgaatatgtaaggttggactcaggggagagttttggtttagacatgcaaattgagggtcatcaatatataaaatatttagaatgcatgaaatcgcctggagaggaagtataaatattgcaaaggtacagctaaaaaataagctctgctgaggggccagattttggaaaagccagctatgaaaaggagtcaacccaaaaagtaagataaagtgagagtaaatgacgtcatagagggcaaaaaagaatgttttaggtactttatttttaaagacatatgcaagacttatatatttcagagaaaaacgtatccgattcacatggaagatactatattccatgtacattctatacactgaagatttctgacacattggctatgtttttgagtgtgtctgtatgtgtggcatatgtataccaagaatccttataacaactctaaaatgtaggtacaggttgaacaacccctacacaaaatgcttaggaccaaaattcagatacagaatctttcagattttggaatagttacattacacttacttactgcttgagcgttccaaatcctaaaatgtgaaattggaaatattccaataagaatttcctttgagtgtcacatgagtactcaaacatgctgcaattttggaggatttcagatttttaatttttgaatttgggatgtttgaactgtattattttattaccttcattttacaaatgatgtaatgggttttgataagttaaaaactagctgatcacttagaaaataatggagctagaatttatgtctatgcctgttgactttataacacattgttttaactatttcttgctgcctcacagccccttcctaccaaaaaaatgaaagatactaccaatgtccatgaaaacaagaagggccacccagacacaatttgaacatccaagagatatagaatcttacaggagttgcctttcaaactatacattaacgagcattccagggaaaagatgattcagctcatagagacacagaaggtacagtgtgtaggttatctagtacaagtgtatttacattgcctgaatatccaccccaaattatagctcatcagattatgaagcctaatctgatgaggcagatattagctatgaacttagatacctggaatacacttttaaaaaaatcatgacatagaaatgcgaaagaactgtgccattactcagattattataaggttaaatagaaagtcatcttacgtgcaatcaaaatacaagaaatacatagagtataaattccaaatagacctgaaaggaatacatcaaatctatcagcatcactcatgtgttttctataaatgtttattcagtagcacacccttctatgccccaaggatccagttatggacaaaatagatataaagtcacatcattatggagcctgtattcgaagagggtttgcgagacaagaaacaaaataaatacgtaaaatattgtgtgctacatggtgctgagtgtttaaaagcaaaaaaaaaaaaacaaaatgcagtgaagcagtatagaaagtgccagagatataggaaattttgagtaatgtggccaaagaagcataaactgaaaaaataacatttgagtaaatagctaaaagaattaaaggaatgagtcatgcagatctctagagaaacaacattccaggtaaaggataaagcaaatacaaagcccctaagacagacttaatatttagtgtgctgaggagtagcaaacagcctcatgtggctgtagaaaagttaaaatgcagagaaaggaagacatggagaacaagaggtaatgtggtgatgttgaacctgtttggactttaaaagactttggccttaacatttcatgagaacgtttttctgagaggattccaacagcggaggaacacattctacctaaaattttaacaagaataagggcacgaaggcagaaaatgaagagaaaattaggaaacttgcactaacttaggtgagagagatgatagtcgttggattggagatacggtaagtacaagtggtgagaactgctgggattctgaatatattttgaaggtagagtgaacaaattggctattagagctgacgtaggatgttggagaaagagaaaaatcaatgaggacgccaagattttcagcccgaacacaaaaaggatagagtcgcatcggctgtggtggagaatgcggcggcaaggatgtggatggaaacaacaaaacaacataagttcaattttgatatatcaagttgcacatactagaaactcaagaagagatcattgaatgagcaggcagatgtagggggctgaattctgaagagaggtctgaacaggagataaaatgtgaaggtgtgagtatacagaagtcctttttgtaagccatgaaactggattaaatcaccgaggaagtggaaagagaaaagaatctagtgccagaggttgtgccccagggaattccaaggttcaatggtaaggaataatcagcaaaggagactgaacgattttttgaatagaaacttccttttgtgaagtgaggagagagaagcagtaaaatgtgaagtattcatgttgtatcatgcagaaataaagggacggtatgctttgattttctcaagaaatattatgggtgggcatgtatgcatacataaagactggaaacatatacattgacattaatagagtgttctctgggtagtaaaaatatagtacttttaattttattttcttcatctgtgttttctaaatttataaatatagtaatacaacatatttgctaatcattagtatttttaatttggaactgagggatatgctttctaaatttctgcaactttctcccttgagaccttatctccttccatccattcctccttgggagcctattagtcaagttaggctcttgtccaagtatacactgttttattccaatggctttgcacatgctgcttctgatccctgatatgcagttgttccaattgtcttcatagcagagttgttaagagcatgggcttggagtccaatgacctgaattggaatcctggcacagccatttattggcggtgtgtccttaggcatttagcctctctgagcctcatgcctttattggcaattggagtgacagcagtacctaccccaaagagttttagtgagtattgaataagctaatatttaaaaatagtcccttcctaaattattaccatatccctcacctggcagtgtttgctctatcctccaagctcacatggcaatttatttatactttcttatagtattcattaccaagctaatattgtaggatgtttaaggaaaatagcatcacaaaactagagagggccctggagatgattccatttaactgagatccatggaaagcaaatgattcatagcagacctgggacttgaattcaacaaaatgtcactcaaaacacaattttaatcatagtttacaacttggtatcagctcttatataattttcaaagcttataatattttattttttatttaaataaaattttaatatgaaatctctctcataatatatttttattttctttgtataatataaatatctttcatataagttcatttggatgatggggacaattataacaacaattaaaatatacagagggcatatcatgtgttgttcactttgctaagtatctcacatgaaatgacatttagttgtcatacaaactgtaaaataagttatgtatgcacattttacagagaaaagaactgaggctcagagagatacagaggcttggcccagattcccaagcaagtgggtagtaccagagccaagagtcacatttagaacatttatttaattttatcagttgcatggcattcaattatatgtgtgtaccaatatttaattattccttattgttagatattaaggttatttatagatttgtcttaatatcataaacaatgttgcattttgcttgcttttgaaagtatctttgtagcacaattatttaaagatgatatttctggcataaatgtttctcctggtttacaactgatgaatgtagaatataaaagatgatatcaacttcactccaagatctgtctcattaacatcatcaattctgagaactatccaatattctttctgtgaggatctactctctcttgcttctatataagttcctgagtaaggccatttctccttgtggtgagatttctcctgtgcaacgtcaccacaagattcattcattattttaacaagtgtctagtaaaagaaaagatgaagaaaaataccacaatactttattttcagcgtaaagagccttttttcattcttgatctcacatctacctaaaaataatacttctagaaatgtctaagaacaccaatttcttatagtaggaaacaaattctcaagtaaaataaattattttctttaggttatagcttttagatggtggggataatatgtcagtagaaataaaggggcaggtttatcctgtagataatggggaggcattaattcttgtaatgataaaaaagcttttaaaatgttatgatctacagtctaataatatggtgacatttaattcactaaaaagtgggtaaatgtattaatagtttgattatatagtatattagttcaagtacctattttcagaagtatgctttactcagtgttatatttgtgggtccttagcagagtaaattaattactagcacattatagaaaacaatagacatattttaaatacatacaaaagtatttcacatcaggtaaccacacactctcatattatatcctaaatgatatgaaaaagagatattgatggataaactttgccataaattgcaatctacactatataatcagattcacagctcacattgtcctttattttcaacaatcttctaaaatactgaccatctttctggcacagatgtctcttatataacttaatctccacacaagcaaatcacacagctcaggacataaacactaaaatgatttcttctgcctgatcagtggcctcatcacaaacagtcagggctgtcaatattgcatatgccatcaatgcatctgatatatttttctgaaaacaagtgcataccacagataagagacagcctgaggtgcaatgatacagagaaccctgtagtctgaggaaagctccattgtcattactatctcaatcacacatttgtgaccctgtaaacaagaaaatgcagcatccccactgtttagccccacaaaatataggccatattttaactgaaaccccctcaacaaaaaaagggccataaaacactattgtacaaagatgaaatctgtaattttatccattaattaaaaagttctggcagttcaatagagctcactaaatcattgtaaatcatttaaacaagtggtttagcagtctatgaagacctggaacagccttctgcagcaaagcaataaacatgatgcaatccactgttaactagtctcagtttaattataaagcagggattttagacttttacacatcctgtagccttcagctgatttcttgttattaagggtatacctctgaagactgtaaatcattatttatatattacattacatatcattaaatgcttgagaccgtggttttacatttctataacatgatctccacttacttattaatacataatatttataaagtgccttctttctgttaaataatgtataataattatttaatgtaagactcacaataaccctgtaaggtaggtataattactacctatgttactacctctagaaatcgaagtttagaggtcaagaatcttctccaaagtatcaaacctacaataaatggcagaaccaggacatgaatccaactatatttggctccaaagcccaaacttaataaacaaataatgaggtctccccacaaaaaaaaacaagtgaattggttattcaaacctcatgcattgattgcaaagcattttggagattctgctttccattaaattcttatgtaacgtacataaattcatcagaaagcatacaaacaaatcaagtaaatataggaaactctgtttcctagcatcatttagataagggtttctcaacctgagcactattgacattttggagtggataatcttttgttgtgggcggatgttgtctgtgcactgttggttgtttagcagcacccctggcttctgttcactagacgacaatgccatcccctcccagctctgataaacaaatacgtcctcagatattagcaaatgtcgcctgtatgtcaaagtcacttccagttgaaaaacactaatttacatgaaagttaatcctggcaagatcgacatagtcatgaaagaagagcatacctaagagccaatcatctggacccatcagtcttagaaattctctacctgaaacttccaaataatgctaaggagagacggttgaaataggcttgccttactcaatgtttatgcagttatttgtctgtattatcttgttgaaaaggtagaaatttcaatttgagaaagacaaatttaagctttaagagtcaaggttgatattaccttacattaaatatgcatagttctaagtatcacaaattacaagaaatgaatgtgaggagagtatcctacgatatacttcccgaattcaaaggctgttcttgataggaaatgcaaagtttattataattttaacaagactgcaacaataacgataactttataaattaatttacatgttgatttttcattttatttatttttaaacaaatgatataatagtgtattatttacttctatgtctttgaataattctacattactatgcatttagacaaattgtttttcaaaaaatatttttgattattcttctgtaaaatataatgaatgtaagaaggttgcattattaaagtgctcactattatcactgtgattacaagttttcattttcctcagaacatttatactcaaaattttaaaacccatggcctgaaccagcattattgtgaacaactaatcattagagaatttttcttgaatctgatatatttgcaagaccaatagaataatatatacagaaaatatatattttgcatctaagtctttcttttacacttcttctacagtctgactaaaaaaggagatatttgagatagcaattacgtattattttgatttctgattatcttcaagcatttgcatgtttattttaaaatattcttgaatatatgagaaaagtagatatttgcacattcctttgcagaggaagggatgctgactcaaaattagtagaattcaaaaaaattgatatatgtttgtaagctgtaggtcagtatcataaaagtttggaaatcagatgatcctagatttaaataccggctttgtcacctttgtttgtactgtgggacattggacaagttatttaatctatgttagtattatgttttatcattaaagtcataaaataaagataagacacaatccatagggcagttgaacattaaatgtaataacataggaaacgcagaaaactcgacatccaaaggcctgggtaggattgatagtttgcactctgttcactatgggtcagatactttatttttttaatttatttttctctttatgtcttctaaaaaaaatgggatacatgtgcagaatgtgcaggtttgttacatatgtctatgtgtgccatggtggttttccttctgcacctattgctttttttctaacttgtgcaatttattcatcatattcactccatgccatgtactgctataacccatcccccaatttgaaaatagtgaaactaaggtacataaatttaagtaacttgcctaaggtcacacaagtagtaagccacaaagctgagattcaaacccaggcaatttgaagccagagcctgtacttccaacatactacaactcactggaaaccacagtaaaataatcccataatgtttattgtttagccacaccacagagtaaagcagctcaaaacaaaggaaacacggtaaattttagtgccaaacaaatcaaatctctctcttttgcgtatgtatgtatatatatttccattatttttgccttttacatatatggtaaatggtatatatatatatatatatacacacacacacacacacacatatatatgaatgaaatatatgtttccttattttgaaaatgggggatgggttatggcagtacatgttattgaataagtataatgaattaattgcacaaataaaaataaagtgacccacagtgaacactgcataaactatgcactgttctttgacagtagaataaaaaacgtagtttttataactgaaaaggaaaaacaaataatgccttgtattgttgatatgataattaaataaaataacatacctactgcttagcatgatgcctgacgtgcttaataaatagtagttattagagcagggatgagtctgcaccaagacttttgcctgatggcccttctgacaaaagttatatatagttaaaagatgattcagaaaggtaaaatatagattttcatctcctatgaatttaaaggaaatgaaagcaaacctatgccttaatgttttttagaaacacattttaaacaactaagataaaggaatatcaagatactatctcatttacaaataattgaaaattcaaaactaaaaattgaagtttcttttcttgggttatataaatacatcatgcactaaaaatatttcttttgatgctcatgtcttcttatgttctcctaagcttcactcactgactaaaatgactagaattaatatttctctgaatatgaatataacacataacacatatttctaaagtgcagaatcttcctgctttgtaataatacatcttcaatatatccaacctctaaaccagccaaatcagctttatcatataacatatatgtatatcaacatatataaaaagtagtatctaatattttataaagttggtttatacatgatctatctatctatatcgagatacacataaaagtacctcacatgtacgtatacataatacaataagaatgtgtaagataaaacatttgtatatagctctgtcttcatcccatgaggatagaaaacctgggataaaattggtatacaaataaatacaatatttttaatgatcaacctcatctcacattttctacttgtagtaccacctacattttattgacacttaatttagtttctctaaccaaaatgatcattctgtaaaagacaatatagtaagactcctataaaatattaaatgggttttggaaagaaataagaaaagtagaattattaaaatgctttagtcacaaaagtgagcacctttgatgaggtaagtcattttaacatgaaacacaacaatgttaataatcagagccaaaattaaaaatggtatgtagttaatcaagtattcccaaagtctggatagtttttgctggttggttataatagatatgagtgaatttttcaatttccccctgggtgtttgtcatcatgtccataaggtatactataaagtgatagtaaaggcctgtgtctacctatggaagaaaagtgaaaaacttggattattcagataccaactccctctcccaaatcatctcgacacatcctttcataagtgaacattgaagagtttgggctttttgtgagtgtgtagcccgcagccaaaacattcccgtgtgatagcacaaacctctaggggtgcaattaaaatatctagattgtatattttgtcatgtggagtgtaaatgactagagaaagctttttctcttaagagaagctgttatttaggaagtgctatgtacatttttctcctaagaaacttgaaagatctgtccagagtgctgacaagatttcacagggagaaggctggaaatttgacgggacgcacactactaacccaatgagttcaggacgcagtattttcaagtcctaaaccaatggcatgtttaaatggaaataaacatgcataaaggacagaaatagccacaattgattcttacatgtgtaattacattgaggtaactgagaaattaaaggaggaaactccctgcactccataaagaaaacagcataaagcacacctaacaagaggtagcatacctgaacactccacagctgacagtagaatgtcatgcaactaagacttccacagaaaacccctgcttatgtcccactggaggaagggctgcacgtagtcctggtcaatgcacctttggctgcttcaaatggccagtgcccaggattagagacacaaattagctctagctttgtcctgagaaactctgaacaataaaatcccatgtagcgaatggagaagaaggtgaaaaggagaagctgccttctcactggtctgtatcaatttcttattgaaaaagtaaagtattggagaccctatcttggttactcgatgttaacagtccagctaaggcagcatcaagattgtgtctaaataagcacaagcgcttgttatcctctcctaaatttcccttccacacagcaactcctctgaaaggaaatgagggcagctgtaaattcgagtaccaggtgaaagagccctccaggtggacctgtcacttccctggagaggtcctaatgcacgttgggctcgggccaccggctagcctccgcactcacgggcctgccctgggttttcttccctaagtcgctgtagcctgggcttcctccttggcatgccgctcatgcccccgccgtgggataactagcaggctttgtgttcgaggggaaagataaatccatggaagaggaaagagcgggagggctcaggctggtgttcaaagagaggcaatatagcctgagtgaaagagatgtgctttcagcaccacccgctgtcccccctcttcctgcagcaggcgccacgaagcggcccctaacagatctattgaaaagcaattctctgtcctcttttcctctccacctttgcttctcacaattccgagccctcgggtggtttgtgggagcacactctgcattcgaaaccacgcgcacctggccttagagagcgggaactcggatgcgaaggcatgcagaatctccttttcaacccttgcagctcttccctccttcaccccattgctcgcgcctttttccccaacaggtttaattaaggctgttcgcaaatggaacagacttgaatcttgtcggctttggccacccctgctccacccgcgtccccctcccccaaaccacactatgagctactcagcaagcctatagatcctaaatccttctctggccaggggacacttgggcacacagacacttagcaagcttacccccctgttggctgcgctgcgagcagtgagactcggtctagctagccccccgaaaagttgggccacggggatcagcagggcagagccggcctctccagtccccggcttcccccccaagatgatctcaagctcattccctccgctcagcgtgcgcagaacagccgagct

SEQ ID NO: 686 - DNA, 543498 bp, Homo sapiens
atcatattataggttttttaatttttttgaaaagtaactggcttcacaaacaccaagtacaacatgatttagacaactgagaaacaggcaagtatattttgaagtgctaaaataaaacatatttatacaagtacaaagcaaaacaatgctgataaaaatgttaaactttatgaaaaaaaatcatttgcagttcacatcaaaataatttaacattctctattattttaatagtacaagctgccacaacagagaaagaacagatacacgcacacaattttaaaaccaaatcagttataagtgcagaaaaaagtaagtacaagcacttttagcccacacaaatcttttaggattggcaccatctttctaaaacatctataatctatatagatttctaattacaacaccatcagcagctgccattgatttctagaaatacacacaatatacatagtatatttgttcacattgggaagatcagtgaaattcaaccaactattttatacatgcctcattcttcaatagacagtagagactctcccaggcctcagaccctcttcaaagtgaattctgacttgtctttatgctttcactgatctgtattttttcacagtataaaattgtaaatggtaactatagagattctgacagcttgagggttattaataagctgttgctaaatgtgaactcacataatacctttgaagtctccaaaacatgtacattttactgggagactagcataggaaatgcttttgttttttgttattcttaaaaagagcatttaattcctggcttggaagtcacagaactgcagcagagctattatacaattcatttacagtcagaaatagctcctagtcttcctgatcacttgctggtaacagcagtagtttgggaaagatagttactttcaaggattagcacgtttggggatttgctttttttccttgcttcagtcaaatctcttataatttttctttccatactccctttctgttccccatccctagcccagaaagacggttcttcccaatccagatatgttcttcttaggctgcccccactcctttcccaaaatggaaggatgagtggactgcttagattagtcagtataacttggttaaaccacgtcttcttctttccatcctgggacatatctctcatttagggtcactttgctgagccttagcatatccccttccttttagtcatgctggtcccgactgaattatcactgggcaccaggaacagattgttttgaaggaaattcaatgagaatgtacccaaatgaattgtgaagttcatatcctatagccctagaatgaatattcagttctctttgtactgtagagttattacttggaacctggtattagaattggcaaagagacagagttagcatcattccaaaataaaagatctcaagaatgcattactaataatcttatgtccaacatacaatgtattcaatggagtggcaaaagttatagaaatacagagaaaaatatatcttgtccttttctaattggataaatcatttttattattacagttgattatgatagcatgtggaagtatcagatggcaatttacttgcattaaatttaatttctgatgaagttttttataaggtagtgtgctttttaagagatatgttactaaaaaaatagaaaatgaatttgaccatgaacaaagtttaaacatgttcttcaactggtctagagtgaaacgtattgtacttgagaataaaatgaaaatcaacataaggattttataaaacaaattttaaaatgtagagcatatcaagaaaggtttttaatacctaagaagtcaagataggaatcctcaggtgaatgccatccttttgatgaggatccaaagggtattaacacctcaaaagatttccatttgtttttcagatagaggcagacatttgcttttaatgaaaccatgaaacttagctagatttcacttacattttaaaagcctcggtgtaatatttgggatcagggtgctgtgatgatgttattttcaaatctagcatgggaggttcgatttcttttaaattaatactttagtacattaatgttagcttttaatgttttgtattgggaggtttgacttaaagttgcaagtaagaacaaatagcagaaaagaaaactcaagcagaatatttattagaattttttaaagtgaagaatgataaattatgccaatggactgacttctatttctcagtttattttctgttaagtagatgtgaaataaaaaaaaatacttaccaaagtaaggatattgagctaaaagaaaaagttttatttattattctctctgccaaaatatacttctgcctcacagcacatatttttcataaggctatcttaagtataaggctgggtcaactgaactttaaatttataggacacctcctccatttattactatccttatttaaaaatcaaaacatttggtacctgaggatagctgcaatgggaggaagaaagagatgacagtggattcaggtcttgaactatgaattctacctatttgagactatcaaagcacacttgtttctgttatactctaaatctcttttctgtagttttaaaaagtgacagtatgaagtgcacaaaatcatattaatcattattttaaaaaagaaaataagaattgctttgcctctttttggaatggctaagaaagactgtgtggttaatattcattaaggttcctcttttttagtattttgtattgctttgaaaaatctacatttgtcatagttcatagctgccctgtttaagcagccaagaatagttaaaatcactgctcactggcatagctaaatctccactaagctgacttgacacagttaaaattttcagtgtattaagattgtgttaatcctttcaacaacagtctctcaaatcatgacaatgtcttcatggggtctatggaccactcttccagtggtgggactcgaaaagaacaaaggagctctttgtgcatcaggttctcaaaataaaggaatgaagaagccccaatgcatattttaatattttagttggcaatgcaaacgcaacagcattcctaaagagtggccatgtttcttgaaagagatagccaggctggagctcaagaatgatttttataaagagaatttccagctacaatgcaccccagtgagggaattacaaaacagtattccagaaaatattttttttgctactccagtattgattggcaacatggtgaaatagtcaagaaatcttccactggttttcttggttaatggaggtgaatctgaaataagtaggtggaatccccgatgcaggcttttggaagagtatttcacaacccaattggagaggaaaatctctggtagaagccctacgtagtacattagcgcagcactcactatccagtagtgtgttatgcatgggacacattcacaacgcctccgtaaatactggacccaagttactgcttttcaaggtctttacaggaaagaaaaaacaaaaagaaagaaaaaagaaagaaaaaagttgatgttttggtcccagattttgagtttgttagaaaatgtacattcatgtttggtgaatcaaagactcttctgggaaaagaattaaagtaaacaaataaaactttttacagttgcttattaactatgctcttcaccctccgttacgctgtttcacacgcactgcttccctagagcaaagcacttggtatggaactgtttgaagagacgccttgtcagccctcaaagatatcagccgtgtttcttaaaagcccatgttttctaaggccactagaagaaaatctgccaaaagatttgtcgtcggtttcttcgtcggttgtcatgagatagcactactgatctcgtgtttccattaaggggtgcccttggcatcttccccctgggccgtaaccaggcgactatgcttgccattgtgtgtgtgtgaacacggggggctccgctccgcacgcgcaggccggcgtgctttccagggacattcacaacgacgaggagctctgagtgtaatctcttatgataagagtgtcatatttgggagacgacgggatacagagggccgactcggacactggcgagttgggggttgtgctccccgagtccaccgagtctctgaagggggacggcggggtgagagccaccagctcctccaggtctggcttggcggccgcagcctcgggaccggccgcggggctctcccgggccgcgtccccagccgcctgcgcccctgccgcgggctgcgcgcctcccgtgacttcgatggccggcagaggctggatttcggcaaaggtcgtcatggtcgtgggcaactggatctctttggggatcaggtaggacgagcagagcggggcgccgacgccggggctgggggccgcggtggacagcatcatggagttgagctcgctgatgttggccgtgaagcgggtgaccacactgctgatctgctccatgagggagccctgcgaggagctgctgcgcgccacaggctccgagtgcagcgacggcacatcgtcgtccgtgcggctggccgagcccgcgcggtggctcagcgtgctgatgggcgacggtgagcgcggccgcgcgggcgccgggaagtgctcctcagcctcggccacatcatacagcgccttggggccggcgtctggggactcgggcccgcctgggccggcgcctgcgcagcccgcaccgcccgtggcccccacgcccccagcgctcccgcctgcgccagcgccagcgcccaggccacggctctccgtgctcttggggaagggcttgatgacggccgtttggttggggttttctttcttgttgatgtggatggacaggcgctgccacaggtgctgcccccggctgctcttctcattctgggcccacgtgacggattttccattggaactgaggagagaagggagaggaaaggtgactcagcgaggtgcccagggggcttggatgccgcttccccaatggtggttgctcatgggccccggactggggaggacttttctcattctttcaggaaacacagcatcaaaaggacatcatggaaagagaccttggaagtggctttcctttgcttgttttgagttaaagactgctttctatatcagggcttcagtttatcataatcgtgaaaatgtgtcaaaggggatgcttgtcaggatgaaggagtgtttattaggattctgcgggagttctgagcccacctgtgagtgcagcagcacacagatgcaagggcttgcagtgtcccggctgtgtgcacaagtgcctggtacaggacaggggcttcctagagttagtggcctctgaaggaaaacattaccactaggacccaaactcaccaacaatcatcagagaggagggaaggggtaagagagtcagggattaccaggaggtagtcagtggttccagttccgcctttattctggaagttggtatatatataactagggttttctgtctgaacccctgattttgaacatagtgttacttaggctgccttacctgctggaaaataaaaatttaatgaacacacatttctaatgagagcttctttacttcacagaaattcacctcacaaatgtattttgagttctgtacttgaataacagttcaatgagtgagagtgctgtataatgccttcggcacttagcagagtgatctcaaattaggatcctggtgaatattgagggactgacaagttttttgaaggcctttctctctctttctcctttgcacttccaccatggggtctgaaagccactctcaagatgtgattggtgcctcagcctcagcgccctagtacctctccttaccactaaaagctgacacaatagcttctgaagctgcagacgttctttcagaaactttacaaaggtcagagaatgtggcctgacactcaagattttttttttattttttgttttttagacggagttttgctcttgttgcccaggctgaagtgcagtggcgccatctcagctcactgcaccctcggcctctgggattcaagcgaatctcctgcctcagcttcctgagaagctgggattgtaggcatgcgccaccacgcccagctaattttgtatttttagtagatacggggtttcaccatgttggtaagactgttctagaactgctgacctcaagtgatcaacctgcctcagcctcctaaagtgttgggattacaggcgtgagccactgcgtctggccaggaatgttatatgaagagattctggtgtagtttcccatcacaaagtaatccaagatctctgttactagggggtctgttattttcagtcaagacagctctgttctaggggctgtgaccaacagatagccttgagcagcctgactacaaaagaagttgaagactacagttttatcatcacagcctatggttattaaactaaattctgtgtaagactcatctagggcatttgtcaaagatataagatgtgaccccaggagagtctgattgtctggattggcttccaaggatctatgcttttgacaagcattctgttcttctgctcccaaagtaaatctgaagcactttgtttctcagattctttcacaatctgagaaactctggcagaaagccatccttttcttctaaatccccatcactccccttgggcccccttgctggagggctggcttgcctttgaggggctggggcgtgtacctcatttggaatccaccagccttgaggctgcctgactggccctgcaggatccactctgtctgagaaacccactcccttggtaacagactgccatttctgcatcccctttaatgacatgctttttgcctctttccacactgcttcccatttctttatctgttcctttctacttcatggtctttctttctccgctctttcctgtgaaatttctttccatgtaatctacccaatatattgtagtctcatgtccttcagaatcctggaatatgagcttcttccaccccactctgcccttcctggaaaggatgaatgaaccattttcaggtttggaggttgctgtgcatccatagtagcagagggggcactgccaaacagttggtgttcctttctagtagtttcaggatttatttttcaattttgcattagcctgacttacgtgtattacaattctttttcccaggtgtccactagcttctggaacatggcagagaagaaatgggccagtttatttacgagatttgattgggaggatggttgccaactacaccctttctcctatcagaaggataagaaacaggtgtttcgaaaggtacaagtattatttcaggtcactaagtccccttttaatacaaagcatggacttgaaatcaggagactaattggatttattccaccaacttttaccttagggacactcttgctcctagtacagagaggttttgcaaacactagcttttaaaaagtttctctctctctctctcgaatgcctttagttgaacatgatggaacataactttggatgttagcagtaacagtctttggaatcacctgtagccatgccccaaaacatgatagcatgttgcaaaacctctaggtgagtgtgtgatgaggaaaccatcctaatcaaccaattctgtacaaagtattgacatctttttcctggctgtgcctttggttacagtgcccatggccataagggagaaagagcaccagaccatctgaataacgtgaaagtggacacaggaaacaccagacacccagagaaatggagtccaaatgtgagtacttcatttcattcttttgaacatgaaagcttttttttccctgaagtaaatgagaactcttaagaaaaaaaacaaaagaaactccctactcacgacattattctgtttattagtagaaagtacattctatgaagacacagatcttatctatctttttcagtgacactcagcatgatcttaataagcatttgatggatgaataggatttttaagttaacagggccactgtggggtgtcatggaaggtgcaatagaatagagatcctaaaatccggttcttattctggatctgccatcccagatacttggaaaagaataatctttttaagcctcggtaagaagcagacagtgtctcatttggttaaggttgttttgagattacatgagacaatgtaggtgaaaagagctggtaaagagaaggtgtctaaggatgttcagtttttatattttatgtgaatacagcatttcagaaaataaaaagtatactcaatgccattttgaaccctggtttaaggaacagagaattcagtgcaaagtaaaatatttggtaagccataaaacctttcaggttctttctcttttacctgacctggagttccatgatccgtggcctcttcacaccctaaactatctccttgggtgatcacctctaccccattaaattccaaattaacctttttcctcaaatgctttctcattgtgctacatcctctcttcctttttgcttaactgtatcctctttttttcttattttattttaccttaattgtcttgtcttaaagaaagctttcctgaccctgctaggctagattcctatggcacctgcattcaggcatatcataactctttgctatatgtctatctcacctgcttgatgggacattatgaaggcacagatggagggtttgctctttcctatatgcccagtagtacccatgcattgtttagaacatggtagtgctcagtaatatttttgggccaatgattgagtagataaaatgcagtttatttttaaaatttatactgaattgttttcctgttagaattaagtttttaaaataattcagtgttaatgaaactctattttgccttatggatctacttttacttcttatatacctccctttaatcaatagtactcaatgtctacatatttaaaaaatttcattaaatatgaaaatacaaagcttgatatctgccatgaaaatcacaaaataattccttctttataactcatatctgtcttagtaaaattgctcagtggtgaaatctcatcgaggcagtagtgatagtggaaagaaaggacccagattctcagtccaggatctgactcagaatgatgttgagcaaatcacttgccacctttgagcttctttctttattggaaaaaaagaaaagaaaagaaaagaaataaacctcccttgcccaccttgcatgatgtctgggaaaaaacaaaaggataatacatatgagggtactttatagagcatagcccttctgcaaatgcaaggggttattcattaacattaaaccttctattcagttgagctaagatgttgtatttattatttaggctgagatttttttttcagcatccatgttatatgtttgtccttgggggctgaagtaagaaaaatgaaagggaacttttctttacccatctatggcacgtcaccttccctcactgaatattttggacattagaaaaggagagggaaagaagaatgaaggagaaagggacaagatgaaatgatctgccacatctgaggagggggccaaaagtaacgtcttgctctcttccaggcaccatttaacccttttgcaaaatataatatgatgccatctaatgttctctctgttataattatttgctctttatttctgaaaaacaaaaagcagcatatcaataatgttatttgaggattaagttttttgtttatttgtttcattagtttttgtttacattttgggtctgccaaaatgacactttctatctttattctcagaggtttatttttcctgtttttcccttccatatcagaaacttagcaaatttattcattttcaagcagggtctgaatgtcatgtcaatgacctcacccagtttctctattcctctgctcaaacctgcagatattagagtattctgccatggtacaccatcattaggaagcaaacattaatagaggaaaaaaaagtttgaccatcaaaaaagtcaatggaatttataattcaatacaggaatacagtgttaaggtattcacaagtgtgacaaaaatgaggatggaaaggaatgtactgacatgaaaactactgtggaaaaaaaaagactttgggtttttcttatcaggattagaaaaattcagagaaaaagttgttcactgaggaaagaagtttcaaggaaggatttgcaaataaagtggatattaacgaggccttaaagcttggggatgttaaaatagcatggataagcaaatctcaattaatacatgtattgcatatatggaaaggaaactaattctacatgtctaatcccaactcctccaacagccctaagtgacgtggattttcacctctctcttaagtagcagtggttacatgtttccacaataattcccccagagaatctttcttaccaggcatttaatccctaataaattcctggtgggaggagaatcactcgatcctctcttaactagtctttggtttaacagcaacaggaagccttttcagaagctacatgttcattcacggtgggttattaaagtgcttaatggtactagtacagtcgctacttcccctgagtcctcataaggagcaagcaccttaacaaaggagaatatgacacgggagcatatgccaagcattggaattgtgttgagtcatcacagatatttccttctcaaatcaaactatttattttgatccacaattctgttacctggactcagcttcaaaactaaactactctaactggtattagttggtaaagtgatacaaaattacagctaggtacaaggaatgagctctggtgttctgcagcattgtagggtgaatatagttaactataatttgttgtatagtttcaagaagctagaataaaggattttgaatgttcacaacacaaagaaatgataaatgtttgtggtcatcgctatgctaattaccctgattttgtcattacacttggtatacatgtaaggaagcattccgtatcctataaatgtgtacaattattaagtgtcaactaaaaataaatttaaaaaaatctcactaaactactcttcatcctgacatttaagttctaggtcttagctgagatgttttaacagcgattagcaagaattttagatttttgtacttctttttcaaaacaggaaatgatttttaccagcaattactataaagctcaattataatttagtaaatagagaacaaagccagacatagctgttttgtgtctagaagctgctgcagtcaggaagactttgtggaggaattcagcttgatttaaaccttgaataaaacatggaattgggattggtggcaaagaagaggagaatcctggaatggtaatagtttccattttaatagaacttttcagctcacaaggtgttttcacctatggcatcatattttaccttcataacagctgtctaggataggatttatcagatagttttttaattacttatttacaagtctgttcctgcactaaacctagagcattgcaagggcagatgctacatgtatctcctgtgcttaatatggtgtctggtgcagagtagtgcagaggagtgttagtgaaataaagtgaactatatgatcttgaatgtttgatattgacaggtattattaaccttcactatagatatgagaaatgaggcttatggaacttaactaagtcgaccaagtcaaagtaaatggcaggacagtgccccaaatctgatgctaaatccagagtcattcccattgtctgtgtactgagtgccaagatacacacaggaaccaaggggctaacaagacatacccctgtggagcatccaagatggcagtgccccaggttttgcccataaaataacctgataaattctaaagctctgcatcaacattgctgagataaatcctgagggactgtaagataaaagttgtcccaggatgtttagaatggttgctgggaaaataattcctgtttaggcaaaagactcctttctgtcttacagcacctcagctgaagcttgtgacttaaatctgatgtacgaaggggatgttagttatgaggcttgaatcctgggtgcagattcaccaccaatatgtttattgtcagtgaagtctcttggtttaagaaggaagtttcttgattatcctggtttttttttttaattggataaaatgggcatatgccttatatctgtcagttctagtcccatttcctgtggaattcttgggatgctgagcactgtatctttgtactattaaaacaaatttaaatctaccatggacaccattattttgcttaatgtcaatcttgttgcttcctcaaagacaatagaaatctttcctttctctggacccttaaaaattaattgggtaggttaattaagatatttccttaatatttccagattaagatattttgttaatatttccagattaagatatttccttaatatttctagattaattgtgtacccaattaattggttacacaaacatacagctattcctgattaatgtttacttttttcttacaattgtaatatattggcttctgtacacacacacacacacacacacacacacacacacgtttctgatcccctcatttacattcttttaatctttaaaaatatctgtgcatatgtgttgtcatatgcatgctattaaattgactacaaaactgaggattagagaggttcaaagaacttgtgtgcataaaagtagaaaatacttaaggtataaacatcttggtaaagccaagatttttgataagctactgattcttggagaatggaagacagtgtgtgtaaaagcttagtgtgctttgaaggcatgtgagacacagtggcaaaaaaagttttaaaaaatgattaataataaataacatttgtgttgaagaatcagttcaaactaactcattaaacatgggattagataaaatgattgatttaaattttcagagcactcagctttgctgagtaactttcgtctacatttcaatattaccattatacataatgggaatatgccaataagattagttggacacaattcccaaattttatccatatctttaggtgagactaaaagtagaaagtattccttaaaattcacttccctctcaagagcatacaagtttggacttgatgactacatgtcaggcggttcccattttggcttggcattttccattagaaatgattttgatttcctttttccttttttacagaaaattacaagctagcaaatctattgtttcagataaaatatatgcatatatattgtatataactactgaattatctacaaaaactatacatttgtacataaatgtgtgcatatagatgtgtgtgtacatatatatgtctatttacaaaatgtttttcacaggcaagaacagcagcctcacacaaggctttgaccagctcctcctttttttcagtaaaaagagtattagataagatgagaattgagcagaaactgagatgagagagtcatagaattcaagtattcctgttacatttctgtattacattttttacaggctaagaaaagagactgttcaatttaataatataaaaaatagaatatgttcaatttaataatataaaaatagaatatactctgagtagttagtaattctttcagaaaaataagaaaagataattagaaatctggttaatatttgtggtatttaataaagctagtaaatttcaattccagtcaccaaacattagttaatctttttggtttttgctggtcttataaggacttatctggaaaaatgcttataataagatttcaaggattactataagctactcatcatacataattttgatgctatgttttttgattaattttttataaaattaattggtaaatggtatagaaagtaagaatgacaatagatggttcatgaataaatggtttcagggtcaaataaatggtttcagggtcaaataagttaaacaaattaaactaatttctgatgaatttatcaattttttatgtaactattcactgagaatttccaagaagggcatatgagcatatatgttggctccattattgttagccatactgtcatccctgcttccctccaatcctgaccaccatccaaatcttggccttattattggtatcacagatttaaaattttaatgtagactattgctcttgcaggttccatcagagcgagttttatttctttattaagattgtaatttcctttagggtggagattattttatacttccccaaacaccccatggtccctaaaacaatgctacctacatacacaaaaattatccaggcacttttattgagtggttgattgactcaatagacttctcacactgttgagtactgaagacgtaaaagtgaaccatacatttttgttttgtggccttaaaaacctcaagtttaatgagaagacacaggcaactagataatatgcaatatcggatgtaaaggtaaaatacattagaattatgaagttgggcagagtttagctagactaagacttttagacacatcaaggaggaatggacattagagttgggttttgaaacctgagtaggtttgctaggtggagcagcaatgggagttccttctccctggaagaagatggatagaaagagaaatgaaggataatccagatagaaacacagcatgtcttaagtcttaagatgtgctgttgtagaaaatagttagcatgtttggagacttgtatatctgggatgtctggaaaggagaacatatgtacagaagcagaaggaatgatggtcaaatagttaggttagggttagtttatgaagaaccttgtattctgagtgcatgagttcgtatttttttcctgggtggctgataacatagtgattatagtatgtgaattgcagaatcagactgagttgggctctaatatgggctttaccaattttttaaggaagattaagtgagcaatcatgcagataaagcatttgacacagtgtctcatgtatctaagtactcaataaatgttggctgcttttataggtaaacatgggagaacatgaattttaaaacagggaaattatatcattgaatttattcttttgttatcattagattttgttttacttacttttccagaattgatttttgagcaaacaaccatggtggcagggtagagaaagacaagacaaaacagtaaatacgtaaaaaacaacctttctaaactgggtggccttggatagtaagagcacatgctaaaatttattgaatgcctattgtgtgtcaggcaatatgctaagtgctgtacttatataattccatttatttttcacagcatcacagtaagataagtgctataatataatctgacgtttatagaaaattgatattaaagagttgaaatgacactccgtggtcacacactggctagtgccagaaccagatattgaagttcctttgattttagatttttcatgagattgctctactgtgtatgttattttatttccctgatcctcattttcctgtgtgtagcatgggaagaaaaaaaattataccttctttatatgttcttgggagaacttaatgcagaacctccatgaagggacttagtatagtgtgggatacatggtaatcatagcaatgttactaattcttcttcttcttattttttagaatatgttagaatattaatatggaattgattttggagataaataaagtgaaggttattgtagaaattctaatctattctcaaaaaccagctggcttctattgtctgtactggaaaggcagaatctttctcttatctatggagtttaaattatataactacatgccttacactttctgaatactcagtttacatctgttattatgtgttattctattacttttaattctgtttgtactggtacaaactatagcatgtggtaagaaatgggcacttaatctgaggcataaactcccctgtgttagaggagttttatattgcattgcagttatctgtttttctgcctgtttctcaatacactgcagattttcaagggcattagtcatatcttggtcatccatttatctctagagtcttttgagtccttggttcataataggtgcttaataaatgagctttacctgaaggaagaaataattgaatgaatgaaaggcaatcctaacacaagacattgtatttggggctatctgaggtcctactcatttaacaaggactattatgacatgactcttaccaaattctccaagcctttattaaacatatgtacctactaaaattagatgctgcatatcacaggagaaaatcagttactcaactaattgaaagttaatagtttgcatagcttatatcacaaaagagtaataataataattctctttttgttcaaaaataaccccatcccaccctccttccttctggcactggagggggactagagagctgtctatttcatttgactgacggagcccttcctcaaagagagactaggaggctcagaatgtctttgtttctccttcgtggcctacatcatgagcacatcagaaagcagattccagccaggagtggtggctcacgcctgtaatcccagctttttgggaggcctaggtgggtggatcacaaggtcaagagttcgagactagcctggccaacatagtgaaaccccgtctctactaaaaatacaaaaaattagccgggcgtggtggcgggcatctgtaatcccagctactcaggagtctgaggcaggagaatcgcttgaacctgggaggcagaagttgcagtgagccaagatcgcaccattgcactccagcctgggtgacattgcagactctgactgagaaaaaagcaagcaagcagattccaagtactccaatgccatgcccctgctgacacagaagataataacattcagtgttgaggtttcagtcattcagtcattcctgaggctggaccatcttgctagcaactcacatggtaacagtgtttagagaatttcagttcttagagccacctccctgtttaggactctcttttacttctcctgcaatcaggaggattctgctctgaatcacacttagactgtccactgtgaaaatatgaaaagatgacaagttatactatattcagacatgaggttaaaaaaaaagcctcttcacataaagggaaaacagcaacatatttcaggaagctagtgtgctatggggacatgttatattctcattcctttcccagcatgagggttgagggaggaaggcagaagtaaaggagcatctgtctaaggccctgctaatgttacagatcagaaaatagtgctctgctctgcttcaactgtaaacactgtgaaatgctttctttccccaccaggcaacttggctctgggataatcatcctaggcatgaattcatagagtactgtccattctacagcttcattatacaaaacaggcaaatgagatgcagagtgacactctcggttttctgtggttgtttgagctccccttaacccctccctggaactagctattcaataatggccacagaggagtcccagatgtttgcagagtaaatgtgatgcttggctttgactcctggaagcaatagggggtggagtagggatgaattacaaagaaaggccttattggttgacgctaaaagtacctataaaagtctcacatacatagagttaacctttcttcagcccttctattccattcctgagtaagcaaatttggattaactacttcaaccccttacttagaaacggcttccatcacagttatctcctctctgacagctttctcttaatgttcattttaaacttatttctcctggataaatatgtgtgtgcaggcatgtgtgtctgtatttatgtgaacaaatgtgaagttggaaaaaaagataccaagaccttgtgaattttgacctctcttttcatatgtctctaggccttttctactccctaagggaaagcttaagcatggcaggtctctcttctctctctctctctctcgctctctctctctctctgtgtgtgtgtgtgtgtgtgtgtgtgtgtgtgtgtgtgtgtcagtttttatatagtgctaaagaaatgagaaggaagagatactaggaagggaagatcatttgttcccaattaactctgcttatctgtgtggctgaggtggatgatctaacacaattgtatttatagtagtatgcattattcccctctcctccaccaggatatatcagtgtaataagcctttctattatcttggctatatccaaacaagtgaggaaacaaaaattaaatgatatcttgcggttgtagagaaactcagaccattcttgctggagatacatcaagtgaatacctttgtagatctggacctgacccaaggaagcctggtatgtttatctgggatctcctactctctgtgtactaccctctctgtccctttcccctcattctcaattaagacagccttgagcaaatttaatttctgtgatgatcagatctaaagctctaagtattgactaaacactgctaagagcatcgaattgcataattgagaccaaatgcttgccacaaacagctccatgtcatctcctacatgaatggattactctaaaatatcagttcatgcactggcttctttgagatgacctaggaaacttgttacatgacagattcctaagttgtattgcccaatattttgcctcagtctgtttgatagtcagctaagtttgccaggtttgggaactccagttttagacctcaaattagaagtcactctgggaagagcccttgagcactcatttggtgaagtcactttaaccttgtccagcttactctggtgctgtttgcctaattttcaaggatatgaattatgctactttgttatatctaagtggaaggaaaataggagccccaatagcattctgttgagtcacttccacaaaatgatcctctgagactcattttgcagatgcactgagatccaaagatagctgtataaagggattgtaggcataaggccatcagatacaccaaagtacacacatatatgcctacacatgtacacacactatcattgccttgtctctgagaaccatagacaaagttggccaagcccttggccaggactgttgtgaatgattgctcaaactgtatgctgaacagttctgggcaccattttcatagactgcaatatgaatagtccaccagcagttgtgcaatatggtgggccttggaaaaatgtagttattattttgaaaataggaaggagcccaccactgaggaagcaaacaaaatgtttgtggtgaaatttcaacaggattatcttcttgttatgcaattaggtctcaagctctgctctcagcacatggacatgcatatgcacatactctacttattgaatttttccttttctctaatccaggatgatttgcaaaagttttccttccatacctctacaccacagatggattgagaaatgtcacaacaaattagaagtgaagagttaagtcatggcaagtgactcctcaactcaaggctccttcaacattctggaactgtttaatgtcaatcttgactttgtctccagggcccttttcttttcttttttctttttctttctttctttctttctttctttttttttttttttttttttgagacagttttcactctcgttgcccaggttggagtgcaatggcatgttatcaactcactgcaacctctgcctcctgggttcaagcagtcctctggcctcagtctcctgagtagctggaattacaagcgtgtgccaccatgcccggctaatttttgtgtttttagtagagacggggtttcaccacattggctaggctgttcttgaactcctgacctcagctgatccacccgccttggcctcccaaagtgttgggattacaggcgtgagccaatgcgcccggccccagggcccttttcttaaaaccaaatcccatgcaataaagcacgtttatttcatgcaacacagcttagttaatgcttatacttccaaatactccggtttactaggtacaactcaatcaggagtgcctagtataaaagaacatgcacagcacagcgacagagaatgttcatcaccaaacacaaggaagcaaaggagatgcaaagctatggtagctagaggaggattagctttcctgatttcagtttgagaaaagccacttgtctctacagtccactagtttggcaaggcatttgcccttggctgtgagatgatgttacattcaaagtaaggtatattaatttccaggcttgtccaggatcaggggctggagtcttccttcaatagtaatcctttccttaaaaccagttctaagctttgtatttgttttattaagtgattggatagccctgaaatatgagtttcctccaatctcttccactttgcaaactccagaaccgtttgaccaataagttaaaacccagaggaggactgactgtgagctaaggcttcagacatgcaaagcgcacaaccctgggaaacagcagcatctgggacaggaggctcccattactacacatgagggtgtcataggttttgcaaatcaaacacacatagaaaaccagtagtagcctgggttggacacactgtatgagttgcacagttgagtgaggacccagaccagggagccacatgttcctctagcttgcatacatttatttcacaccacctcaggccactcatagtttgcttacctgctcattgttgctctcccaccattccccatactccctttgggggtgaaacactctatttccgacttgtgctgggccagtctcctgtctttgtacctggtgagcatgaacaaggacaggagcaaacagaaagacgtgattgtgtgcttaactgccaggctgaggaacggccgtgactgtggagatggtcactctgtgccaaaatgggggttcctgcttctcaatgcaatgaccaacctgtgatacttattagatgaatgtgatggcatatggacaacatcagggatgacgttgttactttttggttaaaccacatgtaacccattctttcacattgcctattaaactgaatatgtcacatttaatagtcaatggtaaaggtgtgcaatttctagcatcttagaaaaagatgaatatcaatcaacacattagaatctattcagtgcttaccatgtgtcagacactatgctagaactttacctaaattgtatccaggcaacagccctgggccagaggctttgttatcatttccattttactgatgaagaaacctaagattatagaggttaagcaaattaatcaaagattagttaattaaataagtggttgggctggattttgaatacagggaatctaagtttagaacccacacttcagccattataatgtgttgccttccattatcaagtttttaagctaattattatcttgagcaagccctcattgagtgataccattctggatgttgttagacattggcaataacagaggagagaagacatgttctttggatattaaaagtttctgtaaacattaagctgaagttttactgtcagtattgggatgccgccattatttttgtattataattggcagttcaccgcgctttgaagataccagatatttcatctaaaataagtgatgagattcccaatattactcttctacgtggtgcatcaagatgagttcttgtatctcaatgacagttttttgagctaacatgatttcacagaaataacctcttttactcattggttcgattctgtaaggtttttaaaaaagaactgttatttccatttgccagatgaggaagctagatttacttaactgacttcatgaaagtcacaagcctcatcagtagagaataaccacctgtagagcttgcaggggcccagagctcttaaggttttattaccttttccctaattaaactggagcctggtataacaccacttcatccaccttcctggtatccagtaggctatgataaagggagttactataataagacttgtttatctcagtacagtcacactctttttagtttattttcctgctgtttcaaaagtagtataaaataaaataaaatgcaacaaagtcaacatcattattgatcctggggcagaggccttcctcttaattttttttcccttctaaaatgtttaaagtatctagtatttgaagaaaaatggcttattacatcaagcaaaatgaatttaatggattacctatttaacggacattagttgagcatttattaaatcctaggtaatggactttgcactacagatgtaaagataagtaatctgcaggccccacctgttagaatttacctaacagtaggagaaggaaggaaataagaaatacgtacacaagtaattttagatgtaggcataaagaagagaggaaaagaacttagagactttgttaaaggaggtaaatcatcagaccaagctagattgagtagacttaattttaccaagaaaataccttagaagtaccaatggccaaatgatgctcaatgtttcaatgcaaagtattttgtgcttctttgtgaattggattgctcaagcaaaatactgctcgacagctcaaattaaaagaatattgatagaataataaattattggtggtcattcacttccttacaaagggatccttaacatatttttgaatatcttctgttaggctaattgtgaattaatcattaaatatttcatagatgagttaagaaacctacagtcttcatgcttataagctcttctctttctttctttctctcatgaccacacacactctgccaggtgacctctgtttatgaaatatggaatagatcctaagcatcttattctatcaaactctaacctctgtgaagaaaaaggaatgcttacacactgctagtgggaatggaaattagttcagccactgtggaaatcagcttggcaatttctcaaagaacttaaagcagaactaccatttgacccagaaatcccattactggtcatatacctaaaggaatataaatctctctatcataaaaacacatccatgtatatgttcactgcagcactattcactataacaaagtcatggaatcaacctaaatgcccatcaacggtaaaatggataaagaaaatgtggtacatatacatcatagaatactatgcagtcataaaaagaatgagatcatgtcctttacacatgaatagcacaggagggcattatcctaaccaaactaatggagaaacagaaaaccaagtacttcatgttttcatttatcaatgggagcttaacactgagtacgcatggacacaaagggaaaaatagacactggggcctccatgagggtggagggtgggaggagagtgaggatcaaaaaactacctaccagattctatacttattacctgggtgatgaaataatctgcatattatacccctgcaaaacacaacttacctataaaacaaacctgcacatatacccctgaacctaaaagtttagaaaaaccatagaaacaaaacaaaaaacaaaaacaaaacctaactgcttttggtaaaagctttcactgacatataaaaaacaaaataatgaaaattcaaaacaataataacaaaactcattttaaaaatgtgagcaatatcttagactttttggaactttcaagcagtttttgtattcaatgcaagctgaaaatggcattaatacagaatgggaaactcatcattgctttcagataggaccctacttgcctgtctgtacctgtaattatattcaccagatatttaaatagatcatatttttattcattcacttactcattatcccatttaccagtaatgtgctgttcaaaattactaatagatttaatagtctcaactgttgagtttaaaaactcaacatttttttccagttgagtttattttagaaatatggaattgtcaattaaaaatagtttaagcttttcagaatttacagatcatggaatatcaattttaaaatttcatttcttttacataataaatttatatatcagatactaaaacacccatacactcatacttgtaaggcactgtttcaagtgctttgcaagtattaactcacttttcaaatgaaatgtttaatttactatatttatattcaaagttataataaaaagtaataatgacaaaatattgagcatgccaggctgtttgctgtacactattgtaaattattaaaacagccatacaaagcagctgctattattctcattctgaagaggcagacactgaagatcagtgtcagtaagcccaacctcatgtggtttatgagcagggagcccaaggttaaaaatcaggtttctctgattctaaagctcatgctatttccattaatttttcctccaagtaacaatattactacgtttaaaaacaaaattacaaaagcttattatttaccttttctcttcttgaccccgttttgcaaataagtagcagagttatcaagtacaggcagtagagaatctagtgataggactttaaattttgttacttcctttaggtccctatgcctgtaccaggcaggtttagttgacatcattcaaaaccgtttactgaatagtccatgtgctgggcactgtgataaggagcatatgggtgattatgtcattgataaggtcacagtcttgaatgagaagatgaaatgtaaacagataatttccaaacaatgtaagaagttttattatagaaacaaatacaagaagggttacttaacccatactagattggcagagaacactttagtgagatatgatacgtaagacaaatctgaaaaattgagcagacatgcaccgtgaagagaaaatcaggtgcaaacatgtagagaggtttagcagcatggtgtatactgggaaacactgtttagtaatttttattgtaagaagtataaaataggaggtcaaaggggaaagcagatggagaagtatataaaaatgatgaatttgcttgttgattatgagatgtcattgtggaatccttatgctacataaaacaggatcagagttgacatttagataaaatgcaatggacttgaaggaacaaaactagagagatagagaaatactactacagttatgcatgtgagagatgataagctaatgcttagggtagcgataatacagatgaaaaatagagcacagtctcaagactatttgggaggcaaaaatgagtaggatttattggatgatgagtataataggaagaagtatagaatgataccccagttactgtgttggatggtgcagttaactgagttaagaaaattcaagagaaggagtatatttgggcaaggaagtaaaaagcttcattttggaatatttgatttgagatgctggtgggacatccaagtggacatattcagcagacacatgagtataaacatttggaggttagaggattgttatacacaggggagctctcagcataccgatggttgcaaatacaatgagaatggttgaaaatattcagaacaggaaaactatgtagacagtggaaagaagaggtgaatagccatgctcattctacctgtccaaaaacttttataacactgttagtgtaagcattcccttaaaacatttactggaaaaaaaatctgctgagtgccttgtatatgctagacatggagtttaaggctcttcaatcttgtaaacctgtaagttttcttataaactatggatttctagatttatgcctaatacagctttgacactttagtttataggccagaagcttggcatgaaaaactctcacaatagatttaataaatttcagaatgacttattctgaaataagttttgcttatcttctgtaaagatttttgttgttgttgttcttcttcttgtaccttctttgtccaggaagttctagctcttctgtactgagttctacaagagcctatactcatctggtaaatctaaaagatgtgcaggtaagaataacttaggatcagatagtaaatgtaattttccattattatttggataaaaaatttcatttcttcacctcaattcctctttcctaccaatatctactgaatattggattactgaaatttctatattggctatgtgattcagaatacataaatgagtgcagaatgaagtgaaagactagaagaaaataaacaagtttaaataataaatgtgtatattaggtgaagtagcagatagatggagaattgtgcctgaagctggcagaaaaggagagattttgatattggaaataatgatgccttatgtgaggctgatcaagtttgagtaagtgaccaggaataggaacattaaaatgtattagaactggggggaagaaagaagcttggtactcatctgtcctttatacaagcactaaattcactcagaatgatagccgggcttgggatagacagaagttctttatccagaagttggcagtaaacagtagttataaatgaagctaaaagatagagggataactagattccatgagtctaaattcagtcagagctttaattttcacatttttgtatgtaagggtgtgatatatgcctggaagcagcgttgagttgctgacctccatctctgtgtcctgtgaaacacgtgatatggaagaataagaaactttacttgagagagatatggcgtagaaatgtccttaggagggaattgggtttcaatttaagaaaacaacagtaaatggagtgtttagtgaagcggttgaataagaaggggggtttaatcattaaataggaattatagacagggactctatatggtttggaagggaaaggtcagtggatgaagcaaagagcaatatatagaagtagaatttacaaatgtgctacaacttatgagatgctaggaagattccattgatgaattctttcctcatttttctctgataccaaggagcaaatgttctccatcctgtatgagtgaggacactcaagatgcaaatgctgttgtgagtatcccatggcatacttagagacatgttttctcatagaaattgcagactctctgagaacatatttggttaaaaatgagtggagaaagagcctaagtttcctagagagttcaagaatggaggggaaaaaacacaaacacagcaaataagaaagctaaaggcaccagaggcacatttcccttactccagttttgtcataggcttatcctgctccaggttttgttctttccaatagataaaattgtcttaaaaaataattttctttcgccactttctctctcacactgacatctactatggcccgtagtcttccccttgaaggagcattgtgctaagccttgtgagcacttaaactcgttttccattcctaagctagctgtcattcagcttagtgaaaaccacagggagatattttcttatatgtgtagaaaccacagtatacctattttacttcatgctataatgctttaaactattcatagaaaaaaacagcctgatttctctaagaagtctgtgaaagcgagttggaaaatgttgcatatttcacatatgtcttatgtgtaaattttagtaactcaatatggaatggacactaatgaggcaggagggtaagtctggggagtaagtgggtaggagtgtgttcttcaaggaaacctctcatttaaaccaatatagatgcatcccatttacaaagcaaatttaaattctctctttcctcaattactttttattatttagaatagaagtatggtatgagcagagaaaaacaatatgggaggaaaagagtctttttggccaagaaagtgccaaaaatagtaaaagttattgaatgagggacatttgaactatagtcatatgacaagtcactgtgaatgttacagaaaatcctataagggattttcataccaaaattgcagtaaagatggcagagttttaggactaagcttgagcataaacatggaagtgcagagacttaaagaaaaatgaccatgtgaataaaccctaaacatagtgcctccattatgtaagccctcaaccaacattttctgagggaatacctccatgaataaatgaataaaatggaattgtaactttagggatgatcaaatctccaatgagatttgctgttgttatttgttttgtttttaataataaatacaaactgaagacattctgtacatgttggtcaagagatcaaggaagatggaaaatattaaagatgtttacagaaagtggtaactaatgtacagagttttgagataaagtaattgtagaaaaaaggaggaaagaacagacttttttgtaatcagtcagcatatactgcaggctccatctgcaaaacatacctaaaatctgaccatttctcaccagtatttattaccctggcccaagccaccaatacctgttaaaattttaacagtttctcaaactggttctgctttgtctgttactaaatttccccaacccagaccaaacccattccaacctccacccagcaagcagaatatcctgtcaaaatagaaatcttttcatatcattcatctgctcaaaacgctgttagttacccatttctctgagtaaattatgaaattttttatcatggtttacaaatccctacacttacctcccactccctgactatctctctgatcccaaaagtcactttttctcccttgctcacattgcttcatctacaatgatcttcttgttgcttgaagacaccagatatcctcccagcatagtgtctttgctttggccatttcctctgcctttaatgctttcattaaaaatatcctcaaagcttacttctttcaaatttttgcctaaatgtcactttctcaatacatcctgccagaccaccctatttaaaaaggcaactaccactctactctttctgttaccatttcctgcttttatcaggaaaacttatctaaaataatttatattttacttatttattttatttattctctgttttcccccagtggaatctgtgatagaatgcaagctctatgaaggcatgggttctgaaccgtatgcttcactgctatcttcccagtgcctatgatagtataggtaataatatttattgaatgaggtatgcatgaatgactgacaaaaaggaaaattaaattataaatttccaggaaatttgcataagtaatgaggagccaaatgttaatccccaagacaatggggaaaatgtctccagagcacgtcagaggtcttcaggcagccccttccatcacagatctggaggcttaggaggaaaaagtggtttcgtgggccaggcctcgggtccctgagctgtgtgcagccagggacttggtgccctgcatcccagccactctagttatggctgaaatgggtcaacatagaactcagactgtggcttcagaggatgcaagccccaggtcttggcagcttccatgtggtgttgagcctgtgggtactcagaagtcaggaattgaggttcaggaaccacctagatttcagaagatgtatgaaaatgtctgacgtccaggcagaagtttgttgcaggagtggggctttcatggagaacctctgctagggcagtgcagaagggaaatgtggggttggagtcctcacacagagtccttactggggcactgcctagtggagctgtaagaagagggctgctgtcctccagacgccagaatgtagatccactgacgacttgcactgtgtgcctggaaaagcggtagacactcaacaccagcctgtgaaagcagctgagagggaggctgtactcttcaaagccacacaggtggagctgcctaagaccatgggaggtcacctcttgcagtagcgtgacctggatgtgagacatgaagtcaaaggaagtttaatatttgactgccctggtggattttggacttacatgggacctgtcacccctttgttttggccaatttctcccatctggaatggctgtatttacccaattcctgtacacccgttgtatctaggaagtaactaacttgcttttgattttacaagcacataggtggaaaggagttgccttgtcttggaagagactttggactgtgcacttttgagttaatgctgaaataatttgagactttaggggactgtcaggaaggcatgattggttttgaaatgtgaagttatgagatttgggaggggctggggcagaataatatggtttggctctgtttccccacacaaatttcatcttcacttgtactcccatgattcccatgtgttgtgggagggaccttgtgggagataattgaatcatgggggcagtttcccctatactgttctcatggtagtgagtaagtctcacaagagctgatggtttgataaggggaaacttgttttgcttggctgtcattctctctttgcctgctgccatccttgtaagatgggacttgcttctccttgccttctgccatgattgtgaggcttccccagccatgtggaactgtaaatccaattaaacctctttcttttgtaaattgcacagtctcgggtatgtctttatcagcagcatgaaaacgaactaatacagttacatggaagatacttatttttttaagatatttgcctttcctttgcattgtcacattcttcttaacaagccatcccatccttaccttcacgatgtagacactgattagactaagatgataatagtaattatcagattcacttgccactttactcatcagttttagccaatgatcatgggagagagtcttctggagacttctgagaacgatttctttagtattaataaaacactggaaaacatagtctctttttctgtggacagtggtctggatgtgatacctgacaatgctccaaccatatggcaggcatgagagaagctaagccaacatttcaaaaactgtggtccagtgattcagtggtagactggaaaggtcgaaataagtaggtccttgagccattgtgtcctttgagctactgaattagcctttttagtgtcagaaattctttttatgtgagattaatttgttatcatttaagccactttgagttaggttatagactttctgaggctgaaatcctcctatctgctatacttggtttcattagtttttcttccaaaactgagtctaagaatttctgaaattgttatagcatttacttaggtttgactgtttataaatactgtgtgtgtctctctgtgtgtgtacacatgtgtgtgagtgtatatatatgatgaatctaaagaagttactactaacaaatactttagtgttacttagatgtttgtgttcttttaaataatgctcctttctgtatgtaccatttatataaaataagtgtgagagttaataagttagatttgtaaggagcaaaaaagagagagatcgattgggtaaaacaaagtattattttctcaataatccacacttagagaaagcctaaacaattggtccttataatcatggaagaaacacccttgttcatttcctgaaagctatgctagttacagtcataaccagttactgtgggtttagtgttacattcttaaactgattaggtcatgggaaatgattcagctcatagtactgaagccttataactactctgaaaacgcttttgttcacatatattgaagaattggcatgggcttatacatatttaacaaaaattgtttgcaattatcttttgtgtaatttgaataagaaggtgtcacacacacaaaaaagaaaatgaacctcagtgggcttatgtgcttattccttattagtcagtgacagatccatatacaagtaatcctggctcaactcagtgatgatttaggagttctttccagccaccatcttctttgagaccagttatagcaaattttggagccagtttttatttgttagctctctctttccctttgcctccctgccttgagacagaatttttctgactttagtttttaatcttgactttgctgtagttattgtatccactccccctttgtaccaacacaaagctttataacagctttgagcacattcaattctgttcccatgttggttccttgaacaccagccaagacctcagcttttcgacctcaggtgaaatttggatcaaacatctacctctagatgatatctttagtgatcacccagaaacacagtttataattttaaaacatcttagggaaaatatatgaggtagaatgctgcacattgcatcttattctacagatttattgccacattccttttgggaccatcctaattttggatcttggcagtcataaagtgaagagagaaactatggtgtaatatacttttgaatagcattcacattattatagaaaaactttccctatatcatttaattttcttaacaaactcaggaatataattatccccattcagcagataaggaaactggctcagaaagcttcacaatttggtcaagaccccatagcttgtaagtctcagaagtgccactagaaaccagatgttttacctccaaatctcatgctcttcattaacaacttactttttctttatttcatgcttaaaaaccccttatttaaataatctgatggcacatttgagagactgaaaaggtcgtacatgaagttaatagtgtatacttagtggagctaggctttgagcacaatatacgcttattttttaaaaggtcaaatttgactacataatggtcaagtggaataaatcaccctctgggccccttgttaacatgcaaacagattggcatttctctggctggagttttcctagacagaaatacaccaaaaatctgaaggctgtaaaagaggcatcactaagaagagctgacaatcagtttcgatgtgtgggatacagtgtgatagcagaagacagacagggacgagatggtagaatattttaacaacttcagagtgttacaaagagagctgaaggaaagcccaagtcagccttccaagtctaattgatcagaggaaaattctagatgaaggcagaagggaagtcattatggatctttaggttagagggaaacagtgaagccaaatttaaaaagatcaatattatgcagtactattgcaaggtaattcctttcttcaatatcatctctcaaccttctatctatctatatatgtaaatatattggaatgatttactagatattccatcagatcttgtggtctccgtgcgcagaaaaacatcttttgcacagacttgaaatgtcaacttgattccttcagataaatcagattaaaaacaaaaactgagcatgattaatagctccagaaactaatggcaaagtgaagataagctgcaaaatgatttgagaaattgccaggtaacatatttcactgtgttctgtgaaaataatggaaaggtaaaagctgaaaagtggggaagcaatgcaaataaggaattaaaaagtaaaaaatcagctgtattgacttagtaattctaggaatttattctaaggaaacaattcaacataagctcaaaggtttctgcacaaagattttttccttcaatgttatagaaaacagaaaaaaaaaaaaacctcaacaaaaaagaacaaaccaaccacgggagaatagtttaataaattacagcatagcaatattatggaaatgtgttaaattttgtattgagtaaagcctttcatttagcttctgaagaattcccaaaggatgtattttaatcctacttatgatgagagcttgttttcagatatgaatcatcataagtcattgccattttattgtgtactttccttcaacattactatttgttacacaatcaatagaaattcaggaagatacagatttcaaaaccaatcctaaggtgctttacaagctttatacaacatcctcaatagggaaaacttttcagggaggaacaaaatgttaactataagaagggtctccataggaaacatttcattatggcattaattaaaagttgctagtttctatcttataggactgaggaattttcagacagataaccttactatttctaaagagagataggtagttttccaacagagatttttcctcacatttttatacatgaacaattggaaatgcagtgaagtcagatgaagctagataataaatgtaataagagccatcacttactgagcacttggaatgttccagacacaattctaagtccctgaatttactgatttaatcattacaacagtcttttgagttaggtactattattattcctactttacaaatgaagaactaggacacaggagatcaagtgatttgcccaggttactagaatggtcaactgtgaggtaaattgcttctcactaaaatgctggctacaaatagtagctgtgccatttgttaaacctagttctgtctttaaatggcctaagggatacaggtaactgtactatttttcaaaccttatcattttttttccccataatctccttggcttgagacactgcctatgcttttacttgagccctttctacccttttggataggaagactgattcctctgtgatactaactttgattaaaatttgcaccagcaactaaattttctcagtctggggactgatggagcttaaacctcagtggtgctcgatggaagcagatttgctctaaagctgatggagtatcagggtccctcactcacagatgcccctggcaaggccctgtttctatttttgtattcacattttgtaatctttttcttaaataaagctccccaagtggaaggaactttaggtctcacaaagcctggatctacttgtttaccagagtttgcctttgacccataagggaatcataaactgtgtttatgttcatagggttagttatgctttctgagttacaatttctccatatatacaatggaaatattgaggatcaggtaagacaattcatgtaaaatgcttgattttatagttgtttcataatgttcctttcatatctgtcattttcttctgtactaataacttctataaccaggcaggcttctcccagatagctctgatacaaaatatttgtcctgtttcctccacacaccccctaatacttatgaaatagtgcttcctcatacgagacataaccaatataatctctattaattcttttaagttaatgcatctttgattttcttacctccatctggacctacctccatctggacctacttccatctggatctgtctgctcccacataccctaatttacgctgctgcgatttaggctggatttgaaaatgatgtagagacaaatgatgctcttctctttacttgtctcagcctgtctcccctgttaatctgtatcagggcctattctcttccttcataccaattattaacaaattataattaaatatctgcctgactactagtttagtaactgtctttctcactacaccgtaaagtttatggctacctgggcacgtctgttcttttaacaagcatctaggatagggcctagtatagagcagcaactcaacaagtgaaatggtaaaagcagggacatttatgaaatgcaaggcagtactatttatctaaatctaactacatcaaaactagcctcccccttctatcatacacagaagttcattcaccagttcttgtctcaactaattcattccgtttgccaccctcctttctttctctagccttcttccttcacctttcttgcccttttaacccctcctgtcctatctcaatgcataaaacttgtctttgttttcctcattcctttgtctttggacaacttagaaacaaaaaaagctttctacatttttgccaagaagcttagtttccatttatttcaggatgtaaaataactggattttcacaagaacaagatgagatggggtggaggaaggagattgggatgtttcttttgcctatatacatgcgaggggtgaagactgaagggaggggaatcatgcttacttttgatagatgcagctgcccacgagtgggaatgacacccagggagagagaagcagttctggaaagtcctgggcatgcaattacaggtagccagtgtaagttgtgcacttacatggccatcaaaagaatcatctccacttcatgacacggggaggagggaactcaaatcacaagtctatgactagagattacctttccactgcctctattcttcatcacattgtctttatttttatttctattttttatttttatttttttgagacagagtctcgctctgtcatccaggctggagtgcagtggcgtgatcgtgatctcagctcactgtaagctctgcctcctgggttcacgccattctcctgcctcagcctcctgagtagctgggattacaggtgcccaccaccacgcctggttaattttttttttgtatttttagtagagatggggtttcaccatgttagccaggatggtctcaatctcctgaccttgtgatccgcccgcctcggcttcccaaagtgctggaattacaggcgtgagtcaccgcgcccagccccatcacattgtcttaagattattattttaataaaggtaattatatttctcctggtattaggataacgttttatgtttaattataatcacacatgattacaacagatggatttcctaattctgtcatttccaagcagatttccacactgccgagtgtctatcacaataaaggaaagtgagattactttaatttcacaatgcaaaatatccaaagaaacgtttactgatgtttcttaagtacttagtatttgctaggtcctaagctaggagtttcattgtgatctgttatagatattaggaatttatcatgtcagagtgtgataagctaatgcatgaagttaagtagtatcatctgtatacatacaagtatataagcatatataaatatatagacacagatacatgtatatacacacatacaatcacacacttatacatatataaacatacatatagatagatataccatagctcttcagatttgtctaacttgactgggctttagtttgcctgagatgggcaatatattatggaaattaagtgtactggatttggagttaattaacatggattttattctcagcaataccacttactagctatattgttatgaataacttatataactttttctcaaattttcttttcgcataatggaagaaataccatgtaatttacaggattgatgttttatgtagattttagcatttaatttcactaagacacttatatggtttggctctctgtccccactcaaatctcatctcaaattgtaattctcacatgtcaagggagggatctgtaatccccatgtgtggaggaagggaggtgattggatcgtgagggggagtttcccccatgctcttctcatgatagtgagtgacttcttgtgagatctaaaggttttacaggggctcttcccccttagctttctcttctctctcctgctcccttgtgaagaaggtacctgcttaacatttggccatgattgtaagtttcctgaagcctccccagccatgtggaactgggagtcaattaaacctctttcctttataaattacccaatctcatgtagtacctttatagaagggtgagagcagactaatacactatgagatatgtactattattatccccctttcaccgataaaaataactgaggcacagagtggctgggtagcttgctgaaagtcacacagttagatgaggcaaagccaggactcatatttgggctgttgaacactgaggcttgtattgtagaacactagattaaagaaaataaccaaaattaccaaaggcatggctaaaaaggaaaaaacaaacaaacaaaaatcaagtagagggcaaagaataaagaagagaaagaggaagagcaagcatacgtaacaggcactatactcagagctttttaaacattgtttcaaacattgtctctttacaaccctagggaggggtattgatgatcctgtttaaaagagatctattggtcacaaagtttataaatgttgatgttggaattcaaagctaggttcttctgtttgtaaatgatatacttaaacatatattgtgtattttctagatacctggcatagtacttggttttctacttgacatccagaaaatacatttcacagcctctcaactcaaggagcttagaatccaatggggatgataaacattggctgtcatagacaaacaaatagagcacactaaactcatggtaaagataataacacctgccgggcttggtggcttatgtctgtactcgcagcactttgggaggaagaggctggtggatcacctgaggtcaggagttcgagaccagcctggccaacatggtgaaaccccgtctctactaaaaatacaaaattagctaggtatggtggcacatacctgtaatcccagctacaaaggaggctgaggcaggagaatcacctgagcccgggaagtggaggttgcagtaagctgagattgggccactgcactccagcctgggcgacagaacaagacttcatttcaaaaaaggttaataacacctaggtgtcctagaatgaaaaaataaatctcctagaactaaaatggaaaatgccgtggtgtaatttgaacttaccctggcctgagaggcacaagcttggcacactgtgcacaacaactatttgttaactgcataagcgataagagctgattaagtgaaaagacatgatattctttatctgttacctttctttctcacatggggccttgtagagctgaccgtttaagctttctccttcaagcctaggaagagggcagggtgcagaatgtgtcattggaagaaacaaatgggtgcaagctgactgccttgcttgtgactgtcacgttcaccacaaataaaatagcagaaggtttctgaaggcagggaccatgtatgtatcccagtgcccacaacagtgagtggggcctggcaagactcaataataaaaaaagtgctgaatgagagaataaataaatgagaaagaaaaatattatttcagggaagacatagagaaatcagagaagaggaaaaaaaaaacccacaaccaggacccataccatcatgttatccttttttttttttttttgaggcctttcctgtcctctctcatcattatttccctttttgtatacccacaaaggatcgagttatctatacttccttactaacattattttttatgagtctgaatttattatgaagagaaaagttatctgggggaaggatggtattgtattcatttttatatctccagtgcctaacctatcatctagcccatagcagataacatggttgctatagcttgaaaatgtcaccaaaagttcacgtgttgaaaacttaattgccgtgtaacagtattaagaggtgggacatttaggggtgattttgtgagggctctgccctcacgaatggattaatgttgttatcatgggagtgggttagttattgggagagttggctcctggtaaaaagataagtttgtctcccatttgctctcactctctctctctctcacacacacacatacacatacacatacacatgctctcttgcccttccaccatgggatgaccctccccagatgctggtgccatggtcttggatttcccagtcttcagaactgagaaataaatttcatttaaatagtgttacccagtccgtggtattctcttatagcaacacaaaacagactaggaaaatggtgaaatggtacctgtttattatgattgcttgggtcataacattcactgagcagacaagccttgctttcctgtgactgacttctggtcactcttttctttcctagcccagccttgtgtttgctgtctggttcacattttagacttttctactccttgtattacggacttccttcatttcacaaagcttaacttcattctccgtaaatgtgtgcattgcctccttgtgtctccttgagtgaaactccccactaacctctgttttgggctttctccccactcctgtgaggctctgctgccctctagggggccttgttcatcacacacttctcagggcccagttggatctgcacttggcaatacagtcctagtgtaggagtgtcatgacagtgctgcaaagcctcagtgctccttttcctgctcctacagtccccagtataaaatgtgtggctatataatgcagttgatttaggaacattaaacttgggcataagcaagcaagaagtctgtcaagaactgaaactcattacaagaggaggctggaagaggctaccacagggtctcagtgctcttggtaccaacgaaatccttggctatgagtatcacacctgcatcttgatagtttgcacattatattaaggtttgcactatagaatccggtagccaactaatgagaatgttctatttgacgaatgaacattgatttacatctttgcctgggcctttgggagacaaaaaacttcctcaaagagatgggacctgaaattgctttttgctaaaccctcaaccaacatctggtttccatacccaatgatgactcttaactctatctaacctgactcatctgcaactggaactattgactacttcttcatctttgaaacacatttttcctgtcatgctatcacttgtatctgggtctcagttcttggactttctttatttatctagtctctgggctctgttcttggttcttccaaattgtgcttacaaacaaaccccaaactctcctaattattggtccaattttcttgcagtttcctggacttgttcacttagatgtctcttagaaattttaaatttaatagttccaaaaacaaacacatatttcttcaaacctattctcttttaccttacccaccccaatccaaattatttctaatttagtcctattattatcaaatgcagttggccccccctcccccaccctttgattctctagtctgaacctttctttgagctcataggacataatataaacatgtccaaacttagttatcaattttacccttcaaacctcttctccttgaggttgaattacacaggtccaaatcctccattcacaaaggtaaaatctagcacccatctttaagtattctcttttctttatacgcaacattcaatcagttattaagtttcatcattatacattctagttgaaaccatcgtgatttctcacctatcctgttgcaatggacatctgatttccctcttctcttcttgtcactctaaattttattctatctacagaaaccagaaagatatcttgaacatattaatcttatgatgtaactcctcttctcaaagcttccgaagcttcctatcacattcaggacaatatacaaaatatatattttgtatattgtctgatccccaatcctcacctagtctgatccccaaataccagtccacatttttctgttgtcattctctccttttctcattttactttaatcacaatggagtttttgctagtctcctaaaatgaaaatctgtttcctgccttaagatctttttggttgttgctgtctttgcttgggatacatacctccacctcccagaactctgtgtgtcttattttctcgcttcattcttccttctctttaacttattcagaaggctgttcatgacactgtatctaaacatatctaaaattagtcccaaatcaatttcactgtaatacctcatcttgcttctctttttttaatgacaattaatactatgtatttgtttatgttttattggcattctctctgactatagttgaagttctttgagagctgagattttaggttgttcttcattttatcctcaaagcatagaacagtttctggcacacagcatattctcaatgaatagttactgaatgtgctaatgagtaaagtcaagatattaaattatagctaaagttccccagaattgtcctctattacaatgacttttgctttgctttatgtttaataattatatatgttaaaacttttgttgcagtttgcttggaatttggctaaatggagttttcttttaggaagatgtatacacatatatatgttcatagccatttcagtgaatggtaaagtcttaatatgggccctatgtgttcaaaacttctgtagactagatagtgaagaaagactttgtacgtggtgtaagcttgatgcgtggggataaatttcatgctaatgagattcatgtaaatgaatttctgtaaattcaatgaatttactttgtagaaacagcaatgtacaagaacaatttgagtggtgagggagcttggtttatgcagaagattaatgctgaggagaagcataaggttaaattgaaaaggtaagaagagcaagctgaagatactatgaggaattgccagtagtgtatttttcaacaaaaatggggaggtattgaatattttttagttggtcagatgtattggtttctcattcttctattaattaagatgtatagatatatgatattcaattgtatagcaattgtgaaaattaaaatgaggatacaaaatcaaaacattaaaaaacagttttacctatatctgattaaaaatgggtaaattgaggaccaggaaaaattaaacatgattgcattttcagagtgggaagtagaaaaatttgttgcatttaatagaaaactgggaagaaagaaactattacaaatggatttatttgatataaaagaaagtgagtttggatatgttaaggttgaggtgatcccaggtatgaaagtggagctatctagttgtcatttgtagactcacaaccagaactcaaggaagactaatactccagaattgaaagtgtaatgatgggatggttgaattctccaaagaagagaacaaaagtagacagaactcaaggaccacagattgaccttagggaataccctcagttaggagatgggagactgcctcaagtagccccaaaccttatctttgtgcctgccgttatctcttgctggaatgccttccctatataagcaactcaaacactcccattattcttgtactcaaggctatctcctctatgagttcctttaatagatcacttgagagttgaaattctatacctgattccatcttttcagactgacaggcaaatatttttcagctaaagaataatggaggctataataaggcatagtatgaagagcacaaggagtaggctggcagtcatgggttcacatcagctcaataacaagctgggcatacaggctcaaattatttcacctgtctgagtctcagctttcacaagtgtaaaaattagcatatttttattttacaaggctattgtacaatgaaataagatataatatgaaatagcacacagtactttgaaggaacttgataaatatgttttcttctttaaccagccaccagatatatctctatgcctaccaactaatggaaatatttgatctacaaaatgccttgtgggaggtggggaagggaaggagttgggacatagaaggtgagaccaaaaatgtgtgtccaggtgattgagaaaaggtagaaaacttattttagccaaagggctagagaaaaggatattcctatctttttcttgtttaatttctttccttgttaccaaaggaatgctgcttgggagaagagagttgttaactcacagaattatgcctgaggcatacttttctctcatattaagtgttatgttctgaaggaaatatgatttgcatgcaccagatacggtgcagcaagaccacttctaagcaggactaatgtaaataaaaggaacatttcttgagacagaattttgaaaataaaactgcttagtttaccttaccattcagagaatttataacaattaatcaaaaacatttcaatcaaatttaagtagtaacaaatgaggccactaacatcacatgcaaattaaaaaaatccactgtaatcacagcacttaaaaatatcaattcattatgcgaagggagtgttttagatgcaattcatcaaaatcatccagacatagtctttaatagctccacaaatatacttcaattattacggagccaaaccatttaattaatcactacaaagcatttcttccctcaaaataaaacactttaaaatatatcattcataacattacaacctgccagatctaaatcttcttagcatttaccttctacatctccagtgagagacattaatatatttaaaaagtatattactaggcactagtggagcacttggaaagttgacttattctcttggaaaatgaactactattgagtgttgattcacattaagggaggagctaagacttcaccagagactagagaagtgaatctttgctggtcacccagcacatatttatcagataacttgctaaaaacaagcaccaaattagttgctgagggtggaggcaaagaaagcaatgcctgcaagaaatttacagtcaagcacaggggaaaaacatgcaaatcaatggtacaatataacctgatgagttttataggagatctagagaatctaatggaaataacagttgataaaataagtgaaacacttgggttaggaattggagagtaagaaggcattttctaggtaatagaaagggagataaattcaggcattagtagaggcaggaagaataccaaagaaatggccaggaggcctggcacagttgctcatgcctgtaatcccagcaatttgggagaccagggagggtggatttcttgagctcaggggttcaagaccaagtgggggcaacatggtaatacctggtctctacaaaaaatacaaaaattagccaggtgtggtggcatgcacctgtggttccatttacttgggaggatcactttagcccaggccatggacgttgcttatgccactgcactccagcctgggtgacagagccacaccttgtctcaaagaaaaaaaaaaaaaacccaaacaaaacgaaacaaaccaaaccccaaccccccagagaacaaacaacaacaacaaaagaaatgtccaaggattgttgaaattgggaactatatgcagtttggcaccgtgttatagtatgtgtttggaggctatatagtatggtatacattttatatagccatactatatggctatatagtatgtgtttggaggtatagtatggcactggtggtgggggctctaggggcttgatgtagcagactggtggctggatccaaggttgggaaggccaagtcatcaagggccaggtcactaaggctctgtgagccatgtgaaagagttttagatttttatattctaaggcatgtatacccgctgaactcaatttgagtattgaataatgtgattacattttcactttaggaagattacgctggtagctgctgggacagggtggtggatcaacaagagagatttagaaaattatgtcagcagttcagacaataggttatgaagacctcatccatgaagatatcagtgaaaatgcaaaagataaggtaaaattagtaggagaaatgactggttggatgtgaagggtcagagcaagtaaaatgttaaggatgacacaggtttgggcaattagttgaagttacagcttttatccagagaagaaatagaagaagaagaagaaacttcaatcaaggtctggagaagtgatgataaaatcatcacttaatttcttggtcaaaatagtattttcttctaatgatctgatttaaatattaaaattatccagattgtcaagtacacttaattctaaaaattgacttaagtatttctactaggtaggtgcttaagaaatagctgatgaaattgaactgtacctgaccactttctaaaatacatgttccacaacaactttagaagtagttttcatttgaagaaaggaaataaaaataaaactgataaaatgaaaccgtgtacttcatctgaatctgtctttaggacacacatccaactccgtgtaccaatttagttcaagtcagccctgcttgcattatgcagacatttcagctaagaaacttaaatgtgcttcttgtgtacatttgctttcatgaccaaaccatattgtcttcagacgttgactggattataatacagatgagtacttcagacagtggctttatatcttctgaaagagaaactgataagggagtgggggggataaaaaaagaaaacagggaaatggacagtcatttattcagtttatcaagaggcttaaataggaagattcctaactgaaatcaagttgtaatgatgataatttcccaaatgtctttctcaatactgacatttcattgattcctacaaattctttaccagtctttcaaatacaatcttagtgtttataatttctggtagctaagctaatggactctagagacaaactgcttagatttgaatttaaagtccaatcctttccagctgtttgtccttgggcaatttatttaacctcacatgtctcaacttccttacttataaaatggggatactaatgttacctgtctcatggggttgttttaatggttcagtgaatatctatgtggtattgacagtagtacctgctactgtcagtctcaatttcacatgtctcaatttccttatttataaaatgggaatagtaatgttacctgtctcatggggttgttttagtggttcagtgaatgtctatgtggtactgacagtagtacctgctacatcataaatgctcattgaagttagttatcattagcccctatcatcccctttccacatcctacactccactttcccttctgtgggttctgcctatttagacttcagctggagtgtccaagaacttgactttaaatcctgtgatagttgcaaaaacagtctgacttcattcttggtctcttttctcatctacctcccaccagcagacctcaacctcttcatacttgcattgagcacttacttaggtataaaatgttgcagactctgacatattaattttccctgatagtaaaaggctacgtgccccttcacaattcttttttccccctccagaaatgggatgagtaagcatgtgacaaggcagattcgattcttattcacaaggtcaagctttagagaaattgatacattttagtagattttagagctaaaattcttaacctcaacagttgaattcaaaccttagtttagccgctcactgccttgggcaagcttctttccctctccacacttcagtgtcctcatcagtataggggtctaataaacttttcttacagggttattgtaagaagtgaattagattaaacagagagtacacatgggcacatggtacatcaccaatcaatggaagatcatggtagtttgactctgaagaattaacactggaagcagaactcattgaattgtaaaggtattttcactgtcaaaagtgactggtaggaagatatttaggcaagccttcttctatggtgtgtgaggtgtatgtttttaaaatctagcatcaacattctaggaaacagctacagctcattttttccaacttttaaatgtcacatctttttttttttttgagtcaggatctttgttgcccaggctggagtgcagtggcatgaccatagctcactgttgcctcaaactcctgggctcaagtgattctcccacctcagcctcctgagtaactggtatgatagctgtctgtcaccacatctagctattttgtttaatttttttgtagcgatggggtcttgctatgtcatccaggctggtcttgaactcctggcctcaagtgattctttcccactggcctcccaacattctaggattataagcataagccatcgtggctggactgttatatcatttttatggttatggaaatgtgatatcaatgataatcagcaaaccaagagatgaaatttagaaatttgtattaggaatcttcttcagctggtccatctgggaatcagcacctctactcttaccactgcttctgcaaaagtttgtctctgctgcttacattgagctctctgtgcaaacccacagtggtagtctttgattattgctacacaagctgagtgcatcttgggcagaaaggctttctcactggagttgcccaaagaacttcgcctgccacctactggccaggaaagggacctggtcgactgactgctggggaccaggttaggggttgaggggagaagaaaaggaggaggaaaaacagtccatagactgttgacacacaaggtctgattcttctctagcattactgaggatggtcagaaatgccccagagtttaaaagctgtctgctcctctcagcccataactcgtagtctgtctggcactattctccctggagatacagtcacagagcagtgtctgtacagtgaatgcaattaaacaaaagcctctaaaaatttccaaggggaaattagataacatgtgctttgatgtagggatttggagtttgaaggtgaaaaagacagccaagacatcagaagtctgcaactgcttagctccagttcatcacattagcattctgctaacatgtctttttttgttgttttttaaagtttttcactaaagtcaatttgctcagtttttctcaagtaccatcggacattttaaacattctttagattaagacaagtcctgaagttggacttctgttgtgagtgaatgatgaaatcaatttttcttgtgtttttattagttaatcaatcaaagggaaaagtgcttgctagtccatttgggctagaacatttggttctcattttgctatgctggcaggccgtagctctgtgcatggatgagaaaagtctacttttgtcctggtccattctccagcaataagccgtacactcagctgtatccagtggctagatagttcctgagagatgtgtccacagttcactcagagttcctgttccccctcattttcctctgatgttccttctgtgccttttctgcattgtcataatgtgtctgcctgagtcagagcacaatgtctggtgtgcctgactctcactaatgggccaagtgtggtcctgctctctttagcttctaatcaagactccagtgggatccagagtaaaagtgaacaggccacagcataggggaaaattaagatggatggtatagcacagcaggagcttgtttatccctgaggaatataagtagggggaattggtagaacttgctctcattttcacaccttgtattaccacgacagtgatttactgagtatctactcagagccaacctagggatgaatatattcttgtcctcaatgatctctggtagaacatgcatgttggggggaaaaatacagtgactttctgtgtgatacgtatgaccaaagtaaaaccttgtaagatgtcataaaacctcacaggagttttgggtagggaagaccaaaatctcctctccttttgcctaatccaagatagtctaccttttaaggagtgttgtggttaggaaaggatcattcatctgggatccagatcttatgaagggtgtattagttttctattgctgctttaaaagttgaccacaaatttagtggctttaaagcaaaagaaatttaatatcttacagttctggagatcagaaggctgaaatggcttccactgagttaaaatcatggtgtcagtagggctacattcctttctggaggctgtaggggacaatccatttccttgtatttttcggcttctagaggctgcttgcattccttggcttctatacccttcctccacattcaaagccagcagaatagcactttcaaatgtctctccgactctggcaccccgcttccctcttgtaatatctttgtgatcacattgggcccactggataatccaggatcatctttccttaacataattgcacctgcaagtcccttttgccatgtaagataacatagtcacaggttccagggaatagcatgtgaccatgtttgggggccatcatctggctactaaagaggacttccaggttgatattattctatcctattacttcccttgttttattcatgctattgaagatgtaataagatttttttgtttaatttagcttttgtttttacagcaattctacatgatgatgctgagatactagccaacttatatcccaagttcttttctaattccctgttaattaactatgttcctgcatctggcactgatgcagttgtttgtttggacctgaatgtaggggaagggcaaataatcttttggattggacattggctcctagtgaggtgaaaaagtgttcccctcaaccagaagtggagaaggtggatgaagacttttcacataatctctgagactgctatggaatttaccagatgggcagagtggagagtatgcttaataaccaatagcaagcctcttataatggcagtgttattatcttaccctcaggtgggccagcaatgtcctagagtttaatgaatctgcaaaacaaaagtttgaatatggagcaaacaggaaggagggaacaattacccacttgacatatcctcttgaaagcttaccagtcatggtactgtggaaagaacatgctgtttggactcagacaaccttggatgtcaggaccatttgtgtcccttaccagctatgtaatcttagatcacttaacctccctcagcttcaagtttctcacttttaaaacagagttaataatatctgactcatatcactggtgtgagcttagaatatgtaagtccattgttctcaaagtgaatctatgttgtgattcctaacccaggaatgtcatcattacttggaagttccttagcaaagcaatctctctggccctactccagacaaactgaatcagaaactctgggttgggaagtcttaccccataaaatagtagtacgcaaaacacatggaaaagagtctcacgcgactggactgggacttacttaacaaatgctgattgtaattattcttttcactgggagcctcattatattcaccatgctttttgcttttcagttactgtttgttttggaagaacatggccaatgacagatttatgtttgtttaccaagttgtggtctctcttttttctcaaactaaaaagtcacataaataaatgaaagaaacagcattattagtttgtatttctggctgtgccgttttaactcagcagagggggagtcacgcactctggcaacttctttatccagaatgtgctgtcgtgatgccacagagcaaggctaggcacaaagcttatgcacctgagagatgctgtgactattttcttcagttgcttttttaaattttttgactaaatatacatgaaaaacataagcgcacacatacctcaccaaatacagcttcatattatatgatgcataaaatttattgcagtgatttatcatttagtttctatgtaattaagtaaagatggatccacatgttctgggccaagttaaaactcatattttttatgaagaatcataaatgcactgccaaaccacaacaggaatgagggaaatggctaaaactcacaaaccgcctttaaaccctgaggaaagtttgacttctagaaaagcagttaagcagaaacttattaacttgccaccgaaggatgtaatgaaaatttggagggccatggatccccaggatagagcaatgatttcctagtagttcaggcaggattcctgaagtcaaatatttccatgtcagtagcattctaaagagtaaagtcatgtaacctactcagattgtcaccaggactgtctattaggtggggtcatgagatgaccccaggattagtgaaaagaaaactcacatttcatggatatgaactgtgggacacattcttttcttttctttttttttttttttttagatggagtcttgctctgtcacctaggctggagtgcaatggcgcaatcttggctcactgcaatctccaccttctgggtttaagcaattctcctgcctcagtctcccaagtagctgggattacaggtgcccaccatcatgccccgctaatttttatatttttggtagagacagggtttcaccatgttggtcaggctggtcttaaactcctgacctcatgatccgcctgccttagcctcccaaagttctgggattacaggcatgagccaccatgcatggccctgtgggatacatcctgtattatgttcacagtggacctttgagcacaatacagagtgaaatgaatatttttgtccttattttctagaggctctgagaatttaagtgcttagtctagggtcctggcttataaatgtcaaagtcaggattagaatgcatgtcttcgctgacaaggctcacttccctataccacactacttctgtcaaattatgacatgagagacaccgacggctaccttgttccatcagggtcacttggactgatttgcctatataccaaaaaaagaaaaaaaatgttgcatttagggttatttctctgggactaaaaatctgtgtcaaaatatgtggcagaaatacattcatcatgaccttatttatcaacagtaacaagaacaaaatgagatacatgcttgagaaaataaatccaccagtaaagcaatgttggaatgaaaaagagctttgaagatacatagacctgcgtttgaatcctaaattttggttctaccacctattagttcactaactaaaggctattaggcctctatgtgcttccgttactaatttttctttatatgtggataggcgatgatagtttctattttaaaatactatgtgaagatccaatgagataacagataaaagtacttagcacagtatctgtcataaagtagttgctcattaagtgtttactgcataaaggatgaagcaagccattattaatccttatcatcatagcacagattaatttatctcttctctagcagagaggaggggaagttttgattgcatatggtgtgtggaggcatcaggctgatgctggggaggtagccatgagtattatggaattggatgtctaaagtgggtgttaagaagggaaaagaggcaactgaaaggaaattgggaaagctggaaggtggttggctgatggctccttgaggctaagcttataaggaaacaatagaggatcctcctctgccccttccctgtcagcttcatctcctgttacctgctgacacacattttacatgcttgtgattccctgcacacaccatgttgtttcatacttctgggctgttgctcctgttgtttcccagtatggtgtattccacggttttcacgtggcttaatcatccttttttttttttttttaatactttaagttctggggtacatgtgcagaacatgtaggtttgttacataggtatacacgtgccatggtggtttgcttcacccctcaacccatcacctacattaggtatttctcctaatgctatccctttgagattcaactcaagtgtcacctttcctgaaaccttcaaattggacttagtttattcttcagtgacttctgatttctctgtgcatttttctctctcatcacttcatactctaaaacattgctttgtgtatgaattgatctcccccactactctgtgagcttttccaaagggcaggctttgtgtcttgtttatctttattctcccagaactcagcaatgtacccagtatataatgattattctaaaaactctggttgaattacactggactgaaccaaggtgggaagcataaggatcctttgcctatttcatttcacttcagattaggcactctctccaaagaaaagtaactatatcagggtttgtgactcagctcttggcgatttatggccaggtgagtttgtaaatacagccccacattcgaaacaacaatcccagcttgttgttctcactgcttttgggagctgtcattccagtcagtgtttctgcagttcctcattaattgttattatccaaagtaagcacctgttgaatgccattgtgctaagggataggtgggatttggaaaagggttgcaatttctgctgttgagatttcacaggctgcactcctgtaattttgttctaaggggagagagtgggaaagggttagatgacttgaaacattgacctgctggcaggtggatcatgaggtcaagagatcgagaccatcctggacaacatggtgaaaccccatctcttctaaaaatccaaaaattagctgggtgtggtggtgcgcgcttatagtcccacaacttgggaggctgaggcaggagaatcgcttgaaactgagaggtggaggttgcagtgagcccagatcatacctctgcactacagcctggcaacagagtgagactccatctcaaaaaaaaaaaaaaaaaaaaaaaaaatacaacaaacaacacaaacacaaaacagcataattctcaaagtatatttataaagttctatttttttaagtttgtgggacttcttggagggaaaaattagtaaatagaagcagagtaaaaatgtggtttataaagagctcataataaaagtttataataaaaactttgtaactaaaaatattataccaaaaagtagtgtaagtcttctcaattcctgtaaaaatattatacataataaaaataagtcagtcagattttattctcataaagaaaatctatacaaatatttgaaaatcaccaccaaatttcaggcagttcttaaggtttaaattttatctcagaagcttttgtgtactctattcacaatcaaatttggttcattcaggatatgatggaatcagaagtgtgcagtgcaataaagatgcagggagcagttttcaaggaaattccttggcggggagttctactcctcactcattaatctcagtttttcctcagttagggctgccatgtttgtcataagggctggaataaggaacacagcttaaaggttacctgagtgggctatgaagctagcttccttttattctaatccttcctcttctacttactatctgaatggggaagtcaattagcttctgtttgcctcagtttcctcatgtgtacaataaatgagctaataatgcctaccccatagattgttgtggatataaaaagattcattacatttaaggggtttagagcagtgcctggcccatagcaagtgctcaataactattactccctagcttcagccttttcttgttcactggcaaatgccagtgcagctcagacattagttatttatccatgtattcatttaacaaacatttttgagtattgagtatgtgattggcactgtgcacggtgcaaatgatacagaaaatgagtaagctcctctctttaataagttcatggtatagtgtgtgtctgtggcgagtctagagatgatggtgcaaaagagtctttcaattaaacagacaattctaacgtgggatgataaatgctctgtagtgagaagcacatggctcatttggatcataaggaggggaacttaatgcagtctcagagggccaggagaggctttccagcagaattggtatctaagatgagtatgagttggccaagtgagagttgagggtgagatggggtaggtgtatttcataccaaagtagctgcctctctagaggccatagagcaaggaaattgtataaggatcagtgtggaaagtcaggcagggggtggccagaagcaaggctagctaagggtgaaggagtcagattagcaagggcctttcctattatgcaaaagaactttatggctctatcctgtcctactgggcggagaagccctgaaggcttctaaacagggtttaaaacacttagatagtttttcttgtttgaatgagtatcttttaaacattatttctaatttcgggcagaatttactacttctacctttgggtccttctgtttctctataggctcctatcatggcactgtattgctttattgaacttaactgtttctaatcctgcctttcctgggagactgagggcttcccaaagattgttttttatctatctctgtatccctaggatctggaacagttactgatgctgctgagtaggcattcaatggaagcttgattttaaaaagaaaagttgattttagaaagaaagcattttttttcttatatttttaggacaaagcattatcagataaaatctggcccatcaagtcagcaaagtgagtaatcttgttcactctgaaggcagtgtgagctccatgaggtgctgcccaacagatctctaatccacctgtccttctgtgtgctctttattaatcactgcatggcaagcactgtgctaggcaccaagggagatataaatacgctgaagacagcattagatagttgtgaaaatgttacatatgtacacaaaacaaactcaatatcccgagggcctagcacagtggtggtattgctcagtcctcagtcaatgtctgtgaataaataacaagtgaagaaagggagagtgatatgtgtgaaatatatggaatacataataaatgctccaagagtccagatgtgggaaaatctgtgagatgggtaaatctgatagggtctcattgaggtgtcctagccttggaagatgagtaggatctggagagatagaaggaaaaggtggaggactctaaagaacgagaaatagcatgaacatcacttcatgcagactaataatgcctgaaggaaatataagccattggaaattatgaaagctctgacaacaattggagtatattggaattcacacaaatgaaccagttttctaggcatattgtaattcggccaatgaatgtggggagaccagcagttgctttagcagacagccaaagtgggccctcgtgacaatgctaattaaagcaaagttaattagttaattaaaacagaagtggcaaatggcagtttctaaatttcagttaaggtggaggcaacactaatgattctgccccctgactagaatcccaggggagggttttgacttctgagaaaatttataacttccagctgtaggtctctgtcatcaatttagccatgaaaggcccattgcattttagaaccccagttccatgtgcctggaaattctgaatcttgcagagctagaactttagattcatcagattcaatgctttatttaggtcagaactggccttgtgttcatttgtcaatttgcagctgaagtgaatgccttaaacggaagcctggcattatctgcttgacaatgatttgatgctgcaccatgttgtgctggaaattagtgtctagaaccaaaatgttaatcacagggacctctatacattgatggcataaatagcatgtttccatataaaaaaatctgtagtgactcatttccatttaaataaaaatctccctttgctatttcagtgaattgaatggctgattccgggcccttttctatttgtgctctaggttgagccaatttaacttcacagaaaattgttggatctgttagaattacctctgttgtctccttaggtgctcagagagctcaaagtgattctttctccatgatgagaggtggaaatttgcttcgtctagcccccttctcactaaagatatgaactactcttcaggccccataaacatgtcttctcttgggtctatgatgatgttttccaaagtaagttctttggagcatcagttcttcagaatgttaagaggtttacttggaaaaaaatggtcttgtatacatgtttgcaaaatgatagaaagagttaacaaatagatgataggtttctacagtgcaagacttctcagtgtttatctccaataagagaatagagttttttcacctttttgaccaaataatttctttttcatggagctatttaatttttcaaagaatatactaattttccaaagaaaacagtccatatatgcttagctctagtaatcatcagctaagaccttaatttaaaaactgctccattactcattagtcatgaaacaataggcaagtattctcaccgtgcaggacctcaaatttcccatctgaaaaatgggaggattgttgcttcaacttgcagtattttatgacaattagaaatgttagactagttatacatacaaaaagttctgtaaggtggcagaacatagtaggtaggtaataaatgaaccattttgggggactactctgatttgaaacttttttccagtctcctactttgtgctccacttcttcttacttctttcctcttctttgctctcttctctgttccattcctcttccttctgcgactgctaccaccgtgactactactaggtgctaacattttaggcactatgcactggattatctaacaaacacctgacacgccattttttctttccatttccatgatagagatggaagaggctaaatgtcactttcccatattctcttatattagacagtttgggccagtgagacacaagggcaattcttatgggactctgagaagacttttgttttccctaatgaaagtacacaatgtatggaaccatgacaactatattacaaccattagtaaaaggcctagagaatggtagaagtgtttgcctttgcatcactgaaccaacacccgaagaaatctccctccacaatttttataacatgaggaaaatgaactctaaagagtataagtgtttgaaaacaggctttctgctacttgcagacacaattctaaaaggttgaggtagcatttattgaatactttctacgtgctggtactaaacacttaatgcatattacctcatttactactcaaaataggaattattatctaccattttacagttgagaaaacagactaaagtgccttattcaaattcatagctgaattgaaatccaggtgtggttccaaagccagaactctaaactagtatgctgcctttgcattttccatctgtgtacatacacctttccaggagcctgtacaaacttttggagacatagttaccataatcttagatattattatagtcttcattttgaggtacacaattagtatcctctttaagatagagagcccttaccatctgccattccatgtggaagggacacacacgaccccatccagaaacagagggcatacccaatctcagattatagcagcctgtttcttcatacacctgacagaggacagcagaacagggctgggtcgagcatggtagatgcttctccaccaaagacctacatccagagactttatttacctatttaagcccacatgacatcccaagagatgggctcaatagcatattaaaattttcaagactgagaagcacaactcagggaagcaatttagaagaaaatgtaaaaatattagaaatacctgaatttatttgtttcccattagttaagctgaagtgcggtgaaccatgtgttatacactggcttttcataaaagtaattatcaaatgggagctgaatccctgcataaccagctatatcctatagtgtaataaatatgctaaacatcacagattttgtatcacagagaagaaatatttagttttggagctcatggaagccatagaggaaaggaattttagtttgcatctctttctaatgactgtgggttaaaaaggagagcagatatcagatgcatgtgatacaaaagaattatagctttccctgcccctttttcttatccatatcaaaagcaggttctagcttgaatatgccagttgatgtcaaaaaagaaatctccatataatcagactgtggcctgtgtcagctataatcacatagacagatcaagatttgccaagattgcagaaagaagaccaaacacttgccaaaggtttctctttaccctctttcagattctaacatccaaatgcacagatttcaaaaaaactacatggccctgtaggaaaaacaagttaaaatattgcaacaaaaatctttagaatttccgttttctagtggttggcactatcagtaaaatttgttgcttttgtttgtccctttgtttattaaattagaaacaaaacagttgaaaatatttattgaatgttactagagaaactttataactatagtaaagcaagggatcagtgatccgattctagagcagagactgatgaccacaggagtgagagagatatctgtaatacagggcactgttgccttaatcttataaaagttaatagtacaactagggagtaagagtgtgcacatttgaagacaagcaaaaaaagtacctaccacattaataccatcccaaattcattcaacaaacataccaaaaatcattattgagcatattctatgtgtcaagcacccttcaaggtacaggtaggtattggaggcacagtgatgagcaaggtaaagaaggcctccatccctaaggagcttgctctgcttaaattggaagacaggatgtgctatacagaatggcaaagagctggacaacatgaagatcgagatgccctgtaaaactcagattgtataatcaatgtctccataggtttgtgctgccgtttatagtgctgtctttgttattaagatcatccagattgtgtattgggtacagtaactttcatgagtaaaagaagactgacaatggttaacttagttaatcaaaatagcaaatacttaagaagggcttactatgtggcagacactatacacatgttaacttattcagtcatcacaaccagtctatgaagtatgcatttctttatctccattttttcggaggaagaaatcaaagcatagagaggttaagtgaatttgcctaaggttctgcacctgctaagtgatgctgccagtatttaatcccagtgctctccagcactatactgtgctaccttcaataaagtgcctactatgtgccagccattacacatattatctccttcattttttacaatccagtttgtcagatgatagaaataaggtgcagagagacaaagtagcactgctgttgttcaaacccaaaacaatctggctaggcagccagtgttctctgccaccactccatgctgtctccctaaggggctttctctagtgagttttttacgtgctcagacatagactcacaattcccttcctccatcaatatgcttgttttatataccaggctttcctgggagattctgtttacagataggacttgaagaaaagctgataaaacaaaagtttgaaaaataaattttcttagccaaaaggaaaggctgatcttgcagaaatttcagaaaaagaatggttcatacaggagtcaggaaggcagatggaaaataggccagcaggttagatatatgaaaggcctgctgtgtacagaccatgacattgccaggatttattgaaaaagaagacatgagttacagtttaattgaatgtcttgtacaatgtacgtagaaagagatgagaagtgtaaaacaagtagaaaagagttgaaagaggtaagagtacaagttaataatgtaaacgaattggaccttgtggataaaattcaactatcctctgatttattttcaaacttcagcagacatagtatctttaccatcataataagtcatactttgaagatttagggctgacagaaaagtaggactttcctgcaggctaagtgatagtataggagaatagttcaagagatgttatttagatatgtagcttccatttgaaatctacatatcttccatttatttatctagattttagaaatactgttaaatttcagaagagttagcagggctgatgtcttgaccagctcttttgattacacattacacttcttaaatagaggtgatacttagtcccagttatcaacaattggtgttgcctttttcatacttcaacatttttcccaagccactgataacatgatcttgtcttttgaagtgctttgggatcatttatcacataaggaagttccttatatgggggaaatcattggcttctggctttagattcttttcagattgaaatggtcgaataactactacctgtgatattgaacttggggtgggatgagactataggcaacaaagaattgggaaaatgactggttgtttttatgtgcaaagtcactttgttgttttgcccttttcagctgcttagacatctcctaaagatttcatcttgcccattaagaactaaaatataaatcctacattcttgtgcctctattggatgggcatttaagcactcttctggcttgaataaggtttaggcacgtacaagtgcagtctgatgtgtcgagttcttggcattttgctctcagtataatctttgttagtaatatatttttactctgttctggtgaactagaatttaacccacagtataactctgtcccctcagaacttgagggtccttgccttggctttgtgagctaactctgctctgtctgccctctcaacctcactccccctacgctgtaactctgctttattagagattttgacttccatgtttctagacttggcctaagtaattggacccacatcccattaaccccataaataccattttatgagaaggtccatgccgtaagtcaccctgcctcacatggtttcatttacccagatttctcccatttaaaagacccaggaaacacatgcctctgctccagttttaggggccagcatccctgtaagcccccacaacttttaccttaaggtttccccagaggagccccttctcttccacaggttgactaggctgctggatctgctggctgcggaggatgacttgccatcccctacatgcatgcgcaccacggtagatgtggtgaaggcgctgcgcacgtttctctctggtttggccaggatgatgtacaccttcggcacaaacatgcagcctagggccactgtggcactgaggctgaccgagaaacacatggtgatgattttgtagttgctgccaaagtagattggcacaaaagctagccatataatgcaggtcgtgtacattgtgaaggcgatatacttggcctcgttgaagttagctggaacatttctggtcttgaacgcatagaaggtgcagctcaaaatcaacaatccattgtatccaagtggagtgacaactcctaggttggtggtgttacagatcaggtagacttctcgaatgcttgggtagtcatgcattatgtcaggaggctccattataaagagggcaacgatgatgcccaactggatgcatatgagaatgaaagcaatcactagctgggcacaggcactcatgaatctgggctttttggtacagatcttcttcttgctgccagccaggatccttgcaatacggttggtctttgttacaagggctgagtagctcatggctggggagagaccaatgccaattctctgaaggtagcagtaaatctgtttgggcttcgcaatgaggcagaaggtacataagtagcccaggcagatgccagcaaggataatgtagcagagttccctgcttgaggacttgactactggtgtatcacggtaaatgatgaagactacagtaacaaacagggtggccaggaggccaaggcaggcaaacaccacagctgcaatgggttcagggtcaccccatcgaagatactgtactgggatcaagtcacaacctgcagagacacaaacacatattgtaaaggagggagagatgttgacttgggtcacatatccctaagttacaagcagctgtttatgaccatttcagtttgttccccatctacctttctaatttcagaatctcctgctacttattgtttcatgtattcattcagaaaacgttaatgatgatattactgaacatgtacatggtctgtgataggaactattctaggttctgaaacaaaataatgcagaacatgtttcctgctctcataaaaaaaaatcagtggccttttaaacaactgtaactgtgataagggtcatgaagaggtataacatgggttctaagcagtctcttgaagcagcaaaggcctcctacaataggaatgagcaaataaatgtgttggtttgatggagttggggatttcatgggcttggcaaacttacagttaaagtacattaactgtaaggaagagaggcatgaagggaagccactgtatgacagtgtaacaagtggcctaagatgaggctgggaggtagggaggaaggggatcttgcaggttagagaatcctagatcagtaggaagttattctaaggatctttgtagagcaatgacaagctcagatttgtgtgtgcgtgtgtgttttaaacatttctttggtttctgtgtgggttttggatgagataaaggtgtgcacacatttaagacttattttagagccatatagagtgtttgaatggatgtgggagtgtgtgaaaagtgaaaaagatatgaaatatgaccaacactagtaaagaagagttggaattttcagagaatcttgtggtctagatgttttagaagattctgttaaaaaaaggaggaagttcatttttataagaaaactgaccccaaaggcaaacaattggcaggcaagggaagtgcaccactctcaaaatcgttccttattctttatttatgatatggagtttttaaattattccttgattatatagcagaaaaatagtgacagaatatagcatcatttggattatctgtcttttacaattttttaggacagtggttctcaaagttggctacacactagaatcaccaagactatatatatacatatttacacacatatataaaatcctgagacctgggtgtcccattggttgagcttctgacttaatttgtctgagtgtgacatgggcatcaggattttttaacaatactgcaagtgcttctaatgtgcaaccaaagttgagaaccattgttctaggaggatcattcctgtcagttagacttgaaagaaaatggacttgagatagcttcactgagtaagtaggaaaggaggcaagtaatctggagcattgggcatttgaggaatgtagcagaaatgactaattgcatgtcaatatctattctccccttcattctcagcaatagacctctaatttcatttgggatggtaaaggcattagttacaatactacatttttcatcaaccattgctgtgaaatgtggcataggaataggtttcagccaataacatgtacacagaggattcctgaaaggaaaatgactcatggtagaaagtaacctttttcccttctttactttcttcttctgctgcctggcacataaacatgatggctacagctccagcagttgttttggacttcaaggtaacttgaaggacagaaaatgtgttctgggtttggaagagaaaaatagagggggctccactccctgagaaccatggaccccccactacctgtggactatgcatatccacatcttctttgtttaagctcctttcatttatttattttcttgatatatgcagggaaaacaaatcctcattgataaggagtaaagttttcctattaacttgtcctatcccatgatcaagggtgttgcagtcagtggctttgaatatcaatggttactgggaggtaggggaggcaacaacaagtaatgacagcaaggaagcatgtagttctttcaaaatatgcctaagggtagcttcgttgtagaaagggaagggaagaagggaagggaagaaacaaaggaaagagaaggggaaggggaaagggaagggaagggaattattcttccccttatttctgccctgctgctgttttgctttaagatctcacatttcagatagtactattagtactataattaaagtcataatggatttaataggagttatgagctagcctgggattctcagcacactttgtaaaatgtttctatgggaaaatgtattcttactctaaataattgtgcatttaatattgaaacaaagggctttaaattttaaaaaattgtggatagctcagactaaatataactaaatacaaaacagttgtgttatatgacctcattaagtataaaaatacatatctcattgctaattaatatacctatatctgtatttctagtcatctacgttcccatgtgcttcctatatagttggaattcaacctctgatactttagtatgccatagagtttaggcttatatttacaaatttgctccttggagaggctgttttaccaaaaaaagtattaataatatatatatatatatatatattttttttttttttttttttttttttgagacatagtcgccctttgtcacccaggctagagtgcagtggtgtgatcttggctcactgcaacctctgcctcccgagttcaagcgattcttgtgcctcagccgcctgagctgggattacaggcactcccggctaatttttttgtatatttagtagagacgggatttcaccatgttggccaggctggtcgaactccttgccctgagtgatccaccttcctcggcctctcaaagtgctgggattacaggcatgagccactgtacctatcccattcctatatttattattttatattagttcatttatagcaatgatttgacaataaaatttattaaatatatagaggtctgtttctactgctaggtcatgtgctgctaacgtccatagcaatttacttatataggaaacgttatgtttgtatatagggcaggaatcttttcattacctaaaagaatgagctggaaaaagtaattaaacacttaattttaccccagtttttcctactgttctgctaaatcttaattgttttcatcttaatgtaattaagtttaatttctaaatactttgcatagaataacatttactactatttttatcagatatatttttgaactcttcatgttcagcttattaacatctgtgtgaaactaaagaaaactcattagatatatgtgttaaaaatgtacatgaggcttgtctctaatgtgatgtaattattttcccaaatctttcaggatttatatattaaatgaatgcttcttttatttaatgtaaaccatttagaaagtcttacatttagtttgatgccttcattgcaaaaaatactgttgtaactattctctaagaatagcaaactggactctgattaaagggttataatcactgaatcttataattgaataagatcttagagtttccaaaaaatggatgcgtatcacaatcacttgggaagcctacaaaactgtaactcaggagtctaaactcagaagattttgagtcagtacattgtggtggggcaaaggaatctttattttgaataagcaacttcagttatgctatattagtctttggtgcaatttaaccttagagattatcaagccaaattcttacccatcgtgcaaatgccttatatgataactccaagatgtaatcatcctaaccttacttaaggctttttataaaatatatcatctcaagggcaggactggtggtggtgtggggagatagattgaaaaggcaggaggctgtgatggcaagtgaagactggaaatgaagaaaccagtcagaagactatcacaaggagacagggatgataaagacaaaaactaagtaactgtactagagaaaacaattagttggtaaagacatttcagaactggaattgaaagaaattatgaagaagatagaagaatcaagaagaaaggctttgtagctgatagcaatactgttaactaagatgagggcttaggaagcaaagggtcacatttcatgggaatgatatctagctccagtttgagcatgctgtttgtactgggtctgacctagtgagctttgaaaagctatcagtgtggaagttacagctttaggaatcatctttttatagaagctgaaaataagagacatggaaataaacacaaccaatgaggaaattcttagatgtggatgagagcagagcctagcagtctggtgtaacaccaatactaatgaatgagagagggagagaatatgtcagagaagatgtaacatcagacagaaggaaggaagtgtatcagaagccaaaggaaagtattaattggatggcccaccacagtctcctctaacaatatcagttctgttttactttttaaaattcttacccaaatagcttgcacaaagcttcaagcttcaggttcacagatatctcttctgacattagataattatatgtttttttcccttcactagtattagatttatttcttttgaataagggatattatactttctaacatgaaacaaggtctaccaaatctcagaatcttgaaataatgctaacctcattatgatataaatttaaattctcagtgataactacccttactatgtacacagttgtacaaatatctgtgtagttattgttcctaacttccttattttcttctaatcactgggcattttttccatcaatggttgtattttttatccctgtttcatccttactgtaatggtaagttactggaagtgtatgtagaggttacctaagagtctaaagcgcatataatgtatagttttattatgaatttaatcaatttagcatatgttattatattttaaattaaataatcttgatcatgtcagtgaaattccttcctaacaagcatattgccatttctctggttctcagaaaatgcacagtattatattattttctagaaatgcagatgaaacatggattagaaaactgcggtccattttctaataacatctatttaggtatctattcacttttaatttttcttcccttttatacttgattcgtaagtctgtggttctcttgtataatccatcttttcaaaacttgaactgacatatattgaaaagacaagtttttctttttttaaagagggaaagtgagctgccaaaactatattgtccactttcattctattacttcactaatgtgttccccataagtctaatagcagaatggatgatctactgattttctggacccctaaaaatgatgtgactcctcattcacagctggtactcatgcttagattgttagttttgcagtattaatattcctgtagttactagtttctagactgctgcatttttcaaaccctgttccaagtgtctcttcagggagagatgcctgatgttctgtaaattgggctgaacaagagctccttaccaagctcctacattcctgtatattttggataaaggaagttgctgtttagaatctctgagaataagatgtatgtgctctcagctgctggttaggtcatttcaggtatacaatgagaaggaagatataagatagattataaaaaactgatctattaaaactaatatggggatacagaactgacaaggggctgttgtgggtttcctctttgatatttgagcaacagatctgtccagagcacaaggtgttgactggtgactaacaacatcatgcttgctttccatctatttaactaataagccatctttctgcctttccttctttctttacctctctggatttggatctcatggatgttgaactgggatcacagggtgatacagaatcagaattctgtgtctagtgttcatatccctgatcctttaatattttttctttacttagcctgagctaaagtttttcatcacttccataattcagagaatttgaaatggtgggtgtctgtgtgtgctgtgagacattgaggaaactcatttctctctgtagcacttactgtatttataatctattttgtggtagggggagtttgattgactgtatcattaaggtctgtcttctctacttgactagaagcaccctgatgatagggagtttgtctcttttgcacacaaacgggtcctcagtactgagcacagtgcctcactcatatggttaatatagcattttacaaattaatatattttgtatacaattaaatatagaattctaattctagtgcatggataagtcattctcaaaaaacttttgcgttgcctttagaagtcccaagttacagaactattatgtagtgttttaggcagaagtctaaaatcaattcactacacctgaatttgagtctagtttctggaacccaaagagggcaaaactagataagcagctcaaaaacttacttctgcctagggacgtgacatgtttcatattagaaatattcctcgtgggcaggtgcagtggctcatgcctgtaatcccagcactttgggaggccgaggtgggtggatcacaaggtcaggagttcaagacaagcctggccaatatggtgaaactccatctctactaaaaatacagaaattagccaggcatggtggcaggcacctgtagtcccagctactcaggaggctgaggcaggagaatcgcttgaacccaggagatggaggttgcagtgagccaagattgcaccactgcactccagcctgggtgacagagtgagactccatctcaaagaaaaagaaatattcctcatgctgactagtcatttgggacattttttatgactgattaatctaattttgagtaattcattggatctgggaagtatgtatagaggaaagaatgagacagtaaccagtaaagtcattctttagaaagtgccatccaactatgaaggtcagatagatgtacttttcttaaggaggctgttaattgtaacttttcttttcttttttttttttttttactttagcatagaaaaaaaaaatagaaaagttcccaagttttcttcaaggaaggcatattctacagttgattgatttttaccttagcacgaaacaaaacatggcatgattgctttctccaataaaaagagagtctttatccaaggtgttaagcaagttttattggtaactgcctcaacaggaagctgccatattcctctttatgtcagtatcaaaagaaaaaagagactaacatttattgaatgcctactatatatcatgtgttattccagaaattttatgtaatcatcataataaaaaatgaggtaaatatcattatctctatttttcagagggggcagtatgaagcttaattagatatgttaactttctgggactgagattaaaactctgtggttatctactaacttatttatttattttatctttgctacatcaggggaggcaacttggccagttactcctctgaaagaagtcctgagtctatttagtaggaaacagaatcatgattaattaacaatgtctgcatgggcaaggtggggctagtggtggcataaatatttgatagctttatcttgatataaatccatgcttcctcttgagaaatctcattggttcaaacccttcagcaagattttcgttctgggctatatgtccttagagttgctgccagagacactgattgatcagttgtttttcttgggttcctaaagttttctagcatagaaaatgttctgaatgatcattcatgggacattcccaactttgctacagagtagactcacagccatccatttgtcattggacctagcctattccccatccttcaaggtttattacacatctcgttttagattccttaatagaattccttcacagagctgaaaattcacagctatagtttttatttttgttttttttaattggttatattttataggggaatttgaaattgtgtgcaaagatttattttataattaagacataaagaatgatttaatagtactgcagagtactaaagggaaatgtgatcacagatgcacatttgtaggaaatagctttgaaaaatatgacttccggtcatactgcacatggataagagtggaaaaacacagcatgtgaatttaaataataaagcgtgctgactggaataattccctccctttctacttttctccagtccctttttactagctaacttctccttattcttctactttccagattctccttgatgagtatgacttttctgattccctgaagctgactgacaggttcctctcatgtggtcaaatggctccctgggcctgtacccgtcatagcacttgcattcttactaattgtgtattagtattgtctctttgaaatggtagatttagcaatttgagaggaggagactgtttctttgcttgttgtatttctagtgctagtcatagtacctggcacacaataggcagttaaataagtttaatgaatgaatgaatgattaacaaagaagagggcaagtaaggaataaggaggcatgcccttcattttcagcttgcacacaaatatttcctattaatatgagccttttactctatgtctcaattttttcatatataaaatgaaaataatacagacttatcttatctataattagggttttaatctggagaaacccttgcagaagaattcacagatgagaaattaaagaccaatgacctgaaaaaggtcagtgaagcaatttctcagaaataaatttataaaatgcttaaagttgtttttgtattttattgaaataaaacattaaactcatcattttaaaaccgatagggtatcagtggaattttgcacacataataggagctataatttggattttacgattcatttctatttatccttgctagcttgccagacccttgtcaagatccctttcctgcagttttagtcagactcataaaattgcttattttgcaaataagctgcatactaaaaagcactttcctactgtagctggtcatccatccaaatgttcaataactttctgattttgtgactcagaattttgcaaccactctccaggccccactatattccttctgtgttcccatatacccttgattttttttttcctttgaggcataccaggactattctaagacctgaaattacattacctttcctaaggaaggttgcaaaattgtatgcatattctgccacagattttacctcctttttctctttccaagcctatttgttcctaaattttaagtatcgttaagtattctccagttgagctatgggcatacatttaactattcaaatgctcatgtttattacagaaagaaaatatggggacaaagtgcacacatgtaagaaaaatgtacaaggggaaagattaatgcctcatcccacccattaaagagattgaacattgttcacacagcacagctacagcatttcactcttgagcacctacaccattcataccacttggtccacactatggtgatagaaaggtaattgtttgttcctttaaaataatgtattgaccaaatgctcaggctctgtgactttactctgctagtcattgtattgaacactttattcttattaccttctttaatacctacaaggtcctcatgcgatagggaccattatttcatctattttcagttaaggaaactattttctgttggaactaaagagcatttgaaaggaaccatagaaagagaaacacagacatagagaaaagcagaagaaatgtaaaggaaacagccaaaatgcaaaagtcagatatgcagaggaaaaaactctacagcatagtaatgtatcaagagaattacaatgtctttgggaattattgctgatagttcagatggggaattagcaaaagctttaggagggaaggtgataatacctatctgcctacatctcaaggattagtgtgaggaccatataaaataaattggacagtggcataataattatgaagtgagagaaagtggaaatggggaagtgtatatacaaaacggtgtgactcaacatctgctaaagtgcctgttttattagattatcctttattattctggggaaaagccaggctactttctctctctagcttgtttaggtatgtgttgccccaagtaaatggtattatgttgtcttaaattgtctgtaagtacaagacagcccataatgctttgaatttttcatcacctcaattaatgtgattttttaagaggtgtcaagataggaggaatttatctgcttcatattactcatataatatatcaatgctttgtgaagcattttccaagtaggttagataatgcaatagttagcactgtatcataatgtttcttgttctaaggggaaaatgtgataatttattttgggtaagctacattgaccaaaaactgaaatcaatgaaatcacattattgtcttcagtctggccatgtcagagtggtttttgaccacaatgccattgttttggtcagaccacaaatttatcattgtgaagaagaacatggtgaacatttttcatcgagtggtttctggcaagatgaaaactggtttatgttcttttcagggacctgttttgataagttccactaagagaggggctttcagccctttttttcttctttagtcagtggcgtttacaagtttaaatatactgactttttgactcatcttgtaggaagaaaattattaaaagttaatgaacgttgagaaattggaagagtaagaaggcattttagaatttatcaatgtgtaagccctggaatctcattttaaaagaaccagaacacaacattgttgtttttagtgctaactgaaacaactttatcaagctaactgtttgaaaaaaaaaagacagtgcacaaaatttttcattgcattttagagatcctgttagaaagaatccattgattcacaatcacttccatatttcctgcagcatcatgtcaaggaaaaagcactagttttacagaaagatgaaacagggtctgagccttactctcctgcttactgtgtgatcatgagcatggatattttcaattttcaaactcaattttctgtaaaatggaaatcatgattccaaccttttttaaagtttatttttataattttaatttttatgggtacctagtagggattccaacctttttgagctgtcaggaggattaggtgatagaacacaaacttcctattctgataggtgacaggtactcaatacatggggatttcttacctttcttccatcctgtattcacttctttagtgaatattcattgaatatctactgtgttctagcagcctggtattctcaaatgaggaaaatatacaaaagttactgtattttggcttatatcctagctgaaggatcaacagtatatgatcagtgaaaatacattaacacataaacaatataaaatagtatgaggtgatataagaggtagagaaaagaagaggtagaactggatatgaggggggttagtttgtagtattaaacgggttgctcagggtagacatttgagcaaggacttgaggaaggaaagaatagtggtcatgtggttatctgcagtaaagccttccaggcagataactgctagggaaattaccctgggataagagcctttctgaccttttaatggaagaacaaaaagaccaatgtattgggaggaagaaccagatgaagtgaagggaaaagtaggtcagacacatgacagaagaccaggtcatacaaaacaggaatttgtaagtactttggcttttactttgaatgaaatgggaaatcattgtagatccttatacaatggagtaacatgacctggcttattttgtaaaaagatatctctgcctggaatgttgaggagagactgtaagtaggggcaagggtagaatcaaggagaaaagttaggaggttattttcagaagaaagatgattaatgatgattgttagacacttttactggaggtagtgagaagtggtggaatttgggatatgaaggattagccaatgggatttctttactgactaaaggatgtgcaagacgtcagtagattgactccaaagttattggtcttacctaatgaaagaacgggtttattatcagatgaaatgtaatagtaaggataaagcagcctgggagattaagaaggtaaagacctggatttcagtgatggaagtgtagaatttaagatatctattagatattcaaataaatatgtcaagtaggcaatggaatatttaagtctggagattaggtgagagatctggacaagatactttacatcaaaatgtttattgtgtagatgatatttaatgacatgaatgaaactgggtatgatcaccagtgaagcaagtgtagacagaaaagaggatcaacactgagctctggagcacttcagcacaatagccttcattttatttgaaattcataaatgtaaaaatatcagtggcaatagatgctagatcctttttgggaaggttatttttttatttttattttgccagtgaggaaaatatcaaaagtgtataatgaagtgatcagtgaaactagaaaccttttttatcagggacaatgataagatagaaaaacaaatggcaggtgctgtgtagtattgtcacggcttacggctttctgggatttccaagtcaccattaaacttctgcaatttattcatttagaatcagaagggctatgaagctaatctaaacgaagttaaaagagatgtttataacagtaagcttagttcaacaaataaaaattgtctactctctgccattgattgtgctagacagtcattgacttaaagggatcttactttcaaatgtagaagacatttaataaacacctgttaggccaggcacagtggctcacgcctgtaatcccagcactttgggaggctgaggcggcctgactaacaaggtgaaaccctgtttctactaaaaatacaaaaaattagctggcatggtggcatgcgcctgtagtcacagctactcaggaggctgaggcaggagaattgcttgaacccgggaggcggaggttgcagtgagctgagacagtgatgtgccactgcactccaacctgggcgacagagcaagattccatctcaataaataaataaatttaaataaataaataaataaacacaggttaaaactttccccaaattttcttcttcattcattcttaaatcaatccatctatctctctattcatttttcatcactatattttaaaaactttattaacagtagagtgataatagtattcttgaacagttaatgcatacgaaactttttgtatgctataaaatagctctaataatcttatgaactagttactactgttatctcaattttatggaagagaaagctgacactcacagataaaaatttccgtgctttaagtcgcacaatgagtcactggtggagtgtgaatttgaacatgggcatgtttgactccaaaaccttttgatttaaaccactacactcttagaagaaaataaagatgaattgttgcagattggtattttatgcagcacaaattctcagctgtactttgttacactacatttgccataaattcaacttccttagattgtactggtgagtgtgtaatgtagtgaacttatctagagaaacctaaaaagtgcttagagacctgggaattctattgttaaacaaaagtcactttcttttacagctgatcaccattatgatgtttggtatttaggaaaggatagttcccataatagaggctttgatgaaaaagcgaccgtgaaatggtggtgtacttgctctgaatgttatattggaaaaaatattttgagacacacatacattccttagatatgacatgtatcattccttatggtctttttttctgcctgaaaattcatttctgctttacctggttagcatcttattttcacatacatgaattccctttccacccagaagctacctctgaacttccaagacctggttaatttcctctcatcaacgtttactcccatcctagcactttctttccttccttcattcatttcttcatttcctctcctctcttttattccttcattatacaaacattaaattggttcctacactatggcagggatacttaatgtattgaaattgcctctttatttgcatatgtctctgcctaggctctgcgatacttgggagtaggaagtggggctcgatcaccattgtgtgcccaatactggatctagtgctatgtttggcactagttggaactcaaatatgtgctaatgaataatttcatcctttgtgccaccactgcatttggtgtgtggtttaactattgtatgcattatatgtataatttaatgcaattatttaagtaaggttaggtaccttccatttatatttgtatcatcagaacttagcacagtgttaaaaaaagagtaggaatgtgataaaatcttttgctgaatgaattaatgaatgatagatagccagctgtatagcatatgctcctgttcagattactatctaacctagaaaccaagaagctagatagcagaattctgaaagctattccagtttcaatattaacaagaaatatttattaaaattgtaataataaactaaacttatttctcatcaaaactcatcagaaatttcctctaaagaatcataaacaaataatatttaatagatgccaagaattttccctcctttcctcatctaagtttaattataatagtcaaataacacattttaagcacatttggaataaaaaatatcagagcagcctggagataattaacatgtgaccagcttgaagccgattttttttccttctataatttcctgaaaatatggggctctaaaatgtgattgtggagagagacaggtagtatagcataaaaaccccagaatcatagcacctgggatttcttttccaccagttttgtggtcttgtccatgtatagaatgttcctgagttttgtttcattcaactgtagaataataatctcaaccttaaaggattaaaaaaggtaatgcttaagatagttataataattggaaatgaaaagaaatcttccccatgtttttatttaatgtgcttatttattaaaaggcaaaaaaaaaaaaagtcccaagaaaagtaggacaagctgaggaacacaaattaaatgcacatttgtaaaaagagagcaattccaatgcgggagttataaaacctgccagtggttacacctcttggagctcatcctctgctccctccttgattcttaccaacatctctttgtttaactctgcggcttttttcctcttaagtgaagagacaaatgttccaacctccaaagcaattaggtaactcagggaaccaaaggaacttcctagagaacgtccctattgacattaagctgttgatacatattgccttggatggaataaaatggaagcgttttacagctttggacttacgtaagatacatttcttttatgattgaaaagcaggagataatgctaacttcctgtcataggacttcccacctggttacttcttgaaagacaggctatttttgctctttccttttacttagtttattggaaggttggcagcatctggtaagccccacctgtaagtgtttctgtggctttggactggggacctaaagatctttagagctcttactacttatatctcctcctaaattctttgatacaaaacaaataaaaaattctttctaggacagtttttgcagatatgtggcagggaatggtgtcccagaaaaagtgtcttggcaaatgcttttcagataattctctgaacgtctagctcaaattgttgccttttattactttttctcctttctctctcaaaccagactacatttttctgagaactaattaccttgttctattgattttaattcctaatcaaatctttgttgcttttgattcacattacattatccttacccaaaccactggtagattcacatggatttttgcaaaattttcttacccttatcctctctttataattcccaacttagtcttatattttaaaatcttatcttttagtgttaaatatttaaatagcgcaaatagtatggaatcatttaaattataaaatttttaaatatgcagagaaaagtatatggtatggaacaaataaaatctatattaaaaaatgttaatattttgtcatatgtttcaaattacacacacacacacacacacacacacacacacatgctaaagctataactaaaacctattttgtaactcccatctaactccctttcttctcttactagatgatactgctattctgaaatctgtatccttccttttcatgtttttatacaatatctactcttcacattgtgactatgtaaataatatttataaagcagcccatcatgattgcattttctttcttttcttttcttttctttttgtttttgagatggagtcttgctctgtcacccgagctggagtgcagtggcatgatctccactcactgcaacctctgcctcctaagtttcccaggttcaagcgattctcctgcctcagactcctgagtagctgggattacaggcatgcaccaccgtggctggctaattttttgtatgtttagtagagacaaggttttgccatgttggccaagctggtctcaaactcctgacctcaggtaatccacccaatgtagcctcccaaagtgttgagattacaggcatgagccactgcacctggcacattttctttcatattcaatttttgaatattcctggagataatcaccttgcttaaaactattctctccactagaatgtaaacattataagaacagataattttactggttttgttcatagaaatattttcagcatttagaacattgcctgagatggggttcacaacactctactccaaaatatggcactttggcatattgaattttttaagctgaaggaatttgagaaacagcaagtgcagaaagactttatgtccttctcccacccttcacccctgaagcaggtcataagaccctcatgtgagaggtgcccttcttagacctggagggaaggagcatccctatctcagaggagtctgaaggaacaggccttgctaagtttacctgagtttacttatgccctttgtcctatcttctttctctacaactcttcattttacatcaaacctagcatacgaacagccaggtttaactgcttcttcaggtccttaggaaggttccagtgttacataaaacttatattaaataaatgtgtatgcttttcttttgttaatctatttttagttacaggggccccagccaatgaacctaagatggatagagggaaaatatatatttcctcccctgcaattggaacagtgaaagtgctagatacacatttattgaatgaatgactagatgactgaatgaataaatctttttaaatttcccttaagataaactttaaaatatttaccatagtttaccaggctccccaaaaggtggcctttgctttcttgtctcatttctcccttatactctcagttccatttcagttcctgtgttctgtgtccacaacactcttctctttcattttagtttggccagctcccatcattactccaatttttgcatgcccacaattcattgaagaggcaattttaaatatcacctaagttagcttttactgttatgggctctcacaccattctggccttctctgttgtcaatattcagtatcttattattactttcaatatttggaaaaattatctccatgagggcagggatcctctttatcctatttactgctagcataggtacctgttaattataagacaaaggaataactgcttgctgtcctcaatgaaaataagttgaattgaggacatgggctatgttctgacctcatcctccatttatttctcatttctttcatgtcttcttggttttcataccagattctttatttgtctacctaattctggtgttcctaagaatttatgactgctattgagaatatggctggcttaaacatcattttaatgatttttattgatgaagatacattctcataatatcattcaatcctctgcatacatgtttacacacacacacacacacacatattcacatgtatttatgtgtaaaaaaaggaacctgtaatcctaccacctgtaaacaccttaacgttaggtagccttcatttaggatatttctatgaaaaaaatatatacacatacaaaaagtatatggctaaatatataggtagacattaatgtcagttgattgctactttaagttgttttctgaacaattgtttaattccaggtgggctgagatctcttagccatgctgataatcttataggattgtgttgacataaaatgaaataacatttccaagatgctgcaaacagttcctgtcacatagaaagcattatatatgtactggttgttattatcacaatgaaggcactgacccaaaggtaacttgagctgtcacattataggctgaagtaaggtaactataagccaagtgcatataagaaaggcttgcaatatttcctaaaactggccccaagcctttctgtggcaggctttggaatagctgaagccatcaggatgttcttctagctagcaattccgagtgatgtgttactttgaatcagagtcactgaggtgggcttgcacacagctataggctctttggaaaagtgctgtagattccagttaaaggttaaacttcacataatatcaatgcaaaggcatttctaggtttggcatttttcccctacccagaccacccacacacatacacacactcacatgtatgcacctagccagagacaaatcattttattcttctgtctgaaaacctccactggccccacactgtctatataggataaattccaaactcgttaaaggctttactcacaggctggccttaatacctactttaatcttcatttgtaacactctccatcattttactggaggttgacacgtatttaccgaaagcttactctatgtcaggcattgtattaggtgctgagattacaaatatgtttaagggacagctatgtccatgagagactaacatttcagtaggagtggcagatatgtatacagatcattaaaatttagtttgcaaagtgatttaaaggggaaagcagaatttgttttagaaatacagaaggggaaacttagcagtctaagtatatcaaagaaagcttcatagagaaagtaacacctgaacagagtaagggagggtaagtgggagttactcaagtaaagaaagaggggtaagcacattccaggtggagaagacaatatgtacacagacagggaggaataaaatagcattctgtgtggatgagaattatcagcagtctttgacaacagaatgtaaaatgaaagatggaaagcagtggtgattgaaactagaaagatcataggagggtgggaaagaggacattttgtatgtcatattgaaagcttggaatatatcatacagagttataaaaccagtggtaagttttgagtgatgggattcaggacacactaccctgaagtgtggcaccttggcatttgagaaaacagcagaagcaggaaggtaactctcaccttccccccagcattctcccctgaagcaggtcataaaactctcatttgacaggttctctctctgtacccagaggaagtgaacatctgtatatctctaaaaatgcaaggtcactgacagcaatctgaacaaacacgaatagctgagttctccccagctaactatcattagatcatgcttttttaatccaatcatactcctcaatgacttaccacttctctatcaaacctagcataaaaatacacaagttttcctgtttctttgtgttttcctttccctatgtaaaacttatctttaataaatgtacatgcttttctcttgttagtttgtgttttgttccaaggatttaatccacaaacctaggctgggaagaaacgataattactttctcctacatgagcaaggaaataaaaaagacagatctgtattttggatacattattcagtagcaagatcatcttctcccatcagcaccttcttcaagtaatgtgatgacaccatttcttgtgtgcttggaaaaagtttcagcttgctgtctcctttgttgttttaaagaagtgttagacaaagcattgtttgcaaaatctagggagataatggagtacactttgatttgttattctgtgtgagctatgatctaagttattggctctttccaactttaaaaatttttgttgttaaaagcaccttgcttaggaaattttaaatatttatgtctgcaacaattgtctcaaaataataaactgtgccattcctgtcattaaaaaaagacctgaattcttcctgaaaaaatagcaagatcaaaagtggattaagaggcatgtggcataaatctaggggcaagggaataaattggaaagttactgcaatatttaaatatgagatgatgagaacacctcttctgacactgttctcctacctgcttacccatatacagacattcacatgtgctgttaccccagactgaaatttcttcttagttattatttgctaaatatttatatttataatttaggtcgcagttaatttttacttcttcagagagaaattatatgaccacaaatttaaattacgacctctcggatatttccatgtttttattcctgttctttgacttcatatataatttgtcagtgaggcacacaaatagcccattagcaaacaaagagctgactagccatgtgcatgtgttgttttatgtctctttccccacaagatggtaagatgtatgaggaccaggatataggcaacaagtgacacaggaagcattgctgtttttccacctcaatttctcaagtacctaatattataatggaaatagtaataataaaatatttatctgttgaaataatgaaagtgtgtgttcattctcaatatcatagtcttacagaacatgagacaaaaagttacatctgtatattcattcacaaggtgcttagccatgcaagttagttgacgatgcaagacagttttttattttcacaataatccagtttaaaattagaaaaacatgtaaataaatagtataaagaaaagataggaatactgctcctcacccttcttcaagaaaaccaatcatagtatttttttctttttggcatttttactgtgtgtgtgcacacaggtacactatagatcatctattcaacaaaatttatttaaggctttgtgtttagaactggggaaaacaggatgaataagagcatcagaaagctcacagtctaatggcaaaaataagattcaaatgcgatcaaaaggcacttggatgttttattaaatcagattttttttttaagaaaaggaaaagtctcctgtatacataccaatcaccaaagaaaggtgagctgtcttgaaagacccaggatcatggaatttttaataaccagactttttaaataagtgaatacaactactatgagtaaaatcattcatcctgggagggatggagtctaatactgatgactttatgatcttctagcctctagaagttttgtgctaaatccatctgaattctaaaaccactagacaacctgacataccacatggagggctctctgcctgcaaggcttttttcctctttttcttgcatactcagttcatgggtgccctcctcatgctcctatgtctataaatctatgtcctcttattatattgtaatcatatttttacttttttgcctcctttattaatctgtgaacttcattaagatagaggtagtacttttatttctatatttttattttagtggtaggaaaataagcacatgagtgcatttaataaatgtttattgaagaaaaattggaagacagtatgaaaggaatcatattctgtttatatattgtaaaaattagaaaagactatgaaatatagactggagaacatgatgacatattctttaacatctgttggcacaaagaagcaaaagctaaaacaaaacaaaaaagaaaaaaaataaacaagtaaaatcaagtctttccctgtgccaacaatacttaaaagcatattagttggagactcctgatttcaattaataaaaacaattaacagaagaaaagaactttagatgacattctgcccaattcggtgatatctttttgttcttggatatgtcatgacatatttttctcactggctaaaacttctttctcttcacctaaaatgacacacataactgggaccctatttaggaacttctgggaatgtcctgggcatgagggaagaatgcccagtagacaagctaggaatactgatctaattttggagtgaagacagacatataggcagatctctcccagaggtctgaagatttgaataagtagctcagactttgggaagcttgtgttcccaaggaaattatttgttccataaataagactacccaagatgagtaacgcttggggatgtgacccccctctcccacgtctgcaccatttttcagttaatttatatgtggtgagattgtgatagattacctgtgagatcatcagtgggccaagaccccagttggcatgccttgcatgtgtactcatcaaagacatactcattctccttacaaggtgtacaggtccaacaacagctgacttctccctttcggatcacctaaggcaaatatttgaaatttagatttttttttgcatagataaaaatccaacaattctatattccaatgtgctgttttgcaaagcagaaaggcctttcacatacattattttaaatgttttcagataagcagtacaatttttaatattaatttataattaaagaaaataaggctgagtttaaacaagtccagcgtcataaagttagcttgtggcaggataaagaattaaattaaatgaaagtctttggataattagccttggaaacctgtatttaattaagtacctgtgcttgtgctcatatgtagatacacataactgaattcaccccaggatctgctctgcttctcctttccttaagttaagaacttctgctccctggatttaccttagcttccttccctccattagttgaataattgtgagcaaaaaacattgtatatttcctaatcttctaaaatctgtccatattgataaaaataattaggaatttgtattgggtagaacatagcaaaagattaagattttcctggagatgatctcttgatctctttctacgaaaaatctgattcaacaattcaacccattctttcctattttggtagccttgttttgtttgaaggtagatgaggtcactgagactattatatacctcttaatctatctgacttttttaaggtaatggaaaataattgaaataatttaacagttgaaagagtcacagatgttattctttcgaaatagatgtaccttttcttccccaccattggtgcatgaaaagcctctccggaatagacagcattcattaaatgttcttttaaataattaaaactgtgattaatattcagcaatgaccagagacagtaatgattacactttatatttctagtcttagatgctaactctagtaatgacctttgataataacatcagctagatacctatagccaaatataattgtaagctgacaactgtttgttacatttttgtagtatttcttgtgttgactcttaaaactacaaaaatacaagcagggaataatggcaaaagggcctgaaatagcttttccctaaagtaactaaataagtgaggcaaaattgctccttagacctgattaaagtattcttcataataatatcgactatttccaggctctttagtacttgtcacatactgttatcccattaaaacattagaacagctctgtatgaagtagctggtttatttttttcattttcttaggggagaaaactaaggtaaagttagctcacatagcatgttagggtaaataagggatcaaacaatgtatgttggacttcaaatgctcatgcttataaacattgagtcttactggaagatagactgcgtgatattttgaaagacgcaggggaaagagcactggcttgggaatcaagtagcaccagggttctagtcttatttatagccactaagtagttgtgcagccttgagtagtcctccagctaatgctcagtttcttttaactggacctgttgcttttaagataataatatctaccttataggatttccttaggattaaataaaacaacacagtgatttgtaaagtgtagaacactctaataatgttacctatttcattaataatatgcacataaatgtccatatacagaaatgaagaatttcattttcaaggtataccacacttggcaaaactatccttgaacaattattagattttgtaatgcaaacaggcatattgcaaagctgaaggagtgtctttcagaacttagcagggattagcaaataaaagcagttgcatttccccccactagaaataccttgatttcttatggttcagttttcattggtttgtgaatttcaggtgtttattaaaataaattcatgcccttttccaagaagaattccaacattacaatctctttttgaatcaatagtgataacttaatatgttttcctctgataatttagaaattgttttatgttttcatattttatgttctgtttcacatctattttgaacacgaggtagtgacaattctctttcatggcaatttaacattctggaagtagtggtgctttcttttttatttattttattttttgagacagagtcttgcattgttgcttaggctgggagtgcagtggcgccatcttggctcacggcagccttgacctccccagcccaagagagcctcccacctcagcttcctgaataactgggactacagatgtgtgccaccatgcccaattatttttgttccttattttttttgaagagatggggtctcactaaattgcctaggctgatcttgaactcctgagctcaagggattctcccacctcggcctcccaaaatgttgaaattatactcatgagccactgcacccacccagcggtgctttctttatgaataacaatatataacatatctgaaactttactagactaaatcctttcatggaaactaagtttacaaactctggaaaatgccatgagatgttgatatcatgaatgaaatcgctgttaaaccatattaagaaaatcttctaaattgtacatttaatagagtaaaaatgacatctggttaggaaaatggagtttgggatttttaaaaaaggactaagcaaatattattacaaaatgaccagtattaaaaatatgataataggctgggtgcagtggctcatgcctgtaatcccagcactttggaaggctgaggtgggcggatcacgaggtcagcagatcgagaccatcctggccaacatggtgaaaccccgcctctactaaaaatacaaaaacattagccaggtgtggtggcaggtgcctgtaatcccagctactctggaggccgagacaggagaatcacctgaacccgggaggcggaggttgcagtgagccgagatcgcgccactgcactccagcctggagacagagcaagactccgtctcaaaaaaaaaaacaaaaaattctgcatgtggaagttacattttccctttcttccttccctccctccctccttcgctccctccctccttctctctctctctctctctctctttctctctttttctctttctttctttttgacgtagtctcactctgtcgcccaggctggagtgcagtggcgccatctcggctcactgcaagctcctcctcccgggttcacgccattctccagcctcagcctcccaagtagctgggactacaggcgcctgccaacttgcctggctaatttttttgtatttttagtagagacggggttttaccatgttagccagatggtctcgatctcctgaccttgtgatccgcccgcctaggcctctcaaagtgctgggattacaggcgtgagccaccccgcccggccctagaagttacgttttcaaaatgtattgctgtgaagggtcaaaaataaacaaaaattatgtggtaatttacactgtgtaatctttctacaggaagcactggaaattatgaatatggatattcttggtgtaataattcatgtaaataattgtacatgaatttaaacccctcacaatgaagagtttaactgcaagataattggccaagatgaaaacctcttttgtcttgatataacaagtgttagcaaacttttttttgtacaaaggaccaaattgtaaatatttaggctttgggccatacagtctctattgcaactcagcaactcagctatccaactctgccactgtagcaggaaagtagccatggagactatataaacaaatgagcgtggctgtattttaataaaactttatttacaaagacaggtagtaggtcagatttagtctgtgggccatagtttaccagctgttgctgtataccataataagacatacagaaaatttcagatatctaatattttgagccatttagcagacattaattaatttatttttatcttcatttaccttatctttcttctttctggtcttatgctttccaaatcttcagacctaccctttgagggccttactatcagtattaaaatatttcagtttcagtcttaatcacagatgaaaaaacacatgaaatgccttctaaacagagtgaaggtaaggttgattgaaaacaccaagtccaatggctctaggaatacactgcctgaaatgtggtgtggtagtgcttcaagaactgtttgattagcaaataaattattttgatatcatttttccttacggcattgcataccaatagctgccctaactccctttttattatatctttgtcttctcttccttcattgaattttcatttcctgtaagtgtggccacatcttctttagcctaagagtaattttttaatgtcctcaaattaccaaattatccattacatgcttttttatcacatacttctttttcttatactctttatttttttcaattgacacataataattgtacatatttatgggttacatagtgatgttttgatacacatataacgatcagatcagggtaattagcatagccatcatctcaaatatttattatttcttcatgttaggaatgttcagtatcctccttctagctatttgaaactatagattacttttaactgtattcatcctacagtgctaaagaacactagaatttattcctcctatctagctgtgattttgcttcctttaacaaagctcttcctatccctctcttcctccttcccttcctaccctctagtatgctctgttctaatttttacttctgtgagatcaacattttttatcttgcacatataagtgagaacacgtgatgtttaattttctgtccttggcttatttcacttcacattctgttctccagttctgtctacgttgctgtgaatgacaggatttcattctttgttatggtttaatagtattctattatgtagataaactacattttccttatccattcatcttgatactcaattgccattacattctattcaatctggcaggcccagatgaagggtgaaccctcaattttcatgcctttccctcattgttcctcttctttgacctttctcttccactgactaccatcttatgtgacagtgtgctctctagttgtctatctctctgtacctgttgctgctcagcctctaccttttcttccttttttgtactttgaaagcagaaattctccaaggtatattcttggtccgtatttattttttatttacacttttaggttctgcaattttatttattttaatagcttcaactttaactctattcaatcaattcctaaatctgtattcttagctttatttttcattgctctagactaagctttaatcactggatggctattttaaaaccaacatgcccacaaactaaccaatcgctttttctctaaagccatccccatttttctattcctggaaatgcaaccttttagttactaacacttagaatttcagttgattgtgttgacttctttatcttccacaactcggcatcaaattggttgtcagcctgattgaatctacaaacgttttctccaaatgtgtcttctggccccttttcattctgtttcttccctaattcaaggccttgttaccactatcacagcatccttctaacttgtctcttctttcttgtttcataaatttgtttattcatcttccttaccacagctcaacttatgccagcatcttggtcaaaattattctctgactccagtttaataaaaattaagttcaatgtatttagtatgatgttcaaaactctccacaaatctgggttcaacttatttcaactttctcttttataataaccatttagagcattgcactctagattattcacttgtttctggacagtcttcaattgaccacttttgtcccttttcttttactgttctttctatatgaatgttctctccctgaaatcatattcattttctatggtccattgtttgacattttattcagtagaaatatctctatcccttttgtacaaacttatatagtcctcttcttttctttcttaacaaaatcatcacattttacatgatattgcttatctgtgtccatgatattttctcacatagactgtaagtcttctgacaataaagcgtgtctcatttatttttgcctaatcaatattaactattatattaataaacatttgatgaatatttattaaataaattagaattagtgtcttttctaactgtaaactttattcccaggaagtcatgtctttaaaggcttgtatgagcagaaacggtgtgggcaaacatgactcatcaactggttcaatcaaaccaactaataagactattgtgagttgcacatgggatttcacaaggaatgagtgagaatttctgacattagaagcttacaatataaaaagtaaaataagtgtctaaaatttttaaaaatagccaatgatagttaacactgttgaatttacaacaaaaatgaaagaaacatagattccattttaccttgatctggcctttctcacatggttcactgcacacagatctgatgatgttgcttttcttggaccatacttcatcatcatccatttttaattctccattgtcccaacttccaacgttgatataatcaaagtaatcttttcccatttccttgaaattcattatttcataccttaggaataagaatatgataattatgcagcttaagatgtaaatactcagctttgaaaaggcaatatattttattcccaaaaatgtgtctattgtcatataagtagcactggaattttccatgacagtacacttagaataacaaaaaaaatctgtctattttactttctctgcagagaccatttttgtactttcaagcttacacctgaaatagaaagtaatcccatgtgagaaggtgacttgaccccagcaggatgaaagacagtttcgaaataacttcaagaagtttaaacgagtactgttaggcttctacaaaagatagaaaggtttttgtctgtattcaagtaaaatgataaaacttacatttactaaccaagtgagaaatttggtaaatctttcatcttattttcagctttaggggatatagggataatttacagagggcctcattttacctttcttactttgcccattatcaatggctaaattcattgtacaaagatagttttgagagtgatgtttaaaaaagtttgaaaatagcttctaaagcacctcatgcaatgtaaacatcctggaagagagtagttccttgtgagttctcagcctttgctagctattgttttttgagtatgtggatagaaatgtaaaaagagaaaatcaatgtgctaacttacaagccttttcttataagtaagctcatttctagagaagaatctctgaaataattttccaatttgaggatattggataagcaatatcaccattatctcagtttctacaggtatgtctcaggtacacactgtgttcacataatattttatactgtttaccccctcaggacttatagtactgacagatagacatataaatgcctcctccaacttccaatgctcagcatgtgtagctatctggaaactgatatgaatggaaaatgttctcgcttttggattcaagtgatgagattactatacacaaaccaatgttctgtacagaaatactgagaacaaaactggcatcaatctattgaaacttatgttataaaatgatgccattctgttttcactcccagtcacattttttactgtagtttttttttttcttcagaatattacctcattcttgttttgttggttgttcagtaacttgataattttcctgcagtcagtaacaatttggtgtaactgtctaaattctacttctaaatcaaaaataccaatttataggatactttccttccctctcggtcacaattatcctttggcctctgtgcatgcaatgagttgagatattagagcacagagcactgaggtaaaaagaactcacgtattatgtcattggctacttcaaatatatgagctttaagtattcaaagggtgactttctatgagcaaataacctttgaagattctaggatgggagaaagagaaatgtcagtgtcagacttgtttctttgctgctgataatttgaagaaatatgtgggtgtcattccttactcaaaaatgagctgtcaactctgtttctagcaattcttaagtctgaaaagtttagttcacactgttaattttacagataatggactgaagctcagtgaggttaattagtacagattacagagtatgtaagcatcagagctaggacctaaaccaagcctttagatttcaagtctgcagttccttcttccttattagactgctccaaatcctgggtactgctccaaatcctgggtagagctaagagatcatattttccttgcttaaatattgtaaaaatttgaaccaatttatattgtaaggcttttatctctatatccatgcctctttgttttatgtatgacaaatagtaaaaagtaaagagatccagtttttgaaaaataaacatgaaaactctatagattggaaaatcacatttgacagggaacttgttttaaggaaagttaaaccttaatttcagttgaactcaataaacttgttataattacattagagacaatgaatcctctctttggaattaggctttagatttctagtcattgtttcttaatacaaggcaaacacaaagatattatcactcacagcttaagctgtgaaaatagaacattgctttaaaaatcttgttttagtacactaaaaaagagaaatagataatatgtctccacaaaagaatattctcccgttgacttgtgaattggtatgagcccttttaattttcagagatagaatatagcttttattctccaacaaaaggaaaataaagtgagtgtttaaaacatactcttacgtaacttttagttaagaatcaaaagacataatggcttcttgcaatctttagccatgattcaatctagaagactgtattttgttttccaataaaataacagaaggtcaggcacggtggctcacacctgtaatcccagcactttgggaggctgaggcgggcagatcatgaggtcaggagatcgagaccatcctggctaacatggtgaaaccccgtctctactaaaaataaaaaaaattagccgggcgtggtggcaggcgcctgtagtcccagctacttgggaggctgaggcaggagaatggcgtgaacccgggagacggagcttgcagtgagcctagatcgcgccactgcactccagcctgggtgacagagtgagactgtctcaaaacaaaacaaaacaagaaaacagtaattcagtgtgctctttgtttttgatggctttagtaaagatccaacttgcacatattcagtgtcagaagcaaagattagtgtgtcattccaatcacaagacactttaatataaatctccagcccagtttcttttttctccttcccatctccttcctcccatttatctcctcctccttctcttcttcctcaatcctcctcctccttcctcctcctcctcttcctccttcttcctcctgctccttctccctctcccccaccccttccccctctccctccccttccctcaccctcccctggcctttctttttcattgcacctcttggtttctatatttctctgcttctgaaatgtttttctcagcacagtgtgtttgtatatgtaatttatcttctttaatacctgtcccttccttccccttactctctaactcctcatgtctgctcttccttaaccagccaaaatttaaacctagaatattctaaataattttaaaaataaattttatatattgctcaaaatcaaaataaacaaaatatgttacaataacaacaacaaaaagttctattaaagcatttaaggtaaactagagaaagtcaggtttcaattgtacagaaataaggaactttctaaatggctagaactctgaaaattagagaagattgtcttcagatgataatgagggatttattcaaggggctgaaacagggttgttgttagagaaagtgaaaaatcatttggagaagactgaagagtattacttttatgtgggtcctaaggctctttcaatctataattccgatgctaaggtgcttttgttaaaaattcttaaatgtgtgctaaattatctgtgggttggcataataagccctggtccatacaacaaagcaattacaatgatctgtgcctttggggttggacaatcacagagtaatgagagatcacagagttagttagaccaaaaatgtgaatggcacctaataatgcaacacttttatactatatgttaatacattgaaccatttcaaatgtaatataagaaaaaaaaagaaggtaaatttttacttgatgattgtgcctgagatttgcgtatgtccttgccctgttatttaattgactatgcaaccttggacatgtctctttctttctatgacacagattttttaccaggacaatctggacattgaagcagaacatctgtttctatgagcagagacatatatcaagaatccgcatgcacacaaagtcgttatctgccatttctactattctagcctcgtattttctatttaccgcatctgtttgtgctcctctgttctttctttcctgccctattttgggccttttcttttctttctttctctctttctctcattctctttctctctcttttgttctttcttatctctctattggcttttaaatgctcctctttgtattaaaatttttgtggttgctcaagagattacaatatgcatttttattctacttaatattgagtcacttaatgtaaaatataagaaatttggctttgtgcaatttcaaattctttttcatttttgccgttgttttcaaatacttcgcacccatgtacttacaaaccccacaatataatgttttagttttttgctttaattagttagttgtactcagtctaacattgggtgtccacgtttcctctgcctattatggtcaattccgggtggcagccacgcatcttaaactttaattctcaatggagtccctaaacccgagattagcaaacttttgctgtgaggggatgtatggtaaatattttaggctttgagatggtttctattcacctctgccattgtggtgtacaagcagctatagcacctaaataaatcaatgtgactgggttccaaaaaacctttcttataaaaacaagcagcagactccatgtggtctgcagatcatagtttgatgactgatgactggtgatctagtctgttaatggtaaaatagtaaaggtccatatttcttatcggtaattgtgaaatctttagagctctgaaatttttttttcttttttttgtaactcacttggcagcaaaacatgacattacctgaactttatctagggatgaaatgtgactggaactaaatgaggctatttatagtcttgtttatcacaatgtgaatattcgtatgttttgctgcagaaatattaatgtgtttattagggagtgctattacatattatgttaggggcattatatgattgtttaggcttttgtaaattcaaaaattctgggttctgtaacacctggcaccatggttttcattagagcattgggtactgatagtagactaatcagatgagagatttaaaaacaatgattaaaacgtgctaacagtctgcaagtgtgtgccagagtgagttgccatctctctcagcttcctctgtttaggatcctccacttttaactctggaattgtagaggattccttaatcaccccaggatcctttgctttctcactcagctgggaatgcctttgatctggcagaatgcttttgctccacaaaaataacaacctaatgtctacaaataagttttctcagaatatagtgtctttaaaattttgatcctggttgattaattgtcaggctgttgtataatgttagaagttgaagcccaggagacagagttaaaattttgactctatcatttactagactgtgtttttgggcaagtcattgaacttttgtaagctttggttttctttagctggaaaaaagaatggtaacattacttacctcataggattaaaaagtagaacacttggcttagtctttggctcagaacacacactcaatatatgctagttataattttttttgtaaaagtaactggattatttggagaaacaaaaggtggtaaatcaccttttcctgagtctgcttcatgcccttagaggccaactctgataatttattcatgggttaatgttatactcaaacctagtagtgcaaggatagactcaaagcaatcctgaattcccagaagttgtttgcaagattttaagtatgttgttcttgaaagaatagctatacattttgtctgagtcttgaagggatgattgttccaaaaaaagattaagaaacccttacaacatatttggatgattatgaataaggtagcgatgttctgccagatccatcaaggtttcccattggaatagagctggaccttctgaggcatctcctccctccctggtttgcggaatggtttgggtacctgatataaaaactcttgaattggtggagctacagtcatcagattctatcagcaagtcctaagctgatgtcagaactctagagatgcacatgggaataataaattcctgtgcaggtatctgagcccaggccttgacctgagcctaaagactgagctcattggtcagcctgcccttaaaagatttacaactgtgaagttttgtttggccctgagaaaatgcttgtatttttttccttcatggatatacgtaagagccaaaaagtagaaaacaacatgtgaaaattcagcttattttggcaaacagcctagttatagcaatattcttcaagtctctggaatagaagaaaaaaaacctgggttttcacttggctgtatgacctgaaactagctatcacttataagtctggcatgtgaaatagtaacagctgcatttgggataagctccagctcatcttagaatgtagaagtgtgataaaccaaggttgctgacagaatgtgtgggcacatgtggtgtgaattgttggggattcatgaaaccttttggcagggtcaactacaaacagagtgtatagacagttttccaagcacagttgttaagtatgagctattgctagaagggcactgagagaccaaaggaccctattgttttgatacaaggctgagtgaagactcagccctgctacaactcaaaatatcatttcaatggcattattccttatagattaaaagtgtctataagtcttaaatgactatgtagagtcatttaagaatttggagtagaagacaaatgtgaattatggtaagttctgggtacttagtgatttctctggggactgacctatacttatgagtttatgttcctcaagttcctctacaaataataaaaggtaaaatttcagagaaaaaaaacaatttagtccttaacaaggaagaaagtgatccagctggagaataataaaataaaatgtgacttataattcacttgctgtacgtacagcaaacaacagaacagaacctcagccctatttctggattaccagaaatcaaattgttcctatttcagaatagttctattatgcaagaaaatatctgaatatggggaataacatgacaagcatgtacagagaaaccacagagatggtttttatttatctatgatcatgtgagtttcctgcctcttagtttaggtctctgaaatgtgatgattcgcaaagcacattttggacatcagcacaaatgcttttttcctggccacaggaaatggggcttcttctctctatctttgctcatttgggatgtcagggaaggggaaacattaccaggaaacctagattaaccacaaaggagagaaagagacatttcaggatcaagagttggctgttattcagtctctactctgcagaggagaattgtaacacaataccttcctggagagtctccattctcatcgaataggatcgtatctccagaaaccccagtaaaattggttttcatcagggactccaaaagtttccgtccatcaattggcttcatggcatcacagagtcctgcatagcctgggcagagggacatctgcatgttgtggagcccataggccatcgaatagatggcgttgatcacaaatcccattttggaatcctgaacatgatgtgttttcagagtcagagaacctgttgggaaacaaattaagcatagctttgaggtacaaatctactctcgcgacattcctgggtactgaataatgggttacctgtaattagagaatgcactggagcaattttatcagagttagaaccatgggtaacactgagaaacagtaccaacataatgggcctgatagttatcttctgtattcaggtttttcttccaaaactctgaaaaaagttctgaatcaccaacagtagcaagatccactttcttccaaaaccaaactctaagtatgaatgcaggatagaactgtatttctgtaccataaaatgtatcttaaggacagattcatttcattagtatgagctgtgataatatacctttttggttcagaaatcctcaacaaacctccagtttctaaactattatgttctcttacctggcgatactagatattccaccatctgatataaatttacctatttagatttatcacccagtacgtctaatctcaaagcatatgctctctataaactggcctatttgaaagttataaaatataacatttaaactcctttaattcattaattaattcagtaaacatttattagagtcagaatatacacaaagctgtgtaatttatcatctagagaaaaaaagatgatttgaacatggagcttgtacataagaaacttgtccaataacagagataaattatgtaaatacagtgaaaggtagaatataataaatctgtaaaacatgtggaggtaaaatctatagaggcccaaaggagtgagaaatatcccttccaatagaaggttcttgggaactaaggaactaaaggaactaaaatttgttattgatgattgatttgacaagtatggacttagtgcctgttatttctaactgctcagaacttgctccgagtgagggacatcatgctgaacaagaaagaagtgattcttgctctcatttacttagagtctaagggcagatgagcatctatctaagcaggcaattataatgtgttttgataagtactgagacaggactgaatagtgaatcagacctggaagctctctgaagctgagcattaagctaagtatcaatcagatgaagggagagaaagagtggtccaagcatttttgaagaataacagataagatagagcatgctatgtttgggagactttaaggaaatcaatgaccagcacagagagtaggaggtaggagaaaagagagagctgaaatggtagaggaaggcagagatgcttaagccatgttaagattgctgccttttggctaggagcggtggctcacgcctgtaatcccaacactttaggaggctgaggcgagtggatcacctgaggtcaagagtttaagaacagcctggccaacaaggtgaaaccctgtctctactaaaaacgcaaaattagctgggtgtggtggcaggtgcctctaatcccagctactcaggaggctgaggcaggagaatccctttaacctgggaggttgcagtgagccaagatggcgccattgcactccagcctgggcaacaagagggaaagtcagtcagcctcaaaacaaacaaaacaaacaaccaaaaaagattactgcattttatgataagagctttgggatccattgaagtgttgaggctagggagggacatgatcagatttctgttttagaaaagaccaatctggctacattgtggagaaaggtttaaagggctgtaggagtaggactgtcagggaaactcattaagagggaatgcagtgatcccaatgacagaagaaaatgttcctgcctgtggtagaggccatgattatggcaaaggtgtctaggaagtgaaatctatttccaggcctggtgattatagaatgaatagggttaagacatataggaagagtgtggttaaaaaaaaaataggtgaaagaaagagctgaggtaaagccagagcttatcattttggaagaaatgttttctttaagaaaggtgtttttttttttttttttcaacaacaacaaacaacaacaactctccaaaggtagtatgttgttttatggcttcccaaattgtagaggcttatcatctccatcttgattgctggcccaaatactgacacctttaatttccccagtagagagtctccctagagaaactggcgtagtgcattgtgacataatataagatgggaaatcctgcttccatctcaggactagacagtggtcccaggctacactctaggcaaatcttacaatttccttccccacacagactggattcatatttccacattttacctcacactgctggaaattccattattctagttgccaagtcaaacacttttgaatcacttttgactcctctttttccttcataccttcacaactcttatttgatttatcttcaaaatttatctggaattagactacttagcactaatctacttctaccagactcagtatatatcctctcctgtctagattacagcaatagtcttctaactggttgcctgctttctccttttgcccatcttccctgcactccagcctgtttttagcacaatagccttaactagaagtcagatcatgacaatcctctgatcaaacttcccagtgacttttttctcattactaaaagtaaaagccaaagtccttgcaatggccttcaaagacatacaggagcgtgcctcatggtatttcaccccttattcctttgactcaatctcttaatactcttctcgtaaattattccgccctagacacactgactttctcccacatcttcaaacatgctaggcatgcccctgcctctgagcccttgtaattgctgtgtcttctgcctagaatgttctgcccacaagatttgtgcaggacaattctccagatggccttggactgaccaggtttttctccctttcttgcttgtagttctcaacagtaactgtatgatggtctgataatgtaacttactgagatagagactggctagaagagcctaggctctgtttcagtctcaccagaacagcatgtccttcaatgatttagcacagtaagtcatgtgaccccaggatataacacccagggcaggctgctttccagggtcccttatctgctatgcaagtgggttacatgcaattgagactccatccaccctaggcagatttctgagccttgggggagcagctcacaatgagtcctaggcttctgatgttttttgctgcctatctgtaagtaataaacccatttcccataacttgcatatgagtatgttctgtcacacaagttggtaaccagtgcatggtgagcttgcttcacaagttgcagggcatgtttccttcccaatttatgactttactcaggcataatcctctctgtgagaccttctctggatatcctgtctaaattgcatctctacctccccccaccaacactccctatcttcttttgtgacattattttcactttaccaacacctaacatattttataaatttatcttattatcttgcttattggctgtctcaaacaccactcactaaaatataagctctatgaaaacagggattttttttttttttttttttttgagacagagtctcactctgtggtccaggctggagtgcagtggcgcgatattggctcactgcaagctccatctcctgggttcacactgttctcctgtctcagcctcccgagtagctgggactacaggaacctgccaccatgcccgggtacatttttttgtatttttagtagagacggggtttcaccatgttagccaggatggtctcgatctcctgacctcgtgattggcccccacttggcctcccaaagtgctgggattacaggcgtgagccaccgtgccgagcccggatattttcttttttgttttctactcagtgcctagaacaatttctggcacacagttggccaccaataaatatttggtgaatgaattaaattaacaaactgtcttctctagactacccttctattttactttttctccctaatcctacactaatactagtcctaaccattttcttcctcttacttttatttaggctcaggggtatatgtgcaggtttgttacatgggtaaattgtgttgctgaggattggtgtataaatgatcctgtcaccaagatagtgaccatagttcctgataggtagccttccaaaccatagctccctaccacccttcctcttcaagcaatctccagtgtctgttatttccatatttatgtccatgtgtattcaatgtttagcgcccacttataaatgagaacatgtagtttttggttttctattcctgcattagttcactcaggataatggttttgggcttgatctatgttgcagcaaaggacatgattttgtttggctgtttagtatttcatggtgtatatgtaccatggtgcatggtaccatgcatgcatatgtaccatgtctttaaccagtccaccactgatgggcatcttggttgattacatgtatttgctattgtgaacagcactgtgatgaacatataaagggatgtgtctttttcgtagaatgagtgcttttctcttgggtatacactcagtagtgggattcatgtctgttcatattatttgcccattttaaatggggttgttttttgcctgctgatttggttaagttctttacacattctggatattagacatttgttggatacatagtttagaaatattttccccaattctgtaggttgtctgtttactctgctgatagtttcccttgctgtgcagaagccctttgcttaattaggttctatgcgtcaatttttgtttttgttgcaattgctttggggaatttagtcataaattctttgctaaggctaatgttcagaatggtatttcttaggatttcttctagggtttttatagttttagctcttacatttaagtctttaatccattttgagttaatttttgcatatagtgaatggtaggagtccaatttcaatcttctgcatacagctagccagtgatcccagcaccatttattggataggaagtcctttccccactgtttgttattactgactttgttgaagatcagttgagtgtaaatgtgtggctttgtttctgggttctatattctgtttcactggcctatgtgtttgtttttctaccagtaccatgctgtttgggttgctgtagcctggtagtatagtttgaagttgggtagtgtgatgcctctggctttgttctttttgcttgatttgagatctttttgattctgtataaattttaggatgcacatttctaattctgtgaaaaatgaaattggtagtttggtagaaatagcaatgtatctgtaaattactttgagtgatatggccattttaacaatattgattcttcctgaccatgggcatagaatgttcttccaattgtttgtgtcatctctgatttctttcagcagtgttctgtaattcttacagagatttttcacttccttggtaaactgtattcctagttattccttattattatttttggctattgtaaatgagattgtgttcttgattttgctctgagcttggacattattggtttataaaaatgctactgatatttgtacattgattttgtatcctgaaactttaccgaagttgtttatcagttctagaagccttctggtgcaatctatggggttttcttggtatagattcatatcgtctgcaaaaagaagtagcttgacttcctctcttcctatttgggtgccctttatttctgtctcttgcctgattgctctggctaggacttccagcactacattgaatacaaatgaagatagtggatattcttgtcttgttccaattctcagaaggaatgcttccagcttttgcctgttcagtatgatgttggctgtggatttgtcatagatggctcttattattttgatgtatgttcctttgttgcctaacttgttcagagtttttaacatgaagggatattgaattttatggaaggctttttctgcatctattgagatgatcacttggtttttgttacttctgttgatgtggtaaatcacatttattgatttgcgtatgttaaaccaaccatgaatcccaggaataaggcctacttgatggtggttaattaacattttcatgtgcttctgaattctgtttgctagtattttttgaggatttttgcatctatgttcatcagggatatgagcctgttgttttcttttattgttgtgtctctgccaggctttgatatcaggatgatgctggctttgtagaatgagttagggaggagtaccttctccttgtatttttggaataattttaataggactgatactagctcttctttgaacatctggtagaatttggctttgattctattgggcccaggacattttttggctggtaggctttttatttctgattcaatttcacaatttgttatttatctgttcagaatttttatttcttcctggttcaattttgagaggctgggtgttttcagaaatttacctatttctcctaggttttcttgtttgtgtgcacagtgatgctgacaatagtctctgaggatattttgtatgtccgtggggtcagttgtaatgtccctttgtcatttctaattgtgtttatttggatcttctctttctttctttattaacctagctagcagcctatcaatattgtttaatctttcaaaaaaccaacttttgttttcattgatgttttgtatggattttcacatctcaatttcaatcatttcagttctgattttgattatttcttatcttctgctagctttgatgttgtttggcttttgtttttctagttcttcttcctttcctgggtgtgatgttaggttgttaatttgagatgattccaactttttgatgtaggcatttagtgctataaactttcctcctaatactgctttagctatgtcccacagattttggtatgttatgcctttgttttcattagtttcaaagaatttatttatttatttatttattatttttttttattatactttaagttttagggtacatgtgcacattgtgcaggttagttacatatgtatacatgtgccatgctggtgcactgcacccactaactcgtcatctagcattaggtatatctcccgatgctatccctcccccctccccccatcccaccacagtccccagagtgtgatattccccttcctgtgtccatgtgatctctttgttcaattcccacctatgagtgagaatatgtggtgtttggttttttgttcctgcgatagtttactgagaatgatgatttccaatttcatccatgtccctacaaaggacatgaacccatcattttttatggctgcatagtattccatggtgtatatgtgccacattttcttaatccagtctatcattgttggacatttgggttggttccaagtctttgctattgtgaataatgccgcaataaacatacatgtgcatgtgtctttatagcagcatgatttatagccctttgggtatatacccagtaatgggatggctgggtcaaatggtatttctagttctagatccctgaggagtagccacactgacttccacaatggttgaactagtttacactcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcatttcttcatgtgttttttggctgcataaatgtcttcttttgagaagtgtctgttcatgtccttcgcccacttttaaaaatatggaacgcttcacaaatttgcgtgtcatccttgcgcaggggccatgctaatcttctctgtatcgttccaattttagtatatgtgctgccaaagcaagcactcaaagaattttttgatttctgctttaatttcatttttttatcccaaagtcattcaggagcacattgtttaatttccatgtaactgtacggttttgatagattttcttagtaatgatttttaatttgtattgtgctgtggtctgagggtgtgttgggtatgatgtcaatttctttgaatttgcttggacttgctttattcctgagcacgtgctcatcttagaattatgtgccatgtgcagacgagaagaatgtatattctgttgtttttggatggattgttctgtagatgtgtaattagctccaattggtcaagtcttgagtttaagtccagaatatcttcattagttttatgccctgatgatacgtctgacattgtcagtcaggtgttgaagttccccaagattattgtgtagcttcctaaatctcttcatagatctctagaaacctgttttatgaatctgggtgctccaatgttggatacatatacatttaggatagttgagtcttcttgtttgtattgtaacttttaccattatacaatgctcttctttgtcttttaaaaaattatcgttggtttataagaaaagctacccctgcagttttttgttttccatttgcctgatagatctttctccatgtctttagttttagactgtgggtgctgttacttgtgagataggtctcctgaagttagcagacagttgggtcttgcttctttatccaacttgccattttatgccttttaagtggggacattagcccatttacactcaggatataaattgatatgtgagaatttgatcctgttattgtgctattagctgctaaccatttttaaaggatccaagaacacttccttcatgaagaccaccatgattgcagatattaaaattaagttgcactttgaactctggatcattttctctagacctctctctgacactctatataccttattatagaattgtgggaatacttcaggggagcagagtttgaaacatccatttcccaggtcagtcttataacctacctttccctatttaacatgctaagtaaagaagaggttactcacacgatccagaagattgggtattcagtgacaatctctgaggccacacttatgtgctttaccttgaccctaagccatgttctgcaactctgcctcccaaccactatcagagttcagcagtacatgtttttctggctgttataaaaggtgggtttgagtctcattcttttatttttctctcttttgaacagggtatggagatctatgtttgaatcctgttatgtgtcttcctggctctgtggcttggacaggttacttcaattacttaacattcagtttaatcatctgctaaatgatgacccttcttttacaaggataatatgagaattaaatgttatagaaaagtcataggtacatcacacagagcctggcacaagatgcttcctaagtagtaactgtgtcaaaatgtaaatcataataacctttagtcactatatatttctggtcaagactttagagtataaaagtaagtgaaaggtctcacctgatgggatgcccattagactctcaggcagtcactatttagcttttttttctgattttgatttatgcctggtccacaatagacagcaactggtgcaaaggcaattttgagcctttttaatttgtaaattaaatcacagtgtgtagggcatgcttactacactgtttattgcattgaatggggacaatattgacaatttgcatttgcttggcacttttcaacataattttgcatgtatctgatatgtgcctaagcactacaagatagacctgcacagcagaaactatccacactgtatatataaagaaactaagctgtagacaagtgaagtcgattttccgtggtcactcaggcggtaaaaatcaaaagtagacagaaacttgtaatgtcatgactagttttcttgttacactatattgctattcattggaaagaagaaatccctgtatcacctttttaaaaattattctaaataagagataaacttagggaaaacaaatggcaacgatattgaatttttcctacacagttccatgtgtctgttctcttagataatgcctgctagcactgcccaagacctgggcccaggtatgtacagaaggggccgatcaaaacaagatcttaaaagctgacggatgtacatgtttgttcacagttcattaaatcttttgttattattgagcatctgggaacaactggcctatttgagcagcattaggatcttgtagaagtgcctggtgactatttttcctaatcacccagagacccaagtgattgcaaactcctccccctcaaaatgataataataaaaataataataattggaaaaccaacaaaataccagaagagaacaaatagaagtttaacttttgtaatttcttattaagtcattttgatgcttatgtattttacagaaagacatcatgatttgtttcagcattcatgaggcatcaggacttcaagtcatagaaatccaagtttaaattctgcctgtgccatttcacctactttccagccttcttcctccaccagagaaggaagcacatggctgacctttcaccttcttcaggtagctgagacagctccattgaaatgtgtgctaacaaaatcaggactttacaaaatgctttaatctcataaaacccaatcagctaggggctatttccactatagattaagaaactaaaaaaaaaaaaaaaaaaatcaaagttactgtgaatagctggcaagcttagctttttttttaaattggggccagatgtggttggtatccacatttataagagacatttgttaatacgttagtctcaatattatagatgtggtgaatatattggtaaattggggaattttcttgcctcttatctctccaggtttaggtccccatctatcttcactccctccataactccacacatggctgaagggggtgaatatgcaagatgacatcgcactttgtgtagagaatgcctctcaactattaagagcagcagagcagagcatataagagcacagattctggaagtagacagaaggttataatcacagttctgccattttcttgctgttcattgttactagcaagttagttaacctttctgtgcctgaaaaaaaatggttttaaaaatagtatctagcagactgagatgatacttaaacaagttaatactaacaaagcatttgataaaataaattgatttatggtacctggtccctgacccaagttttgttaataataatatgatttcttcacattcaaaatataaagatctgggagaagtttgttgccagaggcattagcaagtgcaaatatgcctaatatgttctttgaggaataaaagaaatgctgaaacataacaaggggaagagaaataggatatgaggcaagagagatgggggttggataagatagggctttggagtgtttttttttttttttttttttttttaccagagaaacattacaatctgattttcattaaaaattttttactttgctgcatggaaaatagaacaacagtggaaaaagggggaaacacaggaaatactgtgacagaatgctgagagattatggtagcttagtccggggtaggattctgaatatattttgaaagcatagagaatagaatgtactaatggataggatgtggagtgttaggaaaaatgaagaatgaaggatgagtccaagtattcagttaagtaagtagacggattagagtgtcattaattgagaagtgagaaatcactaatacataattatgtttctgttctgttttcctataatactagtactgatttttatcatatattaaacattcaatacaaaaattgcctgtttacataactatctctaacctggatctaaggctcagttttgctgtcttgtaacattggcggtgatctgtcactgatttccaggacactgtgggctccctagagacaaggattctgtgttcctcacagatgtagcccttgtatctagcatagcacctgacacacaattggctctattaatatatgttaagcacatgaatgaggccaaaggtatgacagggtgcctcaaggagtgtgatcaaataacaggtctcattctcagattgtcaagtcagtttaccagacagaaagcattcctttgtagaacagcacttgtttaaacaaaactaaacatagcaatgccaatttacagcaggatctgttaggtgggccagacaaccccattaagcaatcttgtgtatttttaccatctaataaaactacatgggaaaaattttggtccaatcaagatggagtaagcacactctgattctcccactgaatacagctaaaaatcctggacagagctggagaagctagttgagaactctgaaaaataagtagtaataagtgaattggggaaaaataacagaactcaaaacatcactgaatcatgcatgagtttcttggacctttttccccaatatcttcagatttagactcaaaagcagccaaatcgtggaactgtgcaccagatgtaagcagaaaaagctccaacagaagtttatttccagtctgaggaaaagaaaatgacaccctacaaatcagagagcatggagaaaattctatttttgtttttccttttcttctagctaagcccccaggtaaccctggcaaggtgatgatagtaagcggtgggtgcaaaggcaacagtgtctgggtggatgcttataactctaaggatggaaacccttctctgtgaccaaaggaactgtatcccaacagtgtgcgggggaaaattctctgttggtttgttcctttctctagcctttccccacttggttcccatggcagggtgatctcagggacagaaagtgagaggcagaggtgaaaactaaagtctcagatttctagccagaagaccaggaggtgggtgggagaggctggaacctggagtgggacagggagacagtagggcagtgaggtggggagtgctaagaaagtagtcctatagcattgagtatgaactcttagtttccccctaagttgtacaggcattgatttgactctggtcagcataccaacttttgagaactcaactatgggatggaacaatgcccagggctaaagactgaccactcaatgaggcatatgtttgataaactttgatagcactgcaaaggctttgaaaactgacagttggaggcgcagcctaagaaggtaagtgggaacttacagactaaactaaccaggttgtttgcctatacttaaaaaaaaatcagtattctccattagatttaaacagcacccaagattgcataacattatatttgaaacgtccagaatatggcaactgtatacaattatttggaagtgatgtaaagagcccagacacttttactaatcttcttgcttcatttttaaactcagactgttgataccatctttctttaaatgatttagtagaattcactgagttatattcaattcttttttcttgctgctttggccctagagagaaactctggctcattaaataatttattagttgactcattcagagattaagtcattgattaaaaagacatttattgagtacttactgcatgtcagacactgtgctggatgctgctgacagaaacataagtaagatgaatctgtgtcctcaaaaaaaaaaaaacgattcaacatataagtatgggctcagtggtagaagcttgtggggaccaaaggagtttcatcttcttaggcaaactttaaagtcttaagtgcgcataataaaatggttcgttttattcaaagttcttttcttatccagtaaatggtaggcatgttaattagttggcatgatagtgcaccaaagaacaggacttcattcagtagtatttactttgttcaacgattattttttagggtctgctatgagccaggattaacctagccatgaggttctgtactaagccgacttgacttgccaggtgctctctggctggatctgcctcacagcagcatgtagagaggaaatggaagcaggaaagggctgcttttccttctttttttctttattcaaaactacatccttgagttagaccacttaacattcactcctaattttcatattgtttaaacaaatcagaagcctccaaaaggattagcagaaactacaactctccaatctgtgattataatttaactttacagccgctcaaaacatgttctttaattcatcagggaaactggaactttgaagtagctgttaaacaaaggaaaatcagactgtcttaacagtgcagaatcaaagaatgtctgagatgcaagagatttcagagagcatctactttacaagctgaagaaaggaagcccttgggctgaatttggcctttagatatgttttatttggcctaaatgccattttatggaaatctcacattaatatcaagctttgtggattctcttgataattcagaagatgtgacaacactggctccatattctcacatggcaaatgctctggaccctgtctcatccaagattgtgaccttctaattttgtccaataaactaattttaaagataaggaaaataagaccaagaggacttccctaaagtcatacctctagttagtagcagctagcctcagaatacttgcctcctaatttcttgggtagtgttattttcattatgtgaggctaaggaaccactgtttaagaatgatttggcaaattaactcatgaccatacaataataaaacaagcagcagtttatttttaaaaaatctggagttaaatctttgtgttagttcttattctaggtactaaaatactttcagattgtcctcactgtttcttctgtacccattagtaaggaaaggatagtaaaaggaaggaagatataagggaagggatccaagtattttcttggaagatgattatacatctggaaaacaccactggataacatactataacattgcaatgaaaaaaaaaactgcagtgaatcaaattctccctactgtcatttattttgtgaatctactcattctttatgcatatggcaaatggatttcagttatgcacagtggatgataccatattttttctgctgtgacagaagggcagaacatccctccctccaagccagaattaatcttttgccattatatgctcccacagaaatgtgtttatatctctattacaacacacaatactttctgtcatgcattagaattatctatgtgcttgtctatgcccaccacagagtaggaactccctgaaggctaacatttgtcatgtttatcttggatcttccatagtttctaacaccatggcttagactaggcaatccatttcttcattttgcatttgctaaatgcctattctgtgcaaaagcctctaaacatatcatgggattcagagattacttcagagtagaaaatcagcactatgtggatcagacacacattgatcttgtttatcattgtatttccagcacccagaacactgctcgacattgtcaggaatataccagtggatcatacttatgatggttgaaggtggaatagacttactgtatggaatctaacataaagtgggcccaacagagaaatgaatgttgtaatgaaggtgcaggtagctttttgggaacatagatcaagtttaataaaacaaatgactagctattgatttagggcttgggcggtgactggtgttgtagggaagaaaacaaatagtctatgaaaagggtggagtaactgatgacatcacataaatcattcatcctatgcctaacactatactgcctattctttgtcaggcagcatggcaatactggaaacccagagctgtatccacatgcctgtagagacaccagttcataatatttgcagtgtctccagtttattttgtgcctgaaatacaggcagttgacctctgaatgctcatattgaaatgcaaatgaacacagcagctgcagaaagaagaggcttcttcagggagcttcaaaaattcaacagggattgcacacttctccgtgcagaacatcaaattttaaatttaaatgattcaccatgaacagccagttggcagccctctgatggatatattattttagataccatatctctcattcacattacagtattttgcagaacttccatatggtgtgtaaatgaaagaattccacagggacatgagggctaatggttatgatattatttaaaagattgtgtggcaaaaaccatagcattagagtcttcttactatactaagatcaaactcctagaccagacttttcccacttggccctgtctgtttatcttcatcgccaccattcttttcaatgagttatattttaactgtgttttataatgtttcctgaagatgtggctttctcatttttgtccaattagcttcttatcatacgttaaaacacaatctagtggtcactctacgatgaatccttgatagcctttcccaggtagaattgaaaatgattcttttttcagggctccctcactttgaaaaggagaaaaataatactttcttttagagttgtgagaattagagataatacatatggaagttatgaccccacaacaggtaccaaataattagaaacttgctaattgttattgtacatctagtacaatttacatacacaagatcactattagtatatttacataattaacactttccatctttgaaaatttgagaattactgtgcttatttattcacacagtgttctagagtttatgcttctgacaataagagatgcaaaaaatttaagttcgttcaagattttatttctaattaaaaataatgagcatgctaaatgaagattccatctcttataataagcactgtaattgaaatgaagtagaaaattgcaaaaacgaattacattgcagtatgtaaacctacaaagaattgaaccagaaaatgcagagttcacatattgcacacatgagagattaatcatcatctctaatacaagagatttgattagggtagaaagtagatctatataaaatgattaatattgaatcatttttatcaaaaagtatttatgaagctccctcttctgagtgtagtggctattgtaccaatggtgcaaattttgtaggacatagatattcctttaaaatcacaacactattttcaaccatggcaataattattttctataagccattttattctgaaatatttcaaaggtagccattaaagaagagataggagaggaaagtagcaccacaggtgctacattctagatgctttacacacttatgacctcatgtagccctcacagcaaacacataagctaagcatcattttctgcccttgcttagatgagatccaagagttagaataaaatgctaaatgacataaagctaaaacatacttggggagaatttcaaacccagttcaatctgactctttcaactatgctatctgcagtatacctaaaacgaacattttctaaattattatcatgtttagaaagaagtaacaaagataagaaactgcttaaatacactatccaccttaccactatgaatacacatttatttcattataacccagacttcaattcctttgatttatgggatcacccagctcagcacatagctcaggagctgcatgctggagggagctacgaggaaggggtgggggcggcagacacctgccttctgacatctgatcttttaatcaaaacatgatatatatgcatgtatttatacaacgagtatgtattgagcagcaactgtgtgccagggtgttctagttaacagagatttcagtaaatatttgttaagaatctagtgtgtcctaaaatccgtaaaattgcagtagaggaattagtctcatgcgtatgcatatggtttagcttatttggagtcatataacctaggtttgaaactattttgccacttactagttgtgtaatcccgggcaagttatttactctgtctaaacattattggatttttgttaaaaggacactaatagtaattatgtcataaaatttgatgggagcataaaatgagattgtatagggaaagtgtgggtaagaatagagcctagcaagcaactgcttgttaagtgttaattatgataatgatgatggtaataagatcacttattttttattttttatttttttgagacagagtttcactcttgtcgcccagtatggagtgcaatggcacaatctcagcttactgcaacctctgcctcccaggttcaagcgattctcctgcctcagccttccgagtagctgggattatagctgcccaccaccatgcccggctaattttttgtatttttagtatttttttgtatttttgtattttgtaattttttgtattttttgtatatttagtagagactatgttggacagtctggtcttgaactcctgacctcaggtgacccgcccgcctcagcctcccaaagtgctggcattacaggtgtgagccaccgtgcccggccagagaccacttatattgtcctcaattatcaaattaagctatagaaatcttcatgattgggctgcatagaatacaaattgcttttctaattttgatggaccccttattttacctagattatggaaaactattattctttcatttgggaaattgaagtagcttttattctcctgtattccttttacttgactgccaagcaatgggaatgtaacccaggctcagtaaattggcagctgtattccaggaatctggagaaagctaagtacagcaaaagaatgatcagtatttatttgcaatcaagttcacgatagggtgcaaatgtagtcatactctggccaaattgctaaaagcagagtttcctgctgcctggaatcctttggacctgggccaactttccaaacttggtcttctagctactagtacatccaggtggtgggggtgggcaatattctttaaattaatactatttacttcatttatttatcctaaaaaagtcaaactaaaattggtttttagtgattgcaacaaaatctctgtcatgagtcaaaatgttgtttggaaaagcaacctacagtcaactggatacatatttactaattatttaagttccaattcaactattgattttcataataattagtggcttggctctattcagtgtttgatgggcttgtatgaaggcctatagtccaagagaattacattattcaactttatatcaaagtagaaccatggaccaaaagttttcctgagccaaattattaaagaaaatgcaaacatcaaattcagttcactactggcttctcctgatctggaatagcataggccttgcaccctggaacctgatttcacaagggagaataccttcccattatctgtgactatttgaatctagtaattctgtgtagagaaagaatcaccagatgaattttcttccttttcttgtctgctgaataaacttaattaaatattgcctgagaggataagagaaaacccggggccatgccttatggacgtactcatgtatgtactccaaagagaatgataaatatgggaggaaggaacaatgacaagagggaaactgaaacaagaaactaaaaatttcaggctgggtatggttgcttatgcctctaatcccagtgctttgggggaccaagacgggaggatctcttgagcccagcagtttgaggttgcagtgagctatgatggcaccactgcactccagcctgggcgacagagcaagaccctgtctgtaaagaataaaaatttaaaaattcaggcatcaagggaacccttattgcagaaaatttgctatgtgcttcttagacaatcaattaaaacatatgttttgctttctaaatttttccatgtgatgttcaataatacctattcaggatttttaaaaaatccccctttgaagttatttactatgtttcagacttaattttcctctgtgctagagacagaggtaagattttgatacaactaagatggtgttattgctaggggatctaggaatacagaattctataaaactatagccactgttctgcatgaggtttacttatgtgatacagtcttaccaaacaatgactgtacctcatatgtgaaattaaaatgccttattattcaaaacatggtcatttggaatgaaataaacctaaattttacatcaaggggacctattcctcagcctcagatgcacatcttacaatagtaagatttggcagctctacagggaacaggttaaagaactcaagggtgccgaagttccagagagccaggatttctacctcactcagagaacagggaacaaaatggccaggcttgcctccagataagaatgtgccccacttcaacttatttccatagcaagagtgtatgaggaaagagagaaaaggctatacccgtgtccctgactttgaatccatagtacctctgcactctatcacaggtggcccagtaagtatcctggaatctagccaaattattatacaaagagtaattttttctaaggaaaaatccttagaaaagaagtatttggtggattttcttctccaggggtcacaatttgaccttcatatttaaaaattattaagcactagcatcgtaccggcattatcctatagaattgtgggcgtgaataggccatgcaacttactcttaagatgttgtaacctagagggaatgtttaattggagagaaagggaggggggcaagggctgaagaactacctgttggctactgtgctcactacctgggtgatgggtctaaccataccccaaaccacaacatcatgtaataaacctttgtaacaaatgtgtgcatatagccccaattctaaaataagagttgaaaaagaaatgaaaataaaagcaacaaaaaaatcagacaaacagcaacaacacaaatccaaactcttcctagaaaagaagagataatttgtagctttggtcaaaggagaaagctataatgatttctcccgtgccacagtctaggcaaaacacaaaaattccaggtagaattcagcggcaacaggcagtgagctctaagaaatgtcacacatatagagcaggtcttaagtgactagcttattttttttttaccagattacctcacactaaactttcacagacatacttcttggccagtatttccaaaaattttgtaaattgagagcagcctttacaatttacaccaaatatagagagatttaacaacttgcccaaggttacagagatagaaaatggcagagaagcactactgctacacacagctttgtataatgccatggattacatagctatagtatagataagaggttttagaccataaaacattcttaaacgttgcttttatattttgctagaatttcacagatgtaaaacgtgacaattaaagcagaatatataaaacagtctaatcggaaaccttctggcaataagagtttgcacttagtttataaatgcacaaacctctccactgtgactcatagagatttctgacttgtgtttatttgagtttcatttctccatacaatgtaatttttggttgaattctttcttagatttacattcttttatgtgttcggaagtgttgtgattcttggctctgtgaaattgctaggaaaaaagtgcagaagaaatattcctaatattgttgtaatttattgagttttattaaatgccagagactgtgtgttatggactaaattacgtcccctcaaataccctcaatatgttgaagaaactctaattcctagtgtgatggtatttggagatgaagttttgggaagtaattaggtttagatgagctaatgagggtagcctgttcatgatagggttaatgtccttaagagaagagataccagtgacttgataaagaagatacaaaaaaaatttgattcatgccctgaatttctctccctttctgccaagtgtggacatagcaagaaggaggctgtctgtaggctggaaaatgaggcttcaccagaacccaactatgttcacatcctgatctccggcttccagcctccagcgctgtgaaaaaaaaaatttgtttaagccactgtgtcaatgttattttcttatggcagcccaagctgacttaacactatgttaaatgcttcataggtactattccatgttcttctcataatatctctatctgctaggcatttaatattatcccaaatttacaactgaagaaagtgaagaaagagagtttaagcaatttgtccagtgtcatagagctattaagtggcagagccaggatataaatctagcctgtcaaatgccaaagcttgtacaaaaccactttactgtgatgtcttcagtgtgcataacttttcatttccataaacccaccactcacaaatcaatcaatttaatcacattatcacatttattaatatgagatacatgagtttaccctataatttctttgtggcacatattttaggtctgatggacccagcttttcctgcagttactatctgaaagatgcacattagggatagtttctagccttctattcactcttagtaattttgcaccagggattcttcattaccactgcatgtcattaagatgtcagatatactcctcctaattggctgtacaacagccacatgtgcatatttcaaatttgaaatattttaagcagaactcatcttctgtacctcaatctcacccctttccctatttctctacttgcaaaattttctcaatcacctaaaattgaatcttttaagtcacccttgtcttctccctttccttcagccctgcagaggatcaccaagtttacctcattcttctgtcacctaacaataacttctgtgacaccctcaaattcccagcagcttaataaaataaaggtaatctctccctcacccaacaaattctgaattatactgtcagattaatatttttaaatatggtttttgattacctcgttttcttcaaaattcttcaacaattaagatatagaagaaaattccccaaatcatggtttggcatgcatggttaaaaacatcttttcaaacttgcattcccagccttatttgttacaatctatgacactgagtaggacatgtattttctcaactccattattcagtttgccaaactgtttaagcttgaaatactctgcctccaactccctgtctcacagcccaactaaacttcaggattcaactcaaagactagctatgtcattaatccctaatttccccagatgcatgcattctctacttctctaatgcctagagcccttaagtcacatttcaactattttctacttatcatgtgtaaccttgtattgaaggtattcccagataaattataaaatacctgatggaagagattaaccgctaactattcttggcctcctctcttgtaactcttaaaaccagttcagaatcttgcttaatggatgtaagaagtgataatttgataaagaagatatgaaagaaatttaactcatgccttgaatttgtatcaatacttcattggaaagaaatcatgtgccatttaggttatatttaatatctgctctgatagtcatgaacccttgagctgatcagtaaaatgttttccaagcaacagctcaaatatcctggatctattccaaaataaattgaattggcagggtcagtgggaatcactatggtaacagatggatcctttaactcttgtagtcactttggtgtagattggcatttacatatcatgacaaagccctgctgctgtccatcaggagcaggagaaaggtatatcaagtcagggtaattaacagtagctgctatgacaacagactcaaataaccagtagcttaatacaataaaagtttatttcttgcttatatcacaatctaatgtagattgtgaagtgctcctgagtcttttaagtgactcagagagccaagctctttctaacacatgattttgccatctttggatccctttttttctagtcacatgaatgtaggagggagattgagaccaggatcttttgtgaatttttagaacgcaggcctctaagtagcacacatcactttagctcatattctatcaactaattctagtcaggtactgcaaagtaggtttgtaaatggtgctttcctatgtgctcaggaaaaggaaatggatttgctgaacatctagcctatctttgccataccaaagcttcagcacctgaaggaatttgatatctggatctgatggttattattctggaagaaggaccctgaaaaggcatttgccctgggtctattggtagcggcaaaattcttttaacataaaattccttcaaataaccagaccttctttagtagaattccatggcagggctatgctcagtaatacccaacaactttgcattggtattcattctctagctcaaatatgtcagctatgcgccgtacatatctatagtcagctgcaccttacctatcccactttatttctacctatgtatagtgtcttctctccttgttttaatcttcctaatccatttctgtctgtgaacatggcaggcaaattctgagaccccctccagaggtagagggttttgggaattagaatgccttctttattgatcacggacaaatagaaaacctcttcatgatggactcttctactccagctccacttccctatttcctcaggctattctctctacttggccacttacccataccacactcgcttacccacaggatacccatgctgtctcctccaattgcccttggatactctgacctgaactgatttctcctgtccacagacttccatgacttactctttgactcacacattccagtgatgtttgataatcagacaatctgcttacagctccatggcagtcaatgttatctgctacaaaaaaggccagttcaagtcctgtctttgtctaagtcctctagtggcttcatgtctcaattgagtaaaagccaaagtcagcacagtggcccacacagctttccaagatctcaccttctgtgacctctttgacattatcttctacttgtttccccaacttactttgctccagccactttggtctcccatctgtttccttacctatgacagttcccacacctctccaggctttattcctgtgatttccttctcctgaaatcatcttctcccttaacgacttgggtcacaccttcctcactttctgggctttatacaaagtttctctcttcagtaaggtcaccctccccaacattctaaatcctatctccctgatttatttttcttccagtaattatcaccatctaatatagtatatatttcacttatctattttgttttactctgtctcccctaacaggaatgtatgttccacgaaggcaagaatttttgtctgttttgtttacttctgtaactccagtatctaaaatgcctactgatacatagtagttattcaataagtatttgctgaagggataaatgactcttctagttttaatcttttagtatatcttttattccttagcagaatgtagagaccctgaagttaagtactagatcatatatttgccttgtattccactccagggttgcccaatgttgcaaagggcttaataataatttactaatgtaatacacacacacacacacacacacacacacacacacaaacacacacacacacacatattatgatggagtttcattcttgttgcccaggctggagtgcaatggtgcgatcttggctcactgcaacctctgcctcgcgggtttaagccattctcctgcctcagcctcccaagtgtctagtgttacaggcatgcaccaccatgactggctaattttgtatttttagtagagacggggtttctccatgttggtcaggctggtctcgaactcgtgacctcaggtgatttgcccacctcggcctcccaaagtgctgggattacaggcatgagccactgtgcccagccatttattatattttataagtcaagatctttcacatcatttcttagtgaccatatctttgatagaaggctctcctgtcttcagtaccatgtcacagctgtggggacagcggtttctttatttagtagccatctggactaggtgtcagttctctgtaatttttaaaggtagtgacactggcaattactgaaatgtcaaaacactaggccaaccatgagggctgtggcaaaaaccttcccacatagttgtcatggtgatgtgggcaaactcatatatagcatctgacactcagccataaaattgaaattaaagttagctttttataatatcttagagaatggcacctgttataaaacaggtataccgtaccaaaacacctacatgcatatgaagaataaggttatgaataggcagaggaaacatctgttttttgtttttatattaaatgttatattctagtaatatgctgtaaatcatcattcctagcctagatattattgggatatatatttactaataccacatattgtatttcttttccacaacaacctaaatgcaaatattttctaaagcacaatcgattgtaagtgtaaagttttaatataacatttcttgagatcctttcataggatctttacctatatcatgccattttatccccatcatgactctaaaatataattattgtctgagttgtataaatgaagaaggcagggctaagtaactggcccccggttacagagtgagtgaatggtggagctgaatttaacataagtgatcactccaaagctctcactcctgttcatttcacagcatggcttacctgagtcatctgagagactgggagagaatgaatcactgagcagctcaaaagggataagcttagggattaaaagcaggaggagaagaacatccctttgtaaagtaaatttccatttggttacagacatcaaaatcacaaaagatatgagagataagggacttggttatttgctagaattctttgaagcctgagaaataagtctgaaagaggattattttatgttttatagatatatatgtataaaaggacaaatagatatttgtccttatacatttctgaacaggtttattaaagtactattgacatagaataaactgcacatattgaaactgaacactttgataagttttcacacatgtatactctcatgaaaccacacaaaagtcaagatacttaacatatccatcacctccacgacgttcctcccgcacctttgtaatccatcactccccattcccatccccaggcaaccactgatttgctttctgtcactctagattactttgcattttctaaagtttcatagagattgaatcacacagtatgtactttttttttttttttttttggcaggatctaactccttcatcctggctggagtgcagtggtgcaatcctagctcactgcaggcttaagcgatcctcctgcctcagacccccaagcacctaggactataggtatgcgctgtcacacctggccaatgtttctatttttttgtagagtcggggtctccctatgttacccaggttgatctcgagctcctggcctcaagtgatcctcctgccttggcttttctggctacttagactcataattattttgatttttgctgtgttgttgggtgtattaattggtcattcctttatgtagatgagtaatattccattacatgaatatatcacagtttgtgtattctttcacctgttggtgaatatttaggttttttggcgtttgagctattacaaataacatcattttgaacattattccttaaatacttaggagtagaatggctgcaccacatggtgggtatatgtttaactttttaagaaactatcaaactattttccaaaatggttatagcattttatattctcatcaacagtacgtgagaatatttgttcctcaacattcttcccaacatttgatatgaccaggctttataattttatccatactaataagtgcatagtgttatcttattgtggtataaatttttgttttcctaatgattaatcatattgagcatcttctcctgtacttatctgcaatccttatatcttctttgatgaaatgagtgttcatcaatattttgaacaagcatgttttgaatagtcattttatcaaagaagatgtatggttggcagataggtataggagatgctcaatatcagtaatcattaggaaagtgaacatttataccacaataagataccactatgcacttattgggtcatgtatcctgtaaacacataaaccacaaaaattaaaaatgactaaaagaaatggcttttcattttgctcattttaaaaactgcattgttattattttttaagaatttctcatctaccccaattataggtaaattatatagaaattcttccaatctgtgccttttcttttccattctcattacagagcaagtgtttttaattttgatgaagtccaacacagtcattttttcttctactgatcgtgttttgctgtcgcgtataagaaaccttttctaacataaggtcatgaatgggttttcatgttttcttatagatattttatagttttaggtttcacatttatatctataattttcattttttgagatggattcttgctttgtaactcaggatggagtgcagtggtgcaatcatagcttactacagtgctgaactcttgggctcaagcaatccttctgccttggcctctcgagtagctgggactataggcaggcactactgtgcccaattacctgactaaatttttttattattagtttttgtaaagaggcagggggtagtttcactttgttgcttagactggtcttgaactcctggcctataatgattctcttgacttggccttccaaagtgctgagattataaacacgagccaccgtaactagctaaaattaatttttagttaatttttatatacattcatacatcacttaatgacaaggatatgttctgagaaaggtgctgttaggcaatttcatcactgtttgaacatcttagagggtggttatgcacaacctactaaatacataagctatatgatatagctggtttctcctaagctacaaacctgtacagcatgttactgtactaaatactgtgggcaattatacaaaggtgtaagtatttgtatatctaaatgtagacaaagtacagcagaagtgtgacataaaaggttttaaaatggtatacttctataggatatttacaatgaatagagcttgcaggactggaagttgttctgggcaagtcagtgagtgagggtgagggaatgtgatggcctaggacattactgtatgccactatgactttataaacaatacacccttaggctacactaaatttataaaaaatattatttttctttcttcaaattcaccatagtttactgtaacatttactttataaacttttaatttatttttaactattcaactcttttgtaataacacatagcttaaaacacaagcacattgtatagctgcacaaaatattttcttctttatattcttattccataatcttttcctattttttattttttaaatgtttttgttaaaaaccaagatacctacacacattagcctaggcatgcacagggtgaggatcatcaatatcactgtctcccacctccacatctcatcctaccagaaggtcttcaggggcaataacacacggagctgttatctcctatgataacaatactttctggaacacctcctgaaggacttgcctgaggatgttttacagttgactttttatttcttataagtagaaggagtacactcccaagtaatgataaaaatatataatagtaaatacataaacgttattattttcaaaattatgttgtatacataattgtatgtgccatactttcatgcaattggcagtgcacagggtttatttacatcagcatcaccacacatatgagtaatgtgttgcaccatgacatcactaggcaacaataatttttcagcgccattataatgtgatgagaccattgttgtatatgtggaccatcgtttactgaatcgttatgtagcacatgactctacgttgcaaggtgtagactgaattttggtggggaggaagggcacgtggatataaaaatttttcagtagcatttgttaaaaagcttatcctttggcatttagattatttccacctcttggctattgcagctaatgctgtgatgagcattgggtacagatacctctttgatatactggtttcatttcctttggatatatatccagaaataggattgctgtatcataaggtagttttatttttaatatttttaggaaactccatcctattttccataatggttgtaacaatttacatttctaccaacagtatacagggttcccttttctctacacccttgccaacacgtcatctctttcatctttttgatagtagccattctaacaggtgtgagatgatatctcattgtggttttgatttacatttctctaatggttagcagtgttaagcacttttcatatatctgttggacatttgtatatcttcttttgagaaatgtgtattcaaatccttagtccaggttttagatatgttattatttgtgtttatgtgtgtatgttttaattttgctattgagttgtttgcatttgttttatgttttgaattttatcagatatatggttgcaaatattctcttccattccttaggttgtcttttcactctgttgattgtttcctttgctgtgcatgagctttctagtttgattaaattccttgtctatttttgttttcattgctatgcatttggggtcataccccccaaaaaatcatcgtccaggccactatcaggaagattttccatatgttttcttccagtagttttatgtttctaggtcttatgtttaagcctttaattcacgttgagttgattctcgtctatggtgtgaagtaagggtccaattttatttttccacatgtggatatccagtaaatgatactaatgtattaaaattttagtttctaattatttactgctattatatagaaatacaattcatttttctataattcatatcttctattacaaaaatgtaataaactcactagaacttagtttgtaaacaccactgcttttctagaaagacaattataccatctgttaatagagttttactccattctttaaaatctggacatcacttatttttttcttgacttatttcactgactagaacctatagaattgaaagccaacctcctttcctgaccacagggaaaaatatttttagtagattgaaaaagattctgccaggcacggtggctcacgcttgtaatcccagcactttgggaggccaaggtgggtggatcacttgaggtcaggagtttgagaacagcctggccaacatggtgaaacactgtccctactagaaataccaaaattatctgggcttggtggtatgctcctgtaatcccagatactcaggaggctgaggcaggataattgattgaacctgagaggcttgaacacaggaggggaggttgcagagagctgagattgtgccactgcactacagcctgggtgacagagcgagactgtctcaaaaaaaaaaagagtttctgtctatttttagtttgtgagtcatttcatcaaaaattattataataggttttctcattaaaaaatattatatgttaatacaattccatgaatcaatttttgaatattaagccaaccttacatttcaagataaacaccacttggtaataatgtattataatttttaaatgtgttattagtttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatatctctattttggtaccagtaccgtgctgttttggttaccgtagccttgtaggatagtttgaagtcaggtagcgtgatgcctccagccttgttcttttggcttaggattgacttggcaatgcgggctcttttttggttccatatgaactttaaagtagttttttccaattctgtgaagaaagtcattggtagcttgatggggatggcattgaatctataaattaccttgggcagtatggccattttcatgatataaagacttaaacgttagacctaaaaccataaaaaccctagaagaaaacctaggcattaccattcaggacaaaggcatgggcaatgaattcatgtccaaaacaccaaaagcaatggcaacaaaagacaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacagtgaactcaaacaaatttacaaggaaaaaacaaacaaccccatcaaaaagtgggtgaaggacatcaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaacaggaacacttttacactgttggtgggagtgtaaactagttcaaccattgtggaagtcagtgtggtgattcctcagggatctagaactagaaataccatttgacccagccatcccattactgggtatatacccaaaggactataaatcatgctgctataaagacacatgcacatgtatgtttattgcggcattattcacaatagcaaagacttggaaccaacccaaatgtccaacaatgatagactggattaagaaaatgtggcacatatacaccatggaatcctacgcagccataaaaaatgattagttcatgtcctttttagggacatggatgaaattggaaatcatcattctcagtaaactatcgcaagaacaaaaaaccaaacactgcgtattctcactcttaggtgggaattgaacaatgagaacacatggacacaggaaggggaacatcacactctggggactgtggtggggtggggggaggggggagggatagctttaggagatatacctaatgctagatgacgagttaatgggtgcagcacaccagcatggcacatgtatacatatgtaactaacctgtacattgtgcacatgtaccctaaaacttgaagtataataataataaaatttaaaaaaaggtattattagatttgatttaaaaaattttgtttaatatatttacatcagtgttcatgaggtctatatgaggtatattggggtataattgttttgtttgtttgtttgtttgtttgttttgttttccatgagatattttcgtctggttttggtacctgtaattctgtcttcattgattgaattaggaagtatttctacttctttacttttctggtagagtttacatagaattgatgtctgtttttccttaaatgtttggcagcagttcaccagtgaaaccaatctgggcctggagttttctttgtgggaaaatttttaactataaattcagtttaacaaatataggaccattcatattttctctttatcctccagtgaacattggtagaatgttaatttcaatgaatttttttcattttatctaaattaagtcataaagttgctcatagtatttattttctttttcatatctataaaacctgtagtgatgttgcctcacccattcctgatattagtaatttgtattgtttctcttttcttttttttctgatcaatttgatttttcaattttattgatcatttaaaagaaacaggctttaattttattgaattttctctattgtgtttctgtcttctgtatcactgattttcactctggtctattatttactttttctacttactttgtggttaatttgcttttcttttacaaatttcttgaggtggaagctgtggccattggtttgtggtttttttccctaatatttaatgctagaatatgtccttaaaatattgtttgaggtatctgaactacgtgttttttccattctgactccgttaccatatgattgctgggaacagtgttctgttttaagtggttctgtcccgggtcatgcgtgtttgatgaatactccgctgaatgctcaggagggagcctctacacatctccagcattctctcttcacgcagttctctcctctctgattctgtgctctacaaactctagctttgttgacctctctaaactcaattccattttctcactttagaagggtcacatcttttatttcttgtctcttgagaataatgtcttcattgtttgaggtccagtgtcttgcaaacttgttttctgaattttgtctggttttgctgctgttgttatttcaagcaggagagtaaattccatttttattacttcatcttcaaaagaagcagccattttcccatacatcatcatatgtaagcctcatgataatctgcaagttcattttttttttttttgagatggagtctcgcactgtcacccaggctggagtgcagtggcacaatctctcctcactgcaagctccacctcccaggttcatgccattctcctgcctcagcctcccgagtagctgggactacaggtgcctgccaccacgcccagctaattttttgtattcttcaacaagcttatcaggtctcaatttggtgaattttaagtatctttaacataccttgggttcaaattctagtgccttaggagtttgtagaaaattggtctttttaaattaagggctttcttctgggatctcactgagtattttttgacagtggatattcatcattgaaaactgcctgcactaaacacttacttgagtggataattacaatcatttcttaaactctggaatttaaataagaaatgtgtaaaattatttctctcaaaacttccatagctggggctttgatatagctttatgttctatttccttaatgctgactccaacgtggacaaactttcattcctttggcaatgaaacatatcaaaatacaaataattcaagaatgggtattaagccaatagtgtcacatgaaattctaattaattttgtctgatatgaagacacaaatgggcttctgatcgggatattttactacatgcactagtatcatgtgatcaaaatttttcttcaatgtctgttattattgttctagtatagtctttcctaaagtatggtgctaatcagtgttaaataataatgtgagttcagagttctgagagtaaaaacttgaactctactttttctattctctcactcaacaacaatcatcacagaagacttctgtgaccacatgtgtggggttttctccatgaataagcaagcaatcagttctgcagcaaacaccagctgagtgtcctccaattaaattctgatactatctacttggagatggcatcagatcccacaggttaatggagtcctcacaagactaccctccctcttcccaccagtaataagtctgggcctccagaaattgtgaccaaccggcttgaaggtgacattcacatgacctctggttgggttcagttgatttgttacagtggctcacaaaactcatagaaacttacatttaccagttcattataaaagatattacaaagatacacatgaagagatgtatacagtgaggtatagggggaggggtgtggagcttccacgctctccctgggtgcatcatcctcaggaacctccattagttcagctattgggaggctatctgaaccctctctctttgtaatttatagagatgccattaattagacatgactgacaatactgtaaaaatatgattggacaaaaagtgtagattcttcttggcttctgtgttgggggttcttgaattgctataaagaaatacttgagactgggaacttaataagaaaagaagtttaattggctcaccgttctgcaggctgtacaggaagtatagtacaaacatgtgcttctggggaggcctcaggaagcttttactcatggtggaaggtgaagcaggatcacacacatcacatgccagagcaggaccaagagagagagtggaggctgggacaagtgccacactttacaatagctagatcctgtaagaactcactcactgtcatgagaacagcacaaaggggatgctgctaaaccattcattagaaaacttccaccatgatccgatcacctaccaccaagacccacctccaacactggggattacaatttgacatgagatttagagaggacacattaccaaaatatattatgctgcccctggcccctcaaatctcatattctcacattgcaaaacacaatcacttctcaacagtcccccaaagtcttaactcattcctgcatcaacccaatcagcagtcccaagtccaatacctcatctcagacaaggcaagtcacttacacctatgaacctgtaaaatcacataagttatttactcccaagatacaatgggggtttaggcattgggtaaacattcccattccaaaagggagaaatttgccaaaagaaaggggctacaggacccattcaagtttgaaacccagtaggggagttatccagtcttaaagctccaaaataatctctcttgcctccatgtcccacttctagggcatgtgggtgcaaggggtgggctcccacggccttgggcagctctgctcctgtggctttgcaaggttcaacccatatggctactctcacgggttgaagttgagtgcctgtgacttttccaaatgaagggtgaaagttgccagtggatctaccattctggggtctggatgatggtggcccccttctcacagttgcactaggcagttccctggtggggactgtttgtgggggctccaagcccacatttcctatccactcttccctggtagtggttctctgttggggctccaaccctgcaccaggcttctgcttgggcacccagtttgtctcatatagcttctgaaatcgaggtagaggctgtcaggcattcttcactcttgcagtctgcatgcccacaggcttaacaccatgtggaagccaccaaagcttatgacttccattctccaaagtggcagtgcaagatgtatgtgttctcctttgagccacagctagagcttgagtggcctggatgtgggtaacaacattctgaggctgcaaagggcagcagggtcctggaccaggcccacaaaagcattcttccctcctagacctctggacctgtgatggaagcagctgccacaagggtctctgaaatgcctaagcggcctttccctcattatcttggatagcacttggttcccttttagttgggcaaatatctctagcaagtggttgctccacagcctgcttcaatttatcacctgaaaaagatctctttctctgccacacagtcaggctgtaaatttttccaacttttatgttcttcttctcttttaaatataagttccaattttaggtcatttatttgctcccacatctgagcacagacagatagaagcagtgaggctacatcttgaacactttgctgcttagaaatttccttagcaagatactgtaaatcatcactctttagttcaaacttgcacacatctctagggaatgaacaaaatgagccaagctctttgctaagacatgacaaggatgaccttttcactagttcccaataacttcttaatttctatctgagactttatccgcctgaatttcactgtccgtatcactatcatcattttggtcactaacatttaactagtctctaagaagttctaaactttcccttatcttcctgtcttttcctgagctcccccaaatcttttgacctctgcttgttacctggttccaaatgtgcttccacattttcaattatctttatagcaatgtcccactccttgataccaatttcctgtgttaggtcatttttacattgttattaaaaaatacctaagactgggtactttataagaaaaaaatgtttaattggctcgtggttctgcaggctgtgcaggaagcatagcgctggcacctgctgctggggaggtctcaggaagcttttactcattgcagaaggcagagcgagagcaggcacatcatatggccagagcaggagcaaaagacagagtagggtagaggtatggtgccatgctttacaactagatctggtgagaactcattcactattgcaagaacagtctcaaggggatggtgctaaactgttcattagaacatatcccccatgatctaatcacctctcaccagactccacatccaacactggggattccaattcaacatgaggtttgagcagaaacaaatatccaaactatatcagcctttctgtgcagcattccttcctctagaatatggaacaggatcccttctgaaggaagatcttatgatctacaataagattagggaataatccccaaaaatgtaaccatggaatccttttctcacactagattactgttctctccaaatacaatcttgaaaatgttaatgtggtgcaaggatgaggaatctcaaatctgggtgttagctgtagcagttatttaatttaattttatttggctcttaaagtactattccggtattctagctactctctcccaagcaattcttttctttcagtagatttttttttattttccccagtcatattttcagtttgagagatactcaagtgttctgagctatggctaagccattaatgaacatttcaaagggcataaaagatggcagaagacaacattctgatgcataaggaagtatcctctaacaacccacttcaaatactagtgagacatattcatcagagagattgtagacaactctagattgaaacttactttaagagaagaagaaacacttctaagctagtgagactaacctttttgaatataaactctttgaatgtgaaaaacttgcacacattctacaaatattatttgtacttttagtatttttgatttagtaagcacataatggccgtaaacaactatgatttcaataattcttaatttatgattttgtaacggcaacagtttgtacatacacacaagaatatgcaaggcacacttcagtccatgaacaatggtcagttatatgaggattttagacccaggcaaagtatctacagtgacccagagtccctgcatcccacaaattggggactgcggtcctaggtcctctagctttttaacactatgagaaataaagcagcatttatctaacaacatttataaaatgcttgccttatattcaaggcattgggatagggatttggaaaacagagatgataaagatagcgcctctccttgagacatttataatttaatggagaaagatgaatataaaatgtttgcatgctggtctaacaatttgaaaaattctacttatttgttgatgtaatacagcaagaaaaaattctattgactgtagttacttcagcatctgtggatggtatcatttttctttctgcagtaaactactttctgtgtggcaaagtaactttatcccaaagcagttttgggttcaaaaggtgagcatctctgtccaagggtagaatttttgaagaatacaaggaaacaaagaaacagctaaatagctctacacatgaagtggagagaaacttgtgttagtgtgtagaaatactgagaagagaggagggaaagattacagagaaagaaagggagagaattaagcaccacagtggcaaaaagcttgtagaggagtgggagtgtgtacaggagagcactgtggggaaatgctacagggaaagaaatttattttggtcactatattagtgaccaaagggtcacttttataggggagtggttgttaaggtaaacacttagacagtaaagcattaatgtaaagaagttcaaaaaccacaatggtacatgaattgttaagataaacacaccctgataaccaccactgaatcaataaatgacattgctacaacccagagaaatctcattgccaatgtacttttacattgctctgaacccgttcatttaatcttcattttattaacagtagtttggtacacatagagatggttgtgtgagtagttccttgggggaacaaaaaatggggaagtatatctgtgctcagtgtctggattcccttgtagcaaaaagaagacaaaaggtaaatgaggtgaaaagtgagaaaattaaagtcaaagtaagaacagaaaactggagcgattagaaaccatgagagtgtgaattcattggaactgatacatgtcttgaagtggacttttcactgagcaagatttagcatgtacagaaacacaggagcttaactgggcatgcaattttaaaatgaaagatcacaattcatgaaatggtgggaacacagatttcatgggtttaagaaataggagatgaggcataaagaatataaatgaccaatttgaagagttttgactgaggcagagtttggcttccttttgtagacattgtagaaccaaggatgatctttaagaatgggagtaacattgatgagatttgctctttaggtgaagacctttgaaactaatttttagtatcaaatggggaaggaaaaagctgttatcaaaaacattagatagggggattttaatatttaaggtgagggacaataaaaattatactgaaaacagtagaacagagatgtgaattcaggtaacaatgaaaaggagggaacagaagtataaaatggtgtaacaatagaatgaacactattttgtcaccagttggctatgcggatggaagaggtggggactactcactcctacaccttgagatacagcatggatgagtgtatcatttacttcaactggggatataaaaaggaggaacctaaagtttgaggtggtggttatagaagttataatgaagttaattttagatgtttaagtttgagatgcttttaggaaatttaggtgaaaatgtctgtttgttgtcttaagtgacactcctggaaactactggagatgacagggagaaattatagaaaagatacaataaatgaatgtcagcaagtgacagtatggctgtaaaggaaaccatccttaaaaaatagaatagcatagttattaggaaacagttttaacttaattatttgtagcttactttattactgttaaatatactattagagaaaaattatactcttaatacttcttattacttttaatttattattaaattcgacttataatttaagttttccataactgtgccatttaagtaaaacatactgaagtcaggctcactgttaatagtatatatttctggactcaaataataccaagtagttaaaacatttaagggccatagtaatatttagatttaagtttttaaatgcttagaaggaaaacaaaaattaacaaggctacaaacactttagacattgtaagtgacaagctttatttatacaacagcattaggatttcagaagtagcaacaactaagaataaagagtagaggaagaactggtgttaggtaggatggagaaggaagcaaatgaaaattcctttactgcatacttgaaaaggtgaaagaaatgggaaagtcaaaaatcttaaaggcagtgaagatatatagaagcaacaaagacaaaatgaactaacacaaagagaagagcagcaaagaaggagggtgtcatcagcttcttttgttgcctaggatacttgcaggttctgactgcaaaattcagtttgaggatctctcttggttaaaatgaaggaatgttaattttctaaggttgccattacaaaaaaaaaacaccacaaattggttggcttaacacagtagaaatttattttctcccagttctggaggctagaagtctgaaatcaggtgtcagcaatgtcatactccctctgagactctgggtagaattcttcctaacttctggtgatgaccgtcaatccttgatattccctggcttgctcctgcatcaatccaatcactgcctgtgtcatcccatggtgtcctccttgtctccctttctgtctgtatgtctcttcccctctttttataaagacatctatcataccgaattaggggcctaccctactacagtatgacttcatccttattagttatacttgcaatgagcctatttctaaagaagatcatactttgaggttctggcaacagacatgaattgaggaaaaggtagcaagtggtaattcaacccagtataaggcactccttaaaaaaagtataagacactccttagaaaaagaaccagtaatccttttggttattaagatgacgctttataaattccaggagccccaaaagtatggtaaccattttctcccatgattcacttgctgattctgggggctacaagagaggctcaagaatcaattcacgatgcattaaagacttaaacgttagacctaaaaccataaaaaccctagaagaaaacctaggcatcaccattcaggacataggcatgggcaaggacttcatgtccaaaacaccaaaagcaatggcaacaaaagacaaaattgacaaatgggatctaattaaactcaagagcttctgcacagcaaaagaaactaccatcaaagtgaacaggcaacctacaaaatgggagaaaatttttgcaacctattgatctgacaaagggctaatatccagaatctacaatgaactcaaacaaatttacaaggaaaaaacaaacaaccccatcaaaaagtgggtgaaggacatcaacagacacttctcaaaagaagacatttatgcagccaaaaaacacatgaaaaaatgctcatcatcactggccatcagagaaatgcaaatcaaaaccacaatgagatgccatctcacaccagttagaatggcaatcattaaaaagtcaggaaacaacaggtgctggagaggatgtggagaaacaggaacacttttacactgttggtgggactgtaaactagttcaaccattgtggaagtcagtgtggcgattcctcagggatctagaactagaaatacaatttgacccaccatcccattactgggtatatacccaaaggactataaatcttgctgctataaagacacatgcacacgtatgtttattgcggcattattcacaatagcaaagacttggaaccaatccaaatgtccaacaatgatagactggattaagaaaatgtggcacatatacaccatggaatactctgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgtggtggggtggggggaggggggagggatagcactgggagatatacctaatgctagatgacgagttagtgggtgcagtgcaccagcatggcacatgtatacatatgtaactaacctgcacaatgtgcacatgtaccctaaaacttaaagtataataaaaaaaaaaaaagattttcaagagagagattcaaatctctcattgttttgtaatatttgtaagaaaagctcacttgaggaatgtagactcctcacactttagttggccttttcctgaagatataggccaaattttctttctgaatcatagaaaaaagaaaagactacacagagaataagtcatatgtgtgacatggtaaaatggcttaacagcggtgtaattggatagtaggagtggagagagaaatgcagcagaaggaatgtttaagaggaaatttttaaactgatgcaattctttattctacaggcttaaggagctctggaaaccctaagaaagtaatatacaaaggaaataacaccaaagttcattatggtcattaaaacttaatatacataatatataatatatatattataatatataatacatatattaaaatatataatatatattaaatatatatgtaatatttttatatgtgtaatatatgtttattacatatatacatacatgtgtatgtatatattatatatgttatatataatatctatacacatatacacatatatgtatatatagtatatatatcacacacatatgtattacatatatattatatattatatatatgtaatacatatatattatacattacatattacatatatatgtaatacatatattacatattacatatacataatatattaaatattacatatattatgtattatatattatatattgcatatattatgcattatatattatatatgacatttattatgtattatatattatatattacatatatactatatataatttatatattacatatatattatatatatgtaattttaaaattcttgaaattttatttgctaattttatttgctatattgacaccggggaaacacattaagaatgatggctaacttctcaatgaaatcacaaaatctggaagaaaatgaaatgacattttttaagaaaaaaataagaatgaagcaagcaaacaaaagaaaacctgccaatatcaaatgctatactcagtgaaaatatcttttaaaaataaaaggtgaaatgaaaatgttctaagaaaaatatacactaatacaacttcctggcagtatatctgcgtatacaagaaatactaaagaaatttcctcgggctgaaagaattatagatgggagcatggaagtacaagaaggaatgaagaacaatagcctcaataaatataaaactattgatcacctatgataatcataacacagtcctgtggtatacagagtacatataaaagtaaactatatggcaattgcaaaaaaaattctgaaggggtatatagatttaaatatttgcaagcttcttgaatgtgataagaaccaacttaaaatattctatattaaactaaggactcagttggtaatttctgttgaaaactccaaataaattatacaaagagatgaaacaaaaatgttaagagaaaaggaataataaaaattattgattaatacaaaacagcagaaaagacagaggaataaatagctaaataacaaattggacaaaaagaaaacaagtagtaaatgagagatacagtaaggtaataaaaaagccaaacttctgttttgtcaattttacaatttatatagctgacaaaggactcatgtccatactatatgaggaatttttccaatagatattaaaaagataataaactcaaagaaatgttcaaaagtcttgaacagacacaaaagaggataccagctttccaaaaacatgaaaaggagcttaactttgaaatacatcatgaaaaagccaattgaaatcaccgtatgatagaactacacactcacagattgtcaaatacagaagaaaaaaccaggtattaacaagggtgtggaaaaacttaaactctcatacatgatagggaagaaatgttcaattgatattggattacataagaaactagggtcaaaagtagtgggtagtgaatatttgagtaccttttattgcacttcatagtaagacataaatctaataattattttccttgtatctttgaactatatattgactattatataatgcagatttgatggtgatttttaatctgttatatttaatttatttagcatgttggctaaactctagacaaatctgagttcaattttaagttccaatgtttaatagttatatgactggaggaacttattttgtctctctaaatcatgcttttgttatatttaaaatgaggataatattatacatctctcattaagaagaataacagaggcagtacatataaagtgtccatgccaatgtaccaaatgacatctgttgtcagacgagattccaaggggggggatggactaagtggtgctttccatgactgcagtaaagaacagattctgagcagagatcacaccaaggtgctcacatgagagatagagagctacagcagcaaggtcaagggaggattttacagaacggtttccatagaaataatattttcatggaaatcaagtaaagttttcaaggctgtatttaagcaggacttccaggaaataaagagtcagagaaacaaataactattttcaagaggaggcatttcagaccaaaaaacagtgggaaaagaagaaattaataaagaaagagggtgcaggccaactggaaaaattcccttaaatataccggttagtgttgtcactaattcctcataaagaggaactaaagatgaaatcagagctactgcttacctttcagaactccttcaatgaagctacacatagtaataattatacaaacatagaatagaccacagaaggacatatgatccccaaatctcaagagagaaaagaaatctgttgtcttcagaaactagatagaactgttaaaatatgacattagctacaaatttgaaattgtgagccataagtgacagtgctattgtttctcacgtattttgccataaaaaatgaaagcaaaggaaatgcgtaagcatttgaggatttggtcagagttacaaggatctgaagtgggagagaagcaaacatactctcacactatgttgcaatgatttctggatttcattgatgggtgtattatcccacactccagcattcctcccttccccttctacccaaataggaactgatatgagattgctgggttcttgttttatgaagcaattacatttaaaaacaatcacaaaccaccattgactatctccatcatttcccaaaagaacaaactgataccagaaacacaggatgaacatgacctcagagggggaaatctttatgaatagctcactaaattgtttctgtttttatcattttattgctggtatgtgacaacctctttgtggactagaattgggtaatggaccaggatttcaagcccactgccccactgaattctggtgttccagcaccatgggtaaaggcatctataccaccaactaacaaaaacttatcagagcaagtatttactctagtaagattttagataatttattactatttatatcattcaaaaatttgaacaatgtttcatgttcaatttgcattttcctgcaatgcaaatgcatatgggtttcttataacacaatgtaggataagtcagttccaaaaaaaaatcctttgtcaatttttacaaactttaacctttgcaggcacagatatttgatagacagatgatatagatagataaagtatatgctggctctacctggttattagaatcaagattctttttggacatgttacaaataatattaacccaagctcttattttaaacacttagttatcatatcacttataattttcaattgcaatttttgttggcattactatctcccttccaagatagtaaacctttgagggcaggaactagctttctccatcttggtatccttacaactaaagcaaaatttggtacattcttagcatcttataagtatttgttgaatgcttgaatgaatggctctacataggttacgtttcctgaaacatcacaattttatatagcaaatccctggtactattttatggtttattgatggaagtagcaactcgatctgtccttcaacactcatgtattcattctttgtacatatatgaaaccgttactatgtgcttccactgtgctaactactctggataatagaaatgagcagaatgcagtcactgcattcaaggatgtcagaaatagttccattctggagctcatgtgatgtttttagcacaatgccttatggaaatacattcaattttttgaatgatacaaatagaaatgatctaatcacataaaatatcactaaatacttgctctgatatgtttttcctaatgagactaaaacctgtttatcaccataagtggcaatatccactctacttatgtaagagtcctcccttgtaacatattacagccactatccccatgacatggtttacttaaattggaaccttagccttatgcattttaaatgaaataataaatctgcttactattgcaagtcttgttgtatttgctgttctcctgtggaaacccttccagtcggcactgaaaacgatgctgccaaaattcttgaaaccaagggtttcggtggtttgtttctggccggagcttcagataataatcatcaaaccacttgacatcgggagattggagcttgattgtgatgccaccaacagcttctcgctgatatccatctgtcacatcatacctgtcagcccagccatcactgtggggaaataaaaaaaccctcagcttagaacagatatctcctaagcaaatgagtccatttgctttccttttgacaagattagtcattaaatggctacctcaggccccatgatggtcctatattacaccgacatgattattgatatagaagcttgttagaataaaaagtgcaataacaccatggaaattttgggcctaagagtgctaaaaggcactaacctcacttaccttaaactgcagaaaataacctggagattctggcacaattttactggctgcaaaatatagtatatacatggaagctgcataatatcatcattcacatttttaatggacatttaatagccaggtaaagttaactttaaatacattattttctttggctttataataataattataatgatcataaaataagaattaaaaatattctccaacatacctaatattaatttaatcatcctgtgacacaacatttttgatcaaattttacaaatgaataataggtttaaaaaaccgtttgccgattatggttactctattcaatgttgatttcccaagcctcgaactgaaatctttgtagtccatagtccatacactattttctatcccatggaatctctaaaatacattaaaaatgtacatctgaaatcacattttatattagagtgcccaaaagaacttctgaacaatgtgccatcaaaagtggtgaagggatcatactcctcaacataactatcattctatgcactgctcactcaaagttatttaggaattttaagataaaagtttttgaaatcagagggctcataatataatgctagaggagagtataacagaataagaaaaagtaaagtcttctacaatgatttggaaaatacatgaaacattgtattggaaataaaaataaaaggcatgaaaagatgtttgtatacaatttgggtacaccctagggcatctaaggaagaaggaaagtgacttgtccctcttcactgccattggtatatacacagtttgtgctgtatatctgctggaacccagtggtactgtctttccctggaagaagtgcaagtgcttgtaaaggaagtatggggaaagggaaaatttgactaaattacaagtaacctcaaagagagaagagaaggaatatagagagatttaaggggaagaacagactagagcctcctaaatgcaaagcaggaaaaagtgttaggaggtgagctgggagtaggggcagtgggtagtggggagaggacgtgggaagagatttacactaccaatcactgcttacctcggtgatattcaaatatttccatttaacagaatgttaatttatttttactttcctttcaatgcatttttgcccttaacatttttttttctatgcagaaagcatggtccaatattttgcataaaaaatcagtgccgagaaagtattatgtaagtaattaatttaaattatacagaaagcatgcacttttttcagtatgcagtgctgtgccaactttgatataaatattgataattgggagttattccaaatgtcatatattacttattaagatatcataagggcttgagatgacttgagatattagctagggcatcagtgggtggagagaagggaaaaaataaacagaaagaacactgtttttctctaagtcctccatgacaaaaagatattaaaaattacctatagtgaaatttcaaaaacttttgtggcagatcaagacaaaaatatagtaatgtagtatgttttgtcccaatgttgaatttggttacttcacacattatcttccctcaagtttcccattttcagctccagaagattttatttaaagctgacaagttgaaatgaagtgggcttgtttgcctcattttctcctctgttttggagggtttattatatcactgagatgagagtgtgggtctcattggcactcgaggagcagcatgggcgtgttgcaaatgggacaggaagctctgtttgttcaagcagagacccattctccaaggaagtgggaatttaaattgctccttttgttaacattagctcgctcttatgtaacactatgattatgaatattacataagaaatgtaagattataatggctccaatttacccttcacagttcattcattgaatttaacagggattgtaaaaagtttgtcttgataaacttttttgcaggtgatatttccataaaagaaaactgtcaggatgagagtgataatttactgatctctcatcatgtactttctctgttttttttttttttgaggtatatatcttttctgtaagtttaataacttagaaaactatgatgttttattattagccttataagttagagttgtgagtttaaaataatttttgtttcagatgtttccaattaacagcacaatataaatcataaaggagatagtgtgtaaacagaaaatcccaatatctatgtgacaaaacagggtcattctatttaaatttttggataatatctgctatgttaatcccaaaaaagacaacactggctaaattagagggtgctgtattgactttagcttattaaacattaacatttttatataaatatgcttttaagatttgcattaagatgatagggcatctttaagtatgatgcaataaattcagcagtaaaatgaaatgctaagaaaaaacctttctgccacctaatgctttctattactttgatagagtggaccttcaatttaattttttgggtgacacgtattttaccaaagcaagagaaaacaaacggataaagatggggaaggaaactaacatttgctaaaagtctaccacatttaaggcactttactagatttattatttatccatccatccaatttctccctcttctcactggtgggcattttgcccaactcctcataatccattttattcttttccgttgtttggatttacagttgatcatcattatttacagattctgcatttacaaatttagctacttgctgaagtttatttgcaataccagaatcaatattggtggcatttttgcagtcattcatgggcatgcagagagtggtacacatttgagactactgaagttcatgtccccatctgaggttgaaaaaggtgactctgctttcttgtttcagttttcatactacaaacttacagtatctatttagcgccatcttttgcatgttcgtgttttttattggtgatttcagtgtttaacttggcctccaagaataaagctgatgtgttatctagtgtttctaagcacaagatggctgtaatatacatagaaaatacagtcagcccttcataactgtgggttccatattcacagatttcatcaataattaattgaaaatatttggaaaaataataatacaaataaaaaacaagacagtataatgactatttatataacatgtatgttatattagggataataatctagagatggtttaaagtataatggaggatgtgtacaggttacatgtgaaaactaagctacctggtataagagacctgagcatctttagattttggtattggtgggatgagaggaggaagtgtcctggagccaatgctctgcaaatatcaagggactagggataactgtatatagacaatacatatgttaaataagttgcatgaataaagtgctgttgctgcaagttcaatgttagtgagtcaacaatttatattaactaagatgtctttaaacaagaacacacataaaacaaggttatgttttgactagttgatgaacacgttgtgactaaaggctcacagcaacctaagcttgtatttcctccaggagtaatggtcattattcactaatttactgtttgctgcatgtttatagaacattactgtgaatgataagaattggctgtaattacatatagtcttaatctggatgttgttttagtcaggtttgtagcctttctttggctgtggaatcagagtaacttggacatttaaaatagaaaaatcattcttaacttacttagcttggcttaactaaaggaggattctttatacatatgtactggattctcaaaacacctcactagcagatacttagatcctttaaatattccctgcagacatcttaaggacatgctaatctacagagaatttactttcactttcttcccaagattgcattaccaaaaatatactctctttctctacaatctactcttcccctttctcctttcaactctaattcctatgatttctcataaagagaaactcatgaaagcttaatttttctttcttttcaacagacagttcttgtttaaaacaaaattgactcttgaattaccctgctattttttttcctaggtctctataaccttccttcttttcttcaacatttattaaatatctacccatcttagactaaattattttgtcacaatcaatagtcccagtatctcactggtatagaacagaagtttatttcagcctttatattcactgcagatggcctataactctgttctatgtcatcttcattttgagtttgaagtctaaaagaatagtctgtttctgggacataccaatcttgtagagcaggagtccccaaaccccaggtttcagaccagtacctgtccgtgtcctgttcggaacctggctgcacagcaggaggtgagccctgggtgagtgagcattacctcctgagctctgtcacctgttagatctaatgcagaggcattagattctcataggatggtgaatcctatcgtgaactgtacacgtgagggagctaggtcgtgcgcttcttatgagatggaacagtttcatccatgaaaccagtccctggtgccaaaaacgttggggaccgctgttgtagaaggaaaaacagatgataggggaatcatacaatggttcttaagattctgcttaaaagtggcacatgttatttctgctcacgtttcactgactgaacaaatcacatggctaaacctgacctgaatgggacaggcatccatggtttttcccacggagaggagcagtgtatattttgaagaaaatgcaattgacagcatcactgtgtgttgaaattgtattgaaactgagaaaaaacatgagttaaatagggtttagagactctgctccagcagttcacaagtctagtggagggatgagaaaggaggacagatataaataagtaaccacatacaaatgattattatgggcatgtcctaaatgcagtgggagagcagatcaataaataattgaccaacacttcttagggagataagagttgaactaagtttgaaaagtatggataatagagtgataccagcattttgaaatattgttttctatatattgaaaaaaattgttaatcaaggaatagtgaatatggagcattgcagctatgtagggtgcacaggtcagagaagtaatgagagggtgagctgaagagaatcagttgtgagtgttcttttgtgccatcctaaagatttccaactttgtcatacaggtagtggggaaccagtgatggcttttaaagtgggaaatgatacaaagacatgatgagaagtagaggaactctgctaaaagcttacatgacagattagagctgtcggagatgaaggttagggaatcaagttagaaaatatgttgcaatggtcaaggaaaccaatggagaattgaattaagggagtggcagtaagaatgaagagccatatttataaggaatcttaatgtagaacctccaaacttgtggggcatagaaggtaaaggagcatttttaatgattcgtgggaggagaataacaacattgcatgtagctccatgtcctaggctggacagtattggaaaagaacaggttttttgtgaaaaaggaagaaaatgaatatgagttgggatctgtgatgttcagatttatctttatacgatctctcacatttctttttctcctggatttctacatattctctccatatgcaactggcttgaatgttaaaaatgcaagttaacaatgttcgtacctgtggttccagtatgatattaacctactctgttgtattattgtatgtatgtttttgtttgctgtgcaatagctgttggcattcaaaaatatgagagaaaaatggtaattatacatctgtaaagatttataccttacaccattgtatgcttatactaaaagtattttaactttataattatttctatcattcattatattaaatttatgaaatataaagcagaccaatagttatagttataaaataattatgataggacttaacaaccaataggcagaatatcacaatctatttttgctagaatgtgaaacctcctgagtgctatatgctaacaggaatatataaaaataaatcttagacaattacgaagataaaagtctaaggattatggaatgttagggcagcgatgccaaataatttaaaaatctatctcccttaatgaaatctaaatccataaaatgcagacaatataattttttctttcttcatttcctatccatatatgttataagttattgctatggaaaacagaaaaatacatgtagccctgaaaattgcattgagtgatcctttagtaacagtctcaatgttttattcatttcaatttattaattcactaaacatttgaatgcctcctctgtgccagacactggtaggttccaggccatgccctcaaggagtcaacagtccattaggcatgacctgcctgaatgggcattgccagcttccagtccattgggtttttctcacttatccttcaaattaaacattccctttcctttttactcaatctttccataaacagtagaaatcattagatttccagtcactgaattatcatttactgaaaatcacattcctttcttgcctccctaagattattctctgatcacctcaattagtattctggatatttccaagttcttaattcttacatttataatctcttgatttatttatatggaagactaattatatacaatgggcatggattttcactagttgaactctcaaatggcaacatggttatttattaatactacaactccatggagattttaggaaggcatcccatggtgctacctgccataggcaaacaacataagtacattctgtacccaaaggagcaataccaatctaaaaatgttggaatctgaatgaatattcctagaagttagtggtcattaaacttgtgtcaggaaatataactatgtgtggggcatgctagggccacacagttattcttgcccactgaaatcattagttatgcttatcatgatgaaactggtactgctgagacgaacctcacacatcctgttgatcggagacatagaacattgattcttattccttagatatgttaatagtttcacactcctaagcctttgggtgtgctattccctctgcacagagtgccattcttttaacttctcacatgttttctgatttgataaaatgtaattcatcaagcagacagatttagcttgaatgcaacttatcaaaaagctcctctgggcttaatggttccttctgctctgcttctaaaatacagtgacattcattgctttattcactgaacaagtattgtgtaactaatattctaaatatgtggatatagtggtgaacaaggaaggcaagatttctgctctcatagaggtaacatgatgcttttagttttgcaattgtcattgtattaaagatagctacatttatttttgcttccccaaagtagactacaaattttatactttgcacatctttgtatccttaatgcttgttataatgctcagtacataccaaatactcaagaaatgtttaatgtaacttgtttaaaaattaggttttaaaaggaaaacttcaaataacacagatttcttttcagataactacatctactcatttgttaattgagaaaataacactgtcaaatgtgccttataaatgactctgaaaggctgagttgattcccccgtgcagaatggtcctcttgttatctacctgatgttattaaggttaatgaatgtattcattaggctgcatctcagtattttttttttcaaaatctgtttgcaacccacataattattatggaaactgctgttctacccacatgtaatcatcatcctgccaaatctcttactaatagattttaacagatattttgggattttaaaaaattctaatagtgggagtctacggactacttggctgttttcacataatattgctccgtgcaccccaggaggagtaggaagtctcaaatctctacacactagtgaaaagcaaggaaaaatattgagactctattttattttattttatttattttttagatacagtctcagtatgttgcccaggatggattcaaactcctgggctcagcctctggagtagctaggactacaggcctttgcaactgtgcctggctttgaaattttaaattaaggttcttatgaatataccccagccaacactaatgaattaattccaaaaagaatcaaaatttagaattgttcagaaaaagataatgttatcaactgaaaatcaacttatttctgaggtgtataaatctcaatatttctcatttcaaaggattcataaaaagtaagtagaggtagattggaggagtgatatcagaacattcaaaagaagggaaaaagtcaggaacttgaaatttgccacctgtatatcataagataatttccactgtatgactttttctaaagttctgcaggccttagagataattattagccctagtttttacatctgaggaaactggaggattaactagccttataactgaggaaatctgagggattaaataacctactcaaaaccccatgacaaatgtagaggggatataaactcagatcttgctaattctaaaactccagcacatttcatacttcataaacctgctaagtaatgacatacagtaatgacagcagagaactgtgtcttgatgaattttatttaagagacatgtattggaaaacagggatcagattgtatattgaaaatgtgtaggtaagattctaaaatggcatccaagatctctgatctttggggtatacacacctctcttagttattcaatcaaacactcatctagataagtgcttctctggaaggattttaaagatgtattttaggttccaaacaagctgactttaaaatagggatactaccctctataaatctgatctaactaggtgagtcctaaaagggactggtgatttctgatttaaaaaaaagattcaaatgagggggacttgacatgagagagctagaggagaatctccgttgttggctttcctgatggagggagctacagggaaaggaatgcaggtggtctctcagaaatgagtatggcctccagcaaacaaccagcaccagaatggagactcaagcctacacccacagaccaccaaattcagccaaaaacttgaatatatttggaagcagattcttccagaaagcctccaaaaagaaatgcagttcgccaataccctgactacagcctgtctgaccctgagcagagaacccagttgccatacccagactcctgacatccagaaagtatgaaataatacacgcatttttctttaagcttctaattttgttataatttgttacacagcaatatgaagttaatactcacttcccaactctattctgcatttcttcacttggaaggccaatgcctgttaatatttgaagagataaaatcttaggcggtctgacctaattctgggtgtggtcagtatagactgacttacaaagacgtggggattacaggaaataacagatagtaagaaaaacctattagaatagttggaatatccatcctgtcttgattttggtcctaggatggcaggcattatctcctctggtttaatgtcttgtggctccagggatgcttccacgtcatatgcatgctttaaataggagaggctgataaatatctttataaatagattgattacattgtgtgttacccaatcttttgtttctctcatcatattatagccatttggagaaatgcaaaaattgaggctattgtataaaatgtgcaacaatttagtaagcaaaatgatccatttcaacagagaaaacactttgaatgagctattgtatccatagctttatataaccttgtctgttttttcatgaagtttcctttcttaggatgatcttccagttttcatgctataatcccttcttccactgaattggactaattccttctgttaagcttgtaaatttttatcagtgggactagtgcttagagtttcctgttacatgactgtgctgggataacaccttttcaaaaatatttctcctcttcttaattgcctcttttatgaaggccaaacagcctctgagagcacaatcaaggtgattgcacggtgctaagtgcaatattaaatcagtaatttttttattgaacacctaagcaataagacaggcttcaagaggatatcaatgaatataaacctcacctcccagtttgttttatttctttttatatcataacaggtcactagggacttcataatttcaaatctatattttcctcatactttcctcaaacttcctgcattatttaacattactgattcatttagtaaaatctaacaagtaacattgtacttgctaagttctctgcagagtgctgcatatgaggaataaagagaagaaaaattatcattcccttcaaccttagagtcaggtaaatgaaaaaaattacttgaatgataactatgataatgtatgtagtgtttttttcctaccaaacattgtcctaagcaatatatgcttatgcctatattctgctaaatattatatatacagttggccctccatatccctgggttctacatgtgtggaatcaatcaacccagatttaaaaaaaactggaaaaaaaatggatggttgtgtctgtactgaacatgtacagactttttttcccttgtcattattccctaaacaatagagtatggcaactattcacatagcattttcttttcttttttcttttttttaaagatagaatcttaaaaatcttgctgcccaggctggaatgcaatggcatgatcttggctcactgcaacttccgcctcctgggttcaagcaattctcctgcctcagcctcctcagtagcagggactacgggtgtgcaccaccatgcccggctaatttttgtatttttagttgtgacggggtttcaccatgttggccaggctggtctcgaactcctgacctcaggtgatccacctgcctcggcctcccaaagtgctgggattacaggtgtgagccacagtgcccagcctcacatagcattttcattgtattaggtattataagtaatttagggattatttaaagtatataagaatatgtatatactatatgataatgatttgagctattataaaagtgacttgagcaaccacgaattttagaatccactgagggtcttagaatcaatcccccacagatactaaggaaagactatatgtatgaaactgaagtacataattttacatgttcacattccacatgaggcaactgtagcttgcaaagcaagcaaattgcccagggttgcacaatatttaaacccactctatctaaatctagacattaaaactgaactagaacaatgtattaaatgtgatctttaatacaaatctgtgtccaaaggtatatacataaaaatgtagatagaagagataatttaatttatttacacacacacacacacacacacacacacatccctcttggaatttctttcttttttttccttctacctgaatcgtcaaatagagaactgccttaaaccattaaattaatattctgataaaatgtctatttctgtattgttcagtaccctgtcattgttagtaagagtctctctaataacatggaaaagaccaattagaagatgcttaagagaccttgatttctgtacataaacacagaatgggctcatttccattcacatttcactttgaggcaacatgtttttcctggacaaaatatccccacgacactcagaaacctattgtgaacttctcacatttatttaatatagtttccaaataaaacgtataggtatagaggaagagtaaataatcaaaaattacactgggattcagattaagttttagaaataatcattgtacaagaagtgacacaaaattcaaaacctaagttcctgaaaaatttaggtatcatatgctcaataactaatccaagtagacttaaattttaagtcacataatagaaactgaacagctacttccacattttcctgtgatagattaggcaagccctcctctgaagacaactagaaaggctgaatattttttttttaatttgtttaagttgtcagaaagctatctagtcagccagtactgagggggccatgatccaggagaaaaaaaaaaatggactgaagaaagactttccctttgaagtatgtgacaattcattgaagttgaactcattgataagaagctaagaagttgggacagaagcaccaggtgagctttgaacatttttgagttctgggctagtattacatttaaaatcttatcagtgaatatctgggagggaaaagaagcacagatatctgaagcagatattatttcctcccttgaattctttgctaatttgtaggcatttactgaaaatgtcagaagtggctaagagattggacagatgagaagagctttaggcagtcatactgaattgaagaaaaaaagaattgtaattgttcattagtctatttcctgttgtttataagagaatgcccacaactgggtaatttataaagaaaacaggtttattctattttttattcggcaggctaagaagttcaagggcatgcctctagcttctggtgagggcttttgtgctgtatcacaacaaggtggaaaaggaagtggacacatgcaaagaggggaaacttgagaggtgttctgactttataatcactcactcttccaggaactaatccattcccatgagaatcaatcgagtctctcaagagtgagaactcactcaggaggagagaggagcaacaagccattgatgagggatctgccctcataacccaaacatctcccactaggccccacctaacaacatcacaggggggatcaaattccagcctgagttttattgagaacaaacaaaccattgcagatagtaaccactttgagtttttatttgggatcattacaggctatattttagttgtaaagacaaactggaaagtgataggctccaacaaaaatggaaactgcttcagatcctctcactatcaagctagcttaaaatggtcttcctctcttttaactgctataaacaagcaacagcaaattctctctggatgaacatacaaccagatgtagccttagattacctctacaatttttatacatgttgtctatcatttcagtagtaaatggacagacatataaagcattaaagaaaaagaatgaaatgattgaaaaccaggaaaaacagtcaatgaaatcaaccccatcccaatcattagaatcaatagagtgaatttaaatacaaatatgaataatatattcaagagaatagatgaaaagtcagagaagtaagttgaaagcagtaatttttttaaaaaagagaaatttaagaaactaaacatttaaaaatttaagaactcaatggatgtgtcaccttcagcagaataaacacaaccaaaaatgaagtttagaaaacttagaggaatagaatatatccagactgaaacatggaaaaacacaatttttgaatatagaaaagtataaaatatgatgaaaacatctaagtcagataattagttttccagggggagaagaaaaaagagaatagagtagaaatcatatttgaagagataatgatggagtatttccaaaaccaaatgtgcaaccagcatgaaacctaccaaaacacagattaataagtatgatgaatccaagcaaaatgaatatgaagtaattcacactcaggtttatcatagtaaagctgctaaaaatgaaaggcaaagttattgaaagtaaaatgcaggaagtgagaaaaagaagcacattaaaccctccaaaactagaggtcatagaaaaataaaaatttatggagaattgcttaaaaaaagtatagtagaaagaaaaagttaggccaggcgcagtggctcacgcctgtaatcccagcactttgggaggccaatgcaggcagatcacaaggtcaggagttcaagaccaccctggccaatatggtgaaacaccgtctctacttaaaaaacacaaaattagctgtatgtggtggcaggcgcctgtagtcccagctacttgggaggctaagacaggaaaatcgcttgaacctggtaggcggatgctgcagtgagccgagattgagctactgcactccagcatgggcgacagagggagactctatcaaaaaagaaaaaaaaaagaaaaaaaatgttaaagtcaaaattgattctttgaaaagactaataaaactgatgaacatttatgaacacttggcaacaatgaaagaaatgagaaatgcacaagttatacactaaaaagtaattgtaaaagggcagccaaaaagaatattgtgaaatatgttatggaaataaatttgaaaatttagataaaatagaaaaatccctacataagtattaaattatgaaacagaaacaaacataaaacagaataattttatatctcttaaatcagtggaagtttatttaaaacatctgcagaaactcgcacacacacacacacacacaaagacagaataattttatatctcttaaatcagtggaagtttatttaaaacatccccagaaactcgcacacacacacacacacacacacacacacacacacacacacacagagtctggcccaccaacttcactaacaaattattctatacctttagacgagaaataacaccaatactcaacaattttttttcaaaaaaaagcaaagaggaaaacttcattttataagtccagaaaaacagtaatatctaaatattaaagtgatttcaaaataaagacaaaatgtaggccaaactcttataaatatcaatgaaaaatctcaaataacatattaggaaactgtccagcaatgtatagaaatgccaatactcattcaaatttggtataccccaggaatgaaaaattattattgttattattgtggtaaaaacaggtaacaagaggtctgtcttaacaaatttttcactgtacagtacaatattgttaactataagcacaatattgcacagcagatcattagaacttattcgtcttgcagaactgaaactttgtatttcttgaatagcagctccccatttccttcatccccccaacccctggcaaccacaattcagtttatgcttttatcaagttgactgttttagtcatctaagttgaatcatgaagtatttgttttcctgtgattggcagacattatgttatttcacttagcataatgttctcacagtttatccatagcaaagtggtgcaaccactatggaaaacagtatgtagcttcctcaaaatattaaaaattgaattgccatatgatccaataatcctatttctgggtatttattttgaagagatatatacaccctcatgttcattgcagcattgttcacaacaatcaagatgtagatacaccctaaatgttcactagtggatgaatggataaagaaaatgtggtatatacatatataattattttaattttcgaaagctggtcagcttaatttaccacattaacaacataatgccgtcaataaattaaagaaaacgtgacaaattcaacatcattctgataaaatgaccttggcaacctagctaaaaaagataacttccttaatctatgccagagtctttacagtgaagataacacaacagtaaaatgttgaaatatttcttcctgatatccagcataagtaaaagatgtcttcactcactactttttcccaatattttattgaaggttctagcaagtttaataaggaaagaaaagaaataaaaaggagtaaactgtcattagccaagaataatgcaattatttacctagaagatctgaaataatctatagatatactacagatacactattacaaataacaaaggaatttagaaaattggtgcatactagtttggcatacataaatacatttaatttctatatatccaaaacaaatacaaattaaaaatttaaatatattacttaaaaaccacttaatacaaagaaataagcctaaataatatgtgcaagatctattcatgcatgcaagataaattatgggagattttacttgataaagagttatactgtattcataaattggatgaatgaataatgtacagttaattctcttaaagtcgattacagatggattgtaatctcaatcaatattccagtgggttttccttggtggggtttaggtggagacgatatttacaagtaggttctaaaatttatagggaaatgtaaaagttcaaaaatagccatgataaccttaataaagaacaaagtttatttgaaaaatgtagtattagatattaaggttttagaaaattagacataatttgttgaaattatgggaccaatagaacagagtcccacatgcatacagagacttaatttctaacaaaggcaacactgcaaagaagtaggaaaaaatgttctaataaaaaagattctaggtgaatcatatgtctttatgaaaaaagagtcttgatacttaatccacactgtttacaaaaatcaaaattcaagatagattgtagacctaaataggaatgataaaataataaatcttcttgataataataaaaggagatattttcaccatagaataggaaagagttttcaaaaagggcatagacagaactattaaagtcaaaattgttaaaagtatctataatataactaatagcttattttcatcgaaagacaccactaattgaataaaaatgtaggccacaaattaggagaagatcttgtagtgtgtgtgtatgtgtgtgtgtgtgttgtgtatacagatgacagataccaaaatgatagctagataggcaaaaagtctgaaaacgactcatatttaaagtatatgaataatttctataatttaatataaaaatagaaaatcctatagaaaagtaagtggtcaggaagcttgaacacttcacacctcacaaaatatgatttgaaatgaccagtgaatgtttttaaagtggttaactttaatcattaggagaatacaagctaaaaccactacgaatagcactactcacagaccaaaatggcaaaaagttaaaaacgatcgacatagttcagtataaaatggaaagcaactgcaattctcaatcattgattttaagagcataggttggtacaactgcattggaaaactatttggcaatatctcctacaactgaatataagcatacaatataacccagcaattctggccctaagtatgtttctaacagaaatgctattaaatacacaccaaaatgcatacagaagaatgttcactgacagagcaggagcatcgccatcttggacaagcccctcattctaaagttcaccttaataaaaaaccatctaaatccaaagagcatcagcttagtgggtaaggtcagcacgaccataaaccaaaaataacatctccaacaacaagaaacattccaaaatcctccccaagcagagacatgctagaccctagataaccccagtccaggccagaaagatgtctgccccaagataacctccccttctcccagacagattccaactctgccataaacttctccacatacacaaatattccaagcttataataagtttgcttaccctaaaaccaatatatactcttagtctgtaagagaaagtgctcctgaccaggatcgtccaagagcacctctcaggttttgtctaaagtaaacctgtctttaactgccagctgcatttagtgtttgtttcctcttttttcaactcttacattcacagtagcactatttgaaatagtctcattttaataacaaccaaaatgttcatcaccagtagaaaggataatgaattgcagtttatttatataatacagtagtagacagcaatgaaaatgaacaaactaccgttacatgaaggaaaatgaataatataataaacataataccaagttaaagaaaatatacggaaaggagaagattatacatattccacttacataaaattttgaagaaggcaataacccagaatattggaagttaaaacattggttccttttgaagagtgtgttagacttggaatgagcaagctggaacgttgggaccttgctcactggagcactggtaaagttttatttctggatctgattggtgtttaaatgggcttgttaatttcatgcaaattcaatgtactacacatcatggtttctgtgctcttttggttgtacattataatgcgttaaaatatttttatttaaacagaaaacttaaaatttaatttctgattagtcaagaaatttataatgctgacttgtaaaatttcagcagcaaattctgcttaaaggagattcatcattaattcatttcattcttaggagtcttcaaatgctcaggcatctttaagactgtcttggagtccttggccatcactttttcaaaaatccagtgatataatgataaaaccgattatagctaacattaagttatattatccatatttaggcttaaaaattgaaatttgtaattcttagaaaatccttttggaatctgaaaatagtggaccaaattcagtacagtccaagtacatcaacatttattaagtatctactatgttccaagcctaagtcaaatttgatgacaaacatattatatctgtcctaaatcaagcttatactctggtggaagacttgaagaaagaaagacttgaagaaggaaagactacagaaaagtataatttaaatacaattgaataatatgtataacaaagacctatacaaaatgagacacgagaaattgggcccatgtcttgaagaaaagttattttattttttataagttgatatctggtctcaaatctaaagtgtcaaagagctgacaattggtgaaatgtacaaaagtaaggataattttgagaaaactctcttgctgaatacagcagaaatatttttactcaaatgtgataggagcaaacactatggtccaggaaacaaatgttcaaagtaaaatataaaattctaggccatatttatataatacataataattacagcaataatgttataaaaagacattgctaataactggaaaaactgaaaggtactaaaaagtaaaatggacatgattgagacagaataaatcaatcagcaaatacatattaagtgcctgttgtatgtgaagcagtttattatatgctgagggtacagtggtaatcaagacagagaagttactgtatcgagtcttgaagtttttgcaaaattgtcagatataaaaatggagatggcatttgcagcactgcaaatatcatgaacaaaggcaaagaggcatgaatccacatttttttatgtaaggaaaattccagccacttaattttcacagaaatttaaaatgtgaacatgacacagtctaatttatactattttatagatgactcttatttgcgaatggatttaaacgttttccattttcaagtacttattaggaggccatttccataagtcaggtgagaagtgatgatttgaaacaaggaagtgattataggatggaaaataaggaactgaagtaagaaatactgtgtttatgaggacaaagaggcagggttttgtgactaatattctatggagtatgaggaaggaaaacaaatctagaatgacaccgaattttctgatttgagtgattagtaacatttactaaagagaaatacgtttcttggggaagtttagttttaaacatgttaactttgaaacgcttgtgaaacaatcaagtgaatgtcacaaatgcagttacacatataatctgaaatgtagagaagtctggcctgagatatttaattcagatattatcaataaatctatatttggtagaactggtaaagggaatgtgatcacccaatgaggatgctgcatgttatgagcaattgagaaattcatttattataattttttagtctgacaaaatttcttttctagtttgtattgcccccaaatggtttaactgtactggctgttcatacttgaatgtccagttagagcataagtcatatctcagacagaaagagataaaaatctgtttagggagatgtattgagtagaaaacatgaacccaggctacaagagaagcgtagagaaacaggcagtgccaaatggttcatagttcagtatctgtaatttcagatcaggggatgtgacactattttgaaaaaaaaaaaacaaacatactctagagtataattaccaagcatttctgttgtaggttgtgtttggaacaagcagatgtgagggtgaagcttagacctatatagagagaagcactgagaggattcaaacaagtacgagggaagaatcaacacatctcatttgtatgctggatctaagaaatgtcagtgtcagagtaaagtgaagaatcattcagggttgtatttaggtgtgagagggagtgttgggagtcactgacctttgctgcatttgagatggttgactactttctcctggaaaatctcatcccatggcttctatagtaacaaattctcctaacactcctcttgccaccctgttttcttcctctctatcctctaggtgagtctctcatcctacaggccgagtttagatatttcctagagatttgtctttgaaatttttctattgcacttttgtatagtttcccttttggattttatcctatgactccaattaccatttatatctaattacttctacatatctatctttagccttgttattcttcctgtgctctagattaaaatattcaacacctactagacagcttgctccagaggaacctccaataaaactggcctaaaatatcagtactgttcatttcaccagtagaaattattgccctttctgccatatatctctaaaggaatgctaccattgttcctctaattgttcaaacaaggattataggtttggggcagtgtcactctttctcaccaggaatctgctccttccagagacaaagtcatgatgattccattgactcagtgtcttgggaagctatttttttcccttgactgtctcagtgatggctttattttgaaccttattatctctcacttgaattaggtgctactgttctccctttgctgttatgagtgagatttctaaaacacaaatgtaataatattacatctctgcttaaacatttaaatttggctctctttgtctttaaataaagtccaaactccttgaggaggcacgtaagatcctttatcctgtaatttctcagtagtctttcttttcattccccttttctttctgtatgccacattactgtaggtgcctgcaagatatcacattttttattaatcatccctactatggtaccaatgttcacttcatgttcacttagtccagtgctttttgttttcattttcctatattctggctgtttttctaaccccatttcagatgccttttattctaagtcttctgtgatcctacatgtgggaaagagcagttttgtactttaaacactgtgtgcttaattctgccttagcgtgaatgacattgtaattttaattgttatgtgcttctctttttcaagacactatttcattccattgtcctagcacttcactggattcattgcttgtcaataaagaaggtgtctttaatattgagtaaatggacggagtgaggcaattgttagagaagaaagactattataagaagaaagagaaagatatgtcggcaatttaaatgagtaaggatctttggaggttatgctgaggtttaggctcaaggaagatatgagcctgtctgcaagaaaattagagtatttatgtcttcaagaaaattagagtattttggttaacaaaattttgatatagaaaacaacttagaacaacccgaagctatatataagcaaatggcagttattataatgtacgcattcagaggagttgaactgtaaggttatttacaggaataaaagtagtgagagtaagctttaaagaaaagacaagacttaaactgagttttctccccagttagttactctgtttggacttccgtcacgtcatcctaacccaaaaccttggactcgttgtcccatgtttctcacagagtcaaagacgtgtaataggcattctgtaaatgtttgtataatcagcaacaagcaagaattgggagtccaatgtggccatgtagaaagttaaacacaggattgaatatggaagtacagaaataacagatggccatattgagagtctaagcattctcacacgtaagagaatcatagtatttgtagagtgataaacatccaatgctgggaactgcagctctggttccatgaactcttggataaaaaccctaaggctagttataataaagaactcagcaagggggatcattaggaaagtcaaagtattttatcctttagggaagttaccatcattctataaagataatttaatgtcttgcattttattataacactctcaaacaattcagtttataattcagtgttttattcccctgcttgattgattttttaaccatgattgattggagccccactctcagcacttccagagaaactgagtgagttgtaaagttcttcaaaggacattatttattcagtttcacatgcattatttgtaaaggtaacaaatatttattaggcacctattatatgcctatgctatcatttgagatacaatgacaagctgttctttattcacctctacctccaccaccaccccatacacacttgaagttccttgggggcaggaattgtatattgaatatatttatattccagtgcttggcaaatagtaaacattgaataattatttattaaattaatgaatgacaatttaaacattataaatacaatgatttaaatatgcacaagatgctatagaaactataaaatgaagaataattacttactgcctagcacaatatatttcagagagattttcaattgtgttgataaattttggaatgaataagtgtatgagacaccatgaatccctcaattcaaatactccattgttttctagatgctatataatgaaaatacttttaaagtgaaaattatagtcttgataagttaatgcatcttcaaaacttgaagttaattcatttaagtaacacatttttatgtagcacttactgcgtgcaaggcattgcatttaatgcttgtgctcaaatggggacaagaaaaagtcattttgttgaaataactcggtaattcatctgaatttgtagaacagctaattatatgagaaataaaaatataatctcttctgattacctaagtgcttgaaaaagtacttgaaaactgtggaagtatggttagagtaataggatgaaaggttgtatggtaaattaattaagaactctacacttctttgatgggccacctataatttcatatttgtatttatgttaatgtccagtaaagttaattttactatattcatttatgtgactagaagatatatatacaacatgtaataacttttattcagttgtacatttacagcattatctagaagccctgacttttaatataatgggtaatgtttttcttccaatattcactcctgtcctctcctgtagtaaattcatattttaactctagagggtccagacttgtctctgtcaaccagagtaattcttctctttgctttagttattagtttaggtaaccttagtcaagctgtttagcacttagatttctcttagcctactcagaacatttcctgggaattgtgggacacagatattctctttctctcactggacaatagcatatgaggttgtaaggctggtgattgctacagtgattcttctacaagagaaattagcccaagaatgaagttgaaacatggagaattacaaagaaatggagccagaatcctgatcaccctataccttaagcctgaccactttgaactttttaattacataagctaataaatcctctttaatgctgaaaccaatctacaatgaattttccattatttacatcaatgacaaaaatattaaatgttataaggaggtgttaaattgagatgtgattatcaatttctcattaatcattaggctgcatctttccatttgatttgctacattaaacatttaattataagaaagagacatcttattgaatattagaaattggcaagattttagcttgataatgcatattaccacaatacatggaatgctgttactatattcagataattagttaccaacagttgggctccacacatttaaaaatgttgaaattaatagatagtattgaaaattgacttaaattaaaatcacaatatataaagtggaattaagattacaaacgtgatgcatttttattcatttttaatttctgaatttttttttttttagagacagtgtcttactctgtctccccggctggagtacagtagcataatcatagctctctgcagcctcaaactgctggccttaagtgattctcccattgcagtccccagagtagctagaccttcagaggtgtgccaccatgttcagctaattgttaatttttttgtaatgatggggtctttctatgttagccaggctcgtcttgaactcctgggctcaagtaatcctcttgccttggcctcccgaagcactggtattatggatgtgagccatggtccccagccatgttgcattttcaactgctctagtccatcttgaacttcaccttatttgtccattatctggaccacaccatctacataattacttctttcatctgctcaccatcagtactcattttcaacctttcaacataggttagcaattagctcatactttctcctccataattttctcatttattctttcatctcttcaactgcatttatttagcatatcctgtatgccagtcattgaactcaggtacaaaatacccactgaatatagctttgatgccataagagttgagaaaaatgctaataccaaatttaaatgatattttttcattacaaattgatgaccacaatggaaagaaatataatgaagaaactgattttatctactctgaggctacaaagaattccatgaatagtgaacatttaatctcagatccaaagatgagtggtaattaactaggtgaagaaatatgccagtatttattagccaggtaaatcaatatcccaggaagaaaaagtatcccatttgaagctctgtggtaaaaagaagcttgactcatttaaaaaaaaaaagtgaaagaaggccagtacagtgaatgaggaggatagtggcaaaagacaaactccacatcatatggaaatcacaggccattttaaagagtttagttttcatccgaagttcaatgaaaatacatgaaatgtaaataggcaatgagaggatcagatttatattttagaaacaactttctatatatgttacaatatgaaaaattacagaacagaggcaaaagtggaagatgcaattgcaaattaagtttcagttgcactgattcaggagagaggacactgcagtttggatcatggcaatggagatgggaaagagtgaggacatttaagaaatactgaggaatggagctatggaattttcagaagattatatgacttctaaatttcttgcttaaacaaccattaagaaaaagaacacagagaataactagctttgggaacaagattatgagatttattttaagtatagtgacttgatattcaagtagaaacattacatatactactttagaatttcaaatattttacattgaaaatatgaatctgagaatgatgagtcaagcctcttttggttgcagtatatatatagtatgtatattcaatctatctatccctctatcatctattatctatctatcagtctatttggattttattgccttgtattactagaaagttgactcaaagttagcttcacatatgataatatcctggggctcaaatacttttatacttttatgagtccctttaatttagaagctgagaggaagctagattgaatttggcaattctggaaggtgaatagttgaacagcatgtgtcattattctcagcaatatctctgttgctgtcacttagcttcaccatacttgatttatattaattcagtaagacaaaagctttaccacatgctcaacaaatcgattttaaataaggcaccattctatttatgaatacactttctcttaaaccttagtttcaccttcctcattcttcatcttcttaatctgtttaataaaaacaaatagacaaaaacgcctgagagttgaaacaacttcaattattaaaccactaattctcttacaccaaatgtagtctattctctgctgttgtgctggtaatctatgggggttaattctgtgacattctcaacatcaaactaatttttttaatttttgtttatactttaagttctagggtacatgtgcacaacatgcaggtttgttacacatgaatacatgtgccatgtaggtgtgctgcacccaataacttactcgacatttacattaggtatatctcctaatgctatccctccccactccccccaccccacaacaggccctggtgtgtgatgttccccttcctgtgtccaagtgttatcattgttcaattcccacctatgagtgagaacacgtggtgtttggttttttgtccttgcaatagtttgctgagaatgatggtttccagcttcatccatgtccctacaaaggacatgaactcatcattttttatggctgcatagtattccatggtgtatatgcgccacattttcttaatccagtctatcattgttggacattttgtggagaaataggaacacttttacactgttgttgggactgtaaactagttcaaccattgtggaagacagtgtggcgatccctcagggatctagaactagaaataccatttgacccagccatcccattactgggtatatacccaaaggattataaatcatgctgctataaagacacaggcacacgtatgttattgtggcactattcacaatagcaaagacttggaaccaacatcaaactaatatttcacaccttgatttttcatcatgtctacatcccaccttctattacatcacccttattgttttccttctagggctttcctgatggtctaaaaagccctctgaaagaattacataaggaatatggagaaggaggagtaacaatatgagatccaccctgtaattcatcacagcgtcaaatactatgtgagaaagatagctgagaagtacagatgagagacaattacagtaggaagtatgcaatattctgtggtttttgtaagatatcctcatgactcattctatgtctcagagtcaatgtcttcattgtctctacacctcagatttttcccttcaagacacatgtatggacttggtctcagaactcttgtcagtatttcaatttttctcattgaatttcaccatttcaccctttccaggacattcaaatttacacaattctcaaaatctttttttaaaaagaagtcttaatttgctctcatcccctcctgagttatatttctctctttctgtttactttcaaacttgtattaatggagcacattttatacttccattcctttattaattccttgccttctgaaagtcatcttctcttcaaaacttcctacaaaattgctttgttaaatgctaacattcttttttgcaatttactttttgctctttgatttctcttgaaccctttctttttgaaattccttcttctcttagcttttgtatcccagtgctatttgttttggaactactcttctgaattcttatttttccttttcatttctggatcatatttcccctactgtttataaactcaagaggttgagttcttccttttttttttttttttttttttttgagatggagtctcgctctgtcacccagtctggagtgcagtggtgtgatcttggctcactgcaacctcccctcctgggttcaaacgattctcctacctcagcctcccaagtagctgggattacaggtgcccatcaccacatctggttaatttttgtatttttagtagagacgtggtttcaccatgttggccatgctggtcttgatctcctgaccttatgatccacccacctcagcctcccaaagtgctgacattacaggcgtgagtcactgtgcccagccctctttttgttattcatgttgtatactcttttctttttgtgaaagtggaaaaccattttcatggttattccttgtcctactcattaaatgatccaaactgtagccaccgactatactaccacacatttagctatgaaaaatatactgttcacctaggatagcaagattaccaatacttgtagtacaatttaaaaattatggttactgtttgatttaaatccaataaactgattttaagtaactgagagtcagggcctccaatagataacttatttccctatggatttgacaatcatctctattgatattgattctgaaatttattgtatccaggccagacctctctgcttgagctccagactcatctactctctatgtatcagtatatgcctatttaggacaccaggaaggtggctgaactaaggaggcagggcctgtgagatgtaaagcagcatcatgcaactttcttgtgaatagaatataaacatttagcaattacctagccttggggaataatgattttaagtgctgagcttacaattcaaaccagaaaaaagcaaacaatggctataatcaggttatgttgttgaatataaccatgtgtatcagtaatacacaggacagtgagatacctatctacttagctatatgacaactatcaccagaatatcagttactcagcaactgaaacatttttttttttctgtttaaatcttgctttccttcaaggatatattctggcattaattactttttgacagttacccaatcctcccttctctcaataatgaatttatttttcatatatctgcctatgatgctttgtttatatttctgttaatgcagttctctctaatcatagtaagacaggatatattaggtgtttacctgtgcatgctacagctaatttctgatctctatgaattaaagaaatatggactttttccctcctttctcacttcttccctttctcttcaccttcattctttctttttttctttgtatttcccacaatgtctggctcattataggtgctcaatagcttactggtgtttaaacggaatagtttttttttttttaagtaatcagctgacatgttaggcaaccatttcatattaaacattttacatcaatttcattacaactttaagtagttaatttcttaactcataacagaaaacaagatacttccctcccagcttatatcagtattatgttattaataaaatttctatcctatttttccaggcacttttccttctaatagttgctgacaatgagtcatagctacaatgccaccacaggcaggtctcaggggatcattgtccccacaaggcagtgcattaatttcacactgtggttcattaatggtattgtcaatgcccccatggggtatgggtgtttgtgaatccctgatgtttcctgattacttggtttgcactctattccttctccaaaaagtcattcccactatgctgtcaccagcgaaaacactgcctagtggtacatcatgtaaactatgcacatagtcacattctattactttagcattttatattgcacctgttgattttatttataaattgattttccttctgctaggctaaagcatgttaatgattttctgggtataatgtgataagctatgcatggaactttcagatgaatctgtcagttctcattgtcttcaaaactcactaatattccctcagaatattttgaaaagccttatttggaaattagtttaccatataaattaatttatagttggtagtttaaaagtaactctttctgctcttgtgtgaaattcaacatctactttaggtaaatgtaaatttattatataggaaaaaataatttaacagctaaaaatatttgataagtgctaatatgtgtcaagcacatgtccaggtactggcaatatatgataagagataagaagggtgtttacttttatggggcttttgttagagaatttagcagaaaaaacaaatacacacatactcatagatagataatatatttagatagcaatacatgctgaaataaaacagtaaaatgcgatggagtagataataatgctggaggggattgtggcactgcagctagactggtaaggaaattgcattctgagatggcggcatttgaactaagaccaaaaaaattagaagagtcacatggaggtctatgaaaacaatgtcctgggaagaagacacaatgaatgaagaggctttggtgcagaaataagcagtggtatgttctaagaatagaaggaagaacattgcggctggagcataatgtgccaaagggagactagtaagagattactttgaataggtagagaggaacacgatcacatttgatttgtaaatcattttattctaaatatgatatgaaaccattggaatgttttaagcaggggaattatatgattaatctacgcttaaagattattccaggtactctgtggaaaatgtactagagaggatctaaaatgaaattagaggatcaattaggaatctaatatgctaatccaggtaagggatgaagatagcttggaattgagaagtgcaaatgttagcgatatattttgaaggtaaacacaatgtaatttgctgttggattggatgtgcggagttataaatagagaggagcaaagggtgagcttaaggtttttggcttgaagaaggcatggtagaaacataactgaggtggaagtgtctggtgctgaagcaaggtttagaggcatagactccaatatagtttggctctgtgtccccacccaaattgtactcccataattcccacatgttgtgggagagacctggtgggagataatttgaatcatggggcagttcccccgatactgttctagtggtagtgaataagtctcacaagatctgatggttttatcaagggtttctgcttttgtatctgcctcatttttttcttgtggctgccatgtaagaagtgccttttgcctcctgtcatgattctgaggccttgccagccacatggaactgtaagtccaattaaaactctttttcttcccagtttcgggtatgtctttattagcagcatgaaaacagactaattataataaattggtaccaagagtgggatgttactgaaaagatacctgaacatgtggaagcagctttggaactgggtaacaggcaaaagttcgaacagtttggagggctcagaagaagacaagaatatgtaggaaagtttggaacttcctagagacttgctgaatggctttgaccaaaagcctgatagcgatatagacaaataaggtccaggctgaggggttctcagatggagatgaggaacttgttgggaactgaagcaaaggtgactcttgttatgttttagcaaagagactggcagcattttgctcctgccctagagatttgtggaactttgaaattgagagagatgatttagggtatctggcagaagaaatttctaagcagcaaagcattcaaaaggtgacttgggtgctgttaaaagcattcagttttataagggaagcagagtgtaaaggttcaggaaatttgcagcctgacaatgtgatagaaaagaaaaacccattttctaaagagaaattcaagccagctgcagaaatttgcataagtaacaaggagccaaatgttaatccccaagacaatggggaaaatgtctccaaggcatgtcagagatcttcatggcaggccctcccatcacaggcccaggaggcctaggaaaaagtagtttcctgggcctggcccagggtcccagtgctgtgtgcaggctaacgacttggtgtcctgcatcccagccactacagccatgactaaaagtggccaaggtatagcttgggctgtggcttcagagggtgcgacccccaagtcttggcagcttccatgtggtgttgagactgcaggtggacagaagtcaagaattggggtttggaaacctctgtttagatttcagaagatgtatagaaatgcctggatgcccaggcagaagtttgctgcaggattggggtgctcatggagaacctctgctaggacagtgcagaagagaaatttggggttggagcccccacacagaatcctgactggggcaccacctagtggagatgtgagaagaggtcgactgtcctccagaccccagaatggtagatccaccgacagcttgcatcgtctccctgaaaaagcttcagacactcaacactacccgctgaaagcagccaggagggaggctgtaccctgcaaagcaacaggggtggagctgcctaagaccatgggagtccacttcttgcatcagtgtgacctggatgtgagacctggagtcaaaggagatcattttgaacctttaaaatttgactgccctgctggattttggagttgcatcggccctgtaaccactttgttttggacaatttctcccatttggaatggctgtatttacccaatacatgtacccaaattggaaccaggaaataattagcttgattttgattttacaggctcataggtggaagggacttgccttatctcagatgaggctttgaactgtggactttcgggttaatgcttaaatgaattaagactttaggggactgagggaagacacgcttggttttgaaatgtgaaggcataagatttggaggggccaggggcagaatgatatggtttggctctgtgtctccacccaaatctcatcttgaattgtactcccataattcccatgtgttgtgggagggaactagtgggagataatttgaatcaagggggacctttcccccatactgtccttacggtagtgaataagtctcacaaaatctgatggttttatgaggggtttccgcttttgcatcttcctcattttctcttgtggctgccatgtaagaagtgcctttcacctcctgccgtgattctgaggcctccccagtcatgtggaacctccttttcttcccagtctcaggtttgtctttatcagcagcatgaaaacggactaatacagactctcatggcactgaccagattttgcctcctattacagttttaagatttatctatctcctctactaaacccacagagaacagtcacatctgagagttccattcaggctgactagaaatgttatttcctttcccaagccctgactactcccagcatttcatctggcctatatttattcatttggctatttcctccccaaagccttccttcatcctaccccaccatctaaattaggctctggtacaactctagattcacattctctgacagtaggaaaatcattcagaagttcatcataaaaaatatattctggccaggagcagcggctcgcgcctgtaatcccagcactttgagaggctgaggcaggaggatcatgaagtcaggagacagagaccatcctggttaacatggtgaaaccctgtctctactaaaaaaaatacaaaaaattagccgggcatggtggctggtgcctgtagtcccagctactcaggaggctgaggcaggagaatggcatgaacccgggaggcggagcttgcagtgagccgagatcgcttcactgcactccagcctgggcaacagagcgagacttggtctcaaaaacaaacaaacaaacaaaaaatacacacacacacacacacacacacatacatatatatacacacacacacacacatatatattatatatatatatatataatatatatatatatatattctccacatgtgcctacctgatggaggaaaatgaattatacgtgctctgcatctaaacctatttctatatagtttcactaggaaaaatggtaattttcaatactatatatacccccgtatggtgctttatatttacaaaacctctgtcagcaacattatttaattaactcatctgagttctcctgctagttaactatttattagtgttactaaactctatatgagaaaagtaagggtcaagactcttcagacattttaattaagattatgagatagtgatagtactgagaatcaaatttagaactctgttacaattgcaatcttccttccgccctaacacagctttttctgaagtcccaaatatttaattttaaccttgatttaatttttaatcttttgctttccttcactacatgtattcacatacacacattcacaggttttgcatataaatatccatttacattaagaggtcaagaagcttgggcactttggaaaggtcttggacaaagtgaggagagcagtgacaagtgtgattatagtcctgtaaaagtgaagctctataaagatcttccctcagtactggatgtaaatactaaatatttaaactcagaatcagtttaaatagatgtcctgcaggcactaaatagtggataaaatatagtttacattttaacaactagttattatataatctctttcaattttccttaattgtacttaatattaaatcattttattcccactattggggtatcagaggatatttacaactataataagtgcaaatggacaataagaaaactaattttctgatgctttggccctatgaagcccagataagaactgagaaaaatatactgtggatttcagtacaaagctcaatagcatccataaaatattgactaaaagttggaactcttaaattttaataaggcctatttgctttcttaattaaatatagcctaatgaaaagtaattaaggtacatagagagatctggctagaaatttttttactagtcctgagaattttgtttagttatatagacaagttccaaaggaaacaaaatcatccaattatttattcactattgtcaaagacatcaaagatgaacagaatctctcttttatttgctcacaaaattagaaaattatattaattatatatattcatagttgcatagtagggaaataattgtctttggatcagagagacctgggtttgattctagcacctcatcttgttaggcgattagacctggaacagttagttaacctccatgagacatgctttcattagctgcaacatgtgagacaaaagaaccaaatctacatatttattgttatcattaatgttaaaatactaaaagcacccatataaaacggacacgaaatgaaaggggtcattgtaagattaaaaaattaataacgtaatgctcacagaatctagtacagtacctgggaacttgataaatatttgttgaataaataaatactagatactgctaactgtgatactaaataggctactcaatgtttcagtagtttccttcccatttgtaaaaacaaaacatgcctccttatttcattcaacaaatatttaccaaatgcctgctctgtattaggcactgtgttaagctctagctactgggaataagttcaactttcagaaaaattagtaaaacacatccctgaatgaactatttccagacactatgatgggtttggcagcacaaagaacaatatgaccttatagaaagtgttcccagtgtagttttgaggtgtgaagacttcttagagaataactgagatgtataagccatacaaaaatggcagaagaactgaagtgatgaaagtaagttataggtgaaaggaacagtataaatactaagaaagcatggcttattctgggctcgtgtggttttggtgtgaagaacttgtatactgcagataaactggctaattttcttaatttgtcactcatcaacttctttagatgctgatcttagacagtccctaagacactgttgttttccctttcatccggattcagctttagcagatcactttctgatccccagctctgtttttcttctacctgctcagctttaaggtcacgcctatgccttctggtgtctgacgtcagttcatgaccttcactgacttcctacctgtgcactgttcttgccaagaagtcagaggcttggctgtggagcatagcgatacgaataaccagcagacactatctaagactaagccaggggggtataaacaggcctgatctctttattccaaaattaaaagaacattttttttttgttttgtcctttattgaagagatatatttaaagttccttccttatgccagacattgtcataggtactggggaatcaaaataaactgtcctttaggagcttgttctccaactgggtaaataacataaaaccaaatacataacacagcaagggaggcgctgataaaaatctatgaaaatgtctataacacagagatgattcttatctggtagtaaatttttttaaactcagatacataagaatacaactgagcatatataacagaggcatcacagttttattattttctgctttatgattaaatcaactttttttattacagtaatggttttacaatatgagaaacttgctttaccctgaatttcagatatttgattctaacttaattgtccacattttgtttttgaacagaaatccatttgctttttgggagaaaagaaactccatcattatgggaaggcatattataaaccttgaacaaaaaggtaatatcatgaaatagattcattcattaaaataggatattatgcacaactccccagtgatatttttattcatgctgctttattttttaaaaaaaaatgagttctgaaatgaattaattacaatttatttttaaaaatttcctaattcctaaggatcatcataatttggcattgataggtaaataactaaattctgaaaactgctgagagtgcctattttggatttgatgtcacactaggtgtggagatgcctcaaatgaatgacaaggtccctcccctcgaggatttgtcacttcagtcacagacagataaaagctgttctgatgtggtgtgaaaagtgctcttttattataaatcaggttgggttggcagtaagagggggccatacaaggtttcttggccagaggtacaacctgcactgagaattaaaaggaaattctataattgtggaatccacattcaatttcgacttcacctctttattcatctttctgctcagtggttttgtttagctctttagatggaacctaaataggtagagtttggacaagaagcaatttaaaaccagcctatggatcaattttttagtctgatatgtgaagtttgtaaagcacaaagaggctccctgcctttaaggtcttctgtaaataagtttccactgacacttgaagagagggtggaaactaacgttaagcccttcaaattgcagagaatgatgggctgggaagagggctggatgaggagagcagcacaaaaggtggtgtaggaaaggatagtatatttctaataaagttaaatagaggcttaaatcaaacactttttctaccataaccatagttttatttttttcttgatcactggagaaagggtcacatttttacataatttaattattgtatttatccatgtagtcattttcccatatttgtgagaataatgtataaatgtgtcaaaattttggtgtgtggtgtttcaaaaaataatagttactttagccatgtagaataaacttaaagtgaccttcttattaaaagtacaaatcactatgcagccaaagcaattagaaatacggttggatatagcaaagatttcacctacatccatagttttaaccaatatctctttatcattgactgttttatacctcctgatcatacttctcaccttctctttgctatgtctgctctctgccatctgggtattttacagacttcaatctcaacatctactttcattttgtattttctaacactgtgatagatgtgcatccactcatgtatttaagctggaattttagggtttatcctgagttcccacttgtctcttttctatgacttacacgccccaaaaccaggcatttaatcaggattctgttctgttattctatcataaaaatctcttaaacaggagtcttttcctattagacaaggaatacgacaacaatcgacaatctggttctacaataaactttttataatgtaaattttataacatgatcctcccctttgaagcagctccctgtgagcaacaggaaagtccgaaatacttgcttagcatggcctatgggcttcaaaatctggccttagctggtgctcagttctcctaatctgctatacctctctccagagaaatattctgccccagaaacactggaagctgcacaccattttcttttgtttcttgttaatgcctgctaaagtctcaatgttcagctcaaacctcatatcctttatgagattgttctagacccaggatagttagaacctctcttttatcctttcttagctcccttaccttattatagactttatcactaggtactatactaattcattttctgatctgtcattcattgtgggctccttaaaggcagaaacaatgatttgcctatatctgtctttagcaattcctattggattttatacagagtaagtgcccaataaaagcttattgaatgttttaaggcatagatgcattaatggatgaatgagtgagtaaatgaatgaactaggttattattagctacagaatagcttcaaataaagacgaatgctgaatgaacaattccaacccccccacaggcccttatgacatccgaaagtcccatcactgatgttctctgtcacctctagtgagtcacttagtctctcatctgtaaagcttaattagtgcttcagcaataagctcaagctcttaaaatgctaggtgttaaattcattgcttcagaaaaactgtcatgttcatagtcatttggaataaaactgtaagatatgcaacaagactccattttctgttaaaaatgctaggtttcctcatgcctaaaatagacttaatggcagctggctcccagctactcctgaagatgtcacagcttcaaacatgggggtattgccacttctgagactcgaagttccttctcttaatttcagggccaccctccatgcctccatcctggaggcctgcacagggtgggtaatcatagtcaacgtgaggagaaacaaacaggcaattctcctaatgggaacagttaactggctcactgtcagtcagaaggctggcaattttatagcttctccactgtgcctgaatcactgcactgagtggtctactgcagagaggagaaaatggagtttgtatctcctatggttcttaacagactgcagaattaaggaaaatataaatggaaaaaaaaagtttaaagctatacacgaagattacatagcacagaaacaattcaattcaattcaattcaattcaattcaattaaacacatgtgtttttgaggtcctactacctacaaaacactatgttaggtactatgggagaagcacttataaatgggtgagagaaatagttctgagcttctacagtttcatacagagttgtacaattttccactaatataaatgaacatgtataaaggctagtatggaaatacaaagtagtgaggagataggaaagggaaaggtgatttctgactgggggcctgggaaaagcctttcgaggaagcagaacctgggattttgggcagcctctcaaacagtctccctcattcctgtctgattctgaaaatgttgagaaacaaaagatggaggaaaaaaagtattcaccataaataccgatgacactaggctgggagcttagtctaatgtcaaatgggtttgctgaaactgacccctgaaaataggcagacttacccaccgatcacggtactaggagactgggctcacctctccatatggatgggctgcccatgtaagccttagaaccccaggatagctctttctctaaaagaattttcagtccctaaggaaataaggtaaagatgagctgagcctagttactcttctgaaacttacaaaataagtcactcctcctcctctgagaaaagcctagagccacactaattgatctccttctaaggaatgaaatgttaggtgtgggaaaaatacattcctaatgcgtgataggatcttaatggtgagagggaaggaaggacatctcaggctgggtaatagataaatgtgaaatttgtaagcaagtcctgaggagacagaaaaatgtcatgattaagaacactctttttgtagtaaaacagacatggtttaatcttgactcttttttgatctgaataagtcacctaaatgctctggcctggttttctaatctgcaaattggagataatagtacccgtttcatagaactcaataaatagttgcaataatatttaaccaccagcataattgagcatggggatatgctgcataatcagacacttcctttacaaattaattttggaattttaagttttattaaatgatctatttccttttaatttatcagcttggtgagatcaaattcctgtgtattgtgtttttcttgaagtgaactgtaccttttacacaccgttaggtctcctatattgctattttatatcagtacaggaggagagtggtatggattgtggggacaggagagagcagcataggcaggtacaatgaatagcacacaacaaaatgtagaggtgaatgcaaggatgtgacaaagtgtaagtgatgtggtatgaatttaaatgaagactaccaaaggggaatacaggtggaaagaacagcaggcataacttcatttccagctccatccttcttagagaactatttttttttttttaacgagagcatgccaatgagcttgaaaagtgttaaactgaaccaaaaaatgatatctctaattcttcagggtcccagatgcttttaaatgcatgattggacaatcataaaactatcatgaccatataactgaagatgatttaagaatgtactttcttggttatttagagagcaatgttatgggtgtttttcttttattatatagatatgattgcttatgattgcagtatcacattaggttattgattacatggtactctcgggacagattatttctcttgtatatgtatatgctaggatgctaaaggacatctaccacacagataatttttgaagaagatgactacatgaaaaactgagatcttcaaatggaagcatttttaaactcctcagtgaagcatctactctcacatgagctctgaacttaaccatataaaacatggccttgtaccaatttaatgactgatgcaagagagataagttatgcatgtgggtcaaaagctatggaataattgagagggtttattcacagctctctaggtatgacatctgacaaggagagagaaagaaaatagcaaagagcttgcatgtctcttcgtttccatcaaatatattttcagaagcagaccaaaaggagttgtctctgaaatttaataacctctagaaatagttacataacatgtagaaataagtttgttttataatatgcagttcttagatgttgaaaaaaaaagattgcttgatcatttcttaacccagccatcttccaagtatgtacttccattatttatatagtggagctgtcctacttgctttgtaaggcaaaatactgaaattcactaaaaagaacttctcacacaaaggtacatttctactttgtgtgatattacttactgctttgaatggcctcaggtcagtatttttaggaaataactatgacttttttgactaagtcctctagatcccaagtaatttttatctttcccattgccaaagaaacattcatatgagtctaacaagatgacttagattaaattcacttttatatttgaatatttcctggggcttttctataccttccaaatacaatggtcctgaaaggatatttgtaattgagttttcaaggaatcaacacctatttttggtagttgtgttattgaaacgggagtgtagttcccttatccctctcacagggcgtgagacagggtgtggctcgcttcttccatgctctgctgctagaagccctaggggaagcatgcagaagggtaggttgtgtggagcatttatgggctcccaccccatcggcgttgtccagggttgagtgtttgcagcgccagaaacctcagtaggcatgtgttacagtttgctctttcagttttgccctcttcaggcgacttgtgtgaatcagctcaattagaccctctgccttaccacaaagacagaaggctttctgtatcctggattcttgccctagtgtaccagaaaaattgggtcacacttgggcttggaggatagatacaaagttttattagctgtcagtgagatggatggggaggccagaagggggatggagtgggaaggtactcttcccctggagtccgattgcccagcggtagggctctcctcccactgctcctggctgaatttcactgttgatggtctgccagcgtctgctggtttctgtctgtgggtgttctcttctgctcctctccatgtccaactgcttgtgtctgtgcctgctagggtttccggtgttttatgggcacagaatgggggcatggcaggccagagtggtcttgaaaaatgcaacatttgggcacaaaaacaggagtgcctgttatcacttaggtctgtggagcctttgtcagggaccccacccttctctacccagcacttccctgcctccctgcctcccttctgtggttaagaatgacatgtgatttgaacattaaataatcataatgtccaccttggtggggtatgtggtttaagtgaagtggtcatctgtaagataataattgggatttccaagtcagacacacctggattccgacatttgatatttgataatgaagccctgctgggaaaattatgtaacatttctgactctagtttattttttagcagaatgggttttataatgttacctatctcattgaatggttgtaaagattaaatgacatgaagtacgtaaagtgctagcacagtatttggcatgcagtaagccctcaacatgtaatttggtgttattacctttgaataagataaatggaagaaatctttgataacttatcactaaactccaaaaaaagactaaatttcgtgtcaaatgattgtgagattttaaaagaatctttggagaaggtgatgctgtatctctgtgtatgtgattttcctttaaaaattttttctttctaagcctaccagctgcaacttaagcacatatccttttttcaatatttccagattggcacaagagctgatttggcatataatttatgtctcatgtgtatacagtatgtagtgtatataattgctatatatagtattttttataaaatgttcatcatggaattagattctaagtcagcaattctctttcaaacgcagctgcatccaaatgactctttccctggggaaggaaattttttattttcccctaaggtcacacaaagccataaatgtgaagagcagctgacagaaggcagtttttctctgcggcactttttcctgacagtagtgccatgatgacccttgtgtttggttctgtcactaggattgatgcgcttttgtatgggttcccagaggaccatttatgttttgcaattccttccacagattaggatagtgctctgcaagtgctcactcaatactcatttgttaaccaacagtaaaatactacaaatggatacctgtagaagcaatgcaagatcatgttctttatcttccaagtttgtttactacaatgtacaagtgcagccacaaggtacacattataaagatttagtggtttcctagcctcagatccatggactacataaatgccatgtgatatgaaacttacttgaatgaagcagacccacaaaatacatgcacaattgtgactaggaaagtgcttttgtctagacagaggttttataacttttattaatttcctaaaggatgaacaattcaaaaatcagggatcatagcactgacaaaagctctaaagtaatagatttctctttgtatgcaagtgaaatctttaaatatataatcacattttgcctgagaatgctttcatgtttatatcttggcactacttccattcaattgtgctaaccaaaaacccagagagtcatactggacatcttcttgctcatatgtaatccagtatcaagtgctgtcaactttactgactaaattctgttcaaatccatctgcttttctccagctctgctagcacagttaatccatgctatcatcatctttcatcaggaaaacagcaatagactcaaaattctttactgtcattcagactcgtcctctgccaatccattctccacagggtagctagggaaacttttaaaaatgcagatctgattattaactcccctgaataaaaagtggtttcccatttctctcagggtaaagacaaaagtcctgaacatgaccctatatggtcgggccctgcttgtcctgcagattctctttatgccatgctcttgtttggtctctctattccagctagaataaccttctttttattctttatgtgtgtcatgtcctcttctaccaaggcttctcagcatgtattgtttcctctgcctgaaatacttaaaaacattttttctacaaattcactcttagtgcttcttatatgctgcacatattactttagcaaaatcttccatgacttccactattatacaaattcatgaaaccatatgctctgtttcagagaacttgttaccttgctagcacaatgggctcaagaagagagtagttattggctacgtatggattcaatagcatgggatcttattctccagatttgatctagttactgccaccatcaaagggtctgcctagaagtaacagagaccacagctgagtcccctgtgtggcaatatgtttttatttccttgttaataatttgatgaatgtgaatctttccagttagactgcagtctcagtgaagggaagtattcttaatggtcaaattttcaggtcttggcattgctcctggtacagagaagacatccatatgaacagactgaatgaatgaaaaaatggtctccttcattaagcataatatttgtaaaagtagaaattatgaatgtatggtggattgaacaaagtggagaatttacaaccatcttccttgagatcaaatgccctttccatctgctctctagctatatggtctcagattatacaagtggttacaacctatgagtaaggactattgctatttcaaggtacagatggagaaaactgagacttagaaaacgaacaattctgcattagtctcccattccgacaaaacaaaaaacaaaacaaaaaaaaaaaccgagttattctctaagggtcattcttacttacggcctctaagaaatttgggaatgacaatgtgttctatattcacattctttacatgggtcagctgtgaaagtgacttagacttgtaggtagagacagaggctttgaacctaacttttcactacagcattttttaaaaaaagcatatgaatgaaaaactcatcgtggaatcagatcccaagcagggttgagagtttccaaacttctcccatttcctaggccttatctctttcttattatcctttaaaatgtgtgcagtagaagctgtgaggtgccataaagatttctcttcaggaccaaggcagtcattcctttggctgccaggagtgttgattgctgacaactcacagctgagtctctgtctgggcctctccatcatcttcatctaagagcagctaggaagctgccttaccctaggcactcccattccatggggacagcctgcttcgaatgaagggtatatgtacaagtataaaagctgccctcttacttcaaatagagacaactctggagggggcagtagaatttcattataagatgtaaatgtgatacatgtggatcaagcatgagcaagactagtagacactaatttgctgcacgagcagagtgtccaggtctaatgccattcacttaaatattgatttaaatacgttatgtcagcatttctcccagagctgacacctgtggctgcatgagaagtctcctatgactcgatgtcagaggagacaaaaggtaagcttgattcatgaatgagcaagttctgtgtatgtttatagcaaaagagatttgaggatgacactgtgcagttggaggcattctataccatagaccttaggggagtcctgaaagataatggtaacaggaaatcctcccaatggataaaactttagtgaatatctacttcatgagggaagaaaagtggcccaaagtgaataagtatgaattattggacagagttgaatggcttggctgattgattaggaaaggcctgcaaataaaatagataaaaggtaatcaggatcacccagaaagactggggaaaaggtatatatgtgaacctatgggagtggccagggtatgaagatctttgtatttcatgttaaggtttatcagagaccatctagtacacaggaggtatcaaacaaccatttaatattagctatcctctgttatcaggcatcccattgctagcatgatgggctcaagaagagagtagctatgggtgatacatggatctgaaagcatgggatctcattcttcagaattgatatagttactgccactttcaaaactacaacctagaagcaatagagacaacagctgggtccccagtatggcacaactgctcaaggagaccaaccagctatttggtggaatgttgtctgcattgtacttctactttgaaagggcaaataacttattttgactgaaatcaaaagtattttccatgtgaagatttactgttccttttcacagggtctcagctagaaccactatggcagctcatagagtaatctaccaccatggcatcctttataatgttgcacaagacaaagggactcacagaacagccaaggaggtgtgacagtggtgacatgtagatgggacccactggtcctacacatttggcacctaccagaaactgctacacatatacagcaatgggacaggctcttcaaggtacaactgagatactggcttaggtacaatgccctgcacggatggggtgccattttataagatgaaataaacagctttaaccaatacagtgtttctgtgtccctaggaggcagaatacgtttgtgcagcaataagacaattgatatatgagtggtcccacttaaccatcactccaagtgtcccatttgggttttctgtgcttttcatccctacaaatctggattctgtggctccagaggtcctgcttcccaaggagggaatgcttccagcaagggacacagtgagtttcccaataaccttttagatttagctgccactcagccactgtaggcttcttgaatgaagaagtcaacaagcaaggaaagaaaccaccatcttgttagagcagtggggctgcagatccacagtttttaccatgacagggaagagtataatcactggggtgtcttttggtacctccttgccatatcttgacagaaaattgacaagtacagtggtcatggactaagaaggacatggtgatcaggaagtcagacctctcagggatgacattctgggtcacaattagataagcgatcaagacaagcatagtcaagggttcttggaagagtgagggaactttagaatgcaccggagaggataacaatagcaacagctgaggactcaaggtcagcttcagaggtggggcctgtagtttgttccaccaaacttgctttgtatattttccctggaaaagaaaccaaccagaatctttgagcagctatttctagtacagatagttaggtcatgattctgtcttatacattttagggaagtagaagttacagacaaagtcataaatcgatacatggaggttacattggtttggcccaaaaaggtagaacatcttgaagcaggggcttacaggtcataaatgcgttctttaatttgcaattagttacaggagtaaaacttttctaaaaacttggagtgagaataaaggaatgtttaggttaagacaaggaaggctgttaaccaatgtactgggtcagcgtgacctgtagggttacatgacttaactcttgtctggcatacttaggtaatgtttataatttgatatcttattatcaaaaagagtgtcttttgttagtctcatgatctctattctaacattaatgctggccagttgttgtgtctaaagtccaaaaaggaagggataaaatgagtcatatttgacctcccttcctattatggtagggaattcagttttaaggttgtctgctgtcccgttagccaagggggcattaattcagtctgttggttgggggttaggatttcatttttagtttacacactatctagttactatgaagtaactatatctaccatatagcctgtggtagatagatacaaggaatctgccttatctgaggtattccccatccatggcagcaatcttccaatacagaggtacaaaaaggaataaatacctcaaactgggcctaccctgaaaggttatccagctcaagagtttcaaatggtcagtgaaagatctctgttgcaactgcctcacagtgcagcttctctttctgtccagtcctgcttcgctcagctctcacaggtgtcaccaaaattactatccaataaaacccctatatttgttgtgatcccaaaaagaaattcagctactcctaaatgtttggtgtttacttggctttctgggaaggtaacatgtagttgacagtaatatgaaagatattttagggccatttcatatgatcacaatcatatgatccattgaagactcattgataaggtgttatggactgaaatgtgactgcccaaaattcatatgttgaagcccaacctccaggaccttagaatgtaatcatatatggagataagtatataaagaggtgattaagttgaaatgaggctgtttttgtgtggtcataatccaatgtaactgatgtcattataagaggagaaatatacaccaggggcaccatgcacagagggacagccacatgagtaggcagcttgaggtcaaccatctgtaggtcaatgggagaggcctcagaggaaactaaccctgctaaccaacttgatcatagacttctagccttcagaactatggaaaaataaatttatgttgtttaagccattcgatcggtgatattctgttaggtcagcctagcaaactaatacctaagcatgctttaaattgggggatataatatcttgtttgacttaattagcaaatattttctcaacatgggcaatccaaaatgaagaatccagtctaaaatgttgttgtatataaactctaaagcattggtagatgtctgtaacctggagaaagcgctgggtcctctccccagataacccctttctgtcccatgttgtaaaccctctacacctccatggaataatcaagatcactaagacaaatatttaaagaaagaataattctcttttcaatcacaatagttcctatttattttactatactctaaagaataataattgcaatcttttgcaaagaaacttgtcacattgggatagtactggacacctgagggatggtatgtagacatctcatgttaccttaaaacactttgtccccaatctgtgatcacagtgggactatgggtcaaaccaaacctagttcaattaggggtttttagtttgaaacaaaaggttgggcaaatgacaagcaatatgggttgggtctgtgtcctcagccaaatctcaccttgaattgtagttctcataatctccacatgtcatgagagggacccggtgggaggtaattgaatcataggggcggttaccctcacgatattcttgtgataatcagtatctacccctaccaactcctaattgtgtggtttctcacatcctggctttttgctgtcatcagtgtgaagtgggaaggatcaaactataatcattaaaataataatacaataaatgcagtacgacaatacaaggtctaacttttataagcactgacaatatgctaaggtcctaataaattcatgtgcctcaacctcatcaacccttccaatacctggaatatacctatcttagtcagtttgggctgctttgccaaaataccagcgactgggttttttcaacaacaaacattaatttctcatagtactggaggctagggagtccacagttaaggccctagtagcttcagtgtttggtgagggcctgcttcctggtttactgtcctctcactatatcttcagatggcccttttgtggtgcatgcatatggaagaaaagagatgtcttgtctctttctctttctataagggcattaatctcattataaggtcccactttcactacataatctaatcctctttatcttccaaaagcccacctccaaataccatcacattggggcttagggtgtcaatatatgaatttgagggaaacagaaacaataatccatagcagtacctattttaagaaaactaatgctaaaagcagtgaaggaccttgccccaagttaggtggtaagaaacagggcctgattttaaaaccagaacttactctccattgagaccacactcttacacacagagcatcagtaaaagtcatgtctacatagaacaccaaacctaggatgagaaccactgataattcctctgccaaagaaactcaaagccatttctgccagaaaaataagcccagcatataagaggaactgcacattttgaacattattttctcatctctgagactgttcagccagatttaatggaccaaggagaaaaagcagatgagtaactgcttgacccttttgccctctccatgcctgcctttcttccatctatctagaccttaaataaaacatgggactagtctatttgcaaagtgctgtccttggtgctgaggatggaaaatgaacaaattaggcacagccctttgctttcatggaggatttttttttcttcctcttcttcgctctatactttttctgttctctcctaactaccatttccccattcaccctggaaggaagctagtttttcctatgataattagccttgtcttcccttggtctgtgaaatgaatgcatggtctcacttcatattgtttgcataaactctccctctacctcttttcctttattttgtaattttcctttcatctcttattttatctcaccatctctagcatcagcataaacataacatatgattgtatatcaaatgttcaagaggttctaatcttgttacaagtgtgtaagaaactacatatgttataggtaagacagttaacacaataattacccatatcataaaagaagcagaatatctgagactcactttctactctgtccagtgtggggttggatgagatcaatgggggttcttcagcctggaagcacattagaatcacctgacgagcttgaagactcagcagtgcttgagctgcactcccagggacccttactcaattgacaaagtgtgagtactcaggattggtattttgaaaaatctccccaagagattttaatggcagccaggctgcagaaccactggacttgaccattcctttaggtattttctggctttaggattcagtcacctctaaatgtatcttttaaaaacagatgctagaagtatcactgttttgaaggcccacatttcatccccacaccttattttggttaattagcttttgtggtgaggatgcactatagcatggtgaaggtgaaggttttgacatggagttaggtggtgctgcataaaatgtttcctgagtagagcagggttttttgtttgtttttttttctcctaccttgctgccattcatcatcgactgcaacatcttttctctctgctttctgctaatctcatatatattccatcttccacacacttgccaagaatgattaatctctaaaaaatccaatctgatcttatctctcctctatgtttctctccccttcaataattatttcccttaggatcaaatgcaaacttcttgggtatgtcacccaagaatctgtctccatctctcaacttatgacattcaaaatacatatatcaaacttattaaaccaatctattaaagcacttactatgtatcacacactttttagagtgcttaaatgtattaatttactgaagcctcaccacaaccctaagtgttagattatcactattctccattgtaccaatgaagaaactaagactcacagagattcactaacttcccaatggcacacagctagaatttcatagtcttgggattcaaaatctgacattcttttcccaaatcctgtgcttcttgatgagtatgtgttaatacctgccttacataacccatcaaagttcacttgttttccttctattttgaatgtttatcttccatcagatcttcgagtactgatcaatatctgtgatctttgaaggtccagttgtgttaccattcccagaagcagtccctaagccctcacccttcctcactcaagatttagggcttcttctctactatccaggcacattgtttcaacatctgtgttctggcatttattgcactatattgtaattttctattaaagtatctcccttaaagcagagtaaaatccagtctgtgaaatccttgaaggcagcaaatatatcttttatctctgtattactatcctccaccacattgaagagtgaagtccccaatatgaaatgttcttttagtaatattgcgatacaatttatcatctaacccaggaaattttggaaggtgctattaataattttcctgtgatgataggtatgaacctggatggatggtcaccttatttttaaaactgctttctaaggtgatttttctaatgccttatctaccaaatcctcccagaaataatacagaaaatgttctgcctttaagtatttttttattttgtgagtcagattgtacaaattctccaagatatgaatgcttataattcctcaacatctacacctttgcttgtagcttagtgtaagaattagtaattgaatggaatcagtatcttgttaaaggaggtggtacttagttaaaatgacaaatgaatggtgtttttgagggaaagttcttgaagttgacgatcttatatttaagtttattgctgattgacatgtacacatattgcaatgtttgaggatcagtgaagtagaaccttctttctgtgtcttatttctgctggaagtgctccaaggaatgattctgcatcgctctgcacaactcatttctgagtccctccaggagaacacttgtggatgatcagattgatcctggcttagtgattaagagtgtggtattggtacttgagtgtatggggttcactcctcccattagctgtgtgatcttggatggattacttaactgtgcttcagtttctttatctgtaaaatattacagtagctatcacatatagaattttgtgcattaagttaatatctaaaaatacttaggtcagtgcctgggatttggtaggttctatataagtatatcctaattaaataaatggatagtgtcactgtaaacataaaggcattcttctcttttccacccacatgaggggagatagagatgtcttcctatgcataactactccacttctctcatatatgacacctgtccatatatttttctctgcatctggctgagtgtgttggtcatcacttcaagtttctatgccacagggcctccagcagataatataattttgaggtttaaatcatctagaaataatttaaagtagacaggaggatgtgtgtaggttatatgcaaatggtacaccattttatatgaggggcttgagcatctgtggattttggtatctgtaggaatcctggaaccattcctctgtagataccaagggatgactgtggccagctaatgaaaagtgttactttccatctaatatataagttctttaggattatttggagagaaaggacatttagcagtacaagatttgaaaattctttgcgcctttaactaatctcatattatatcattaaaaccatatgcttttattgactgaagagcattaagtagtgatagatcaaagaaagatcaggtagcctacaaacttataattactctgttaccatcactggaaggcatttctgattttccagattatggtctttcttttatcaccttcatggattttaccttatttgagaaccacctgcactacaattttcctcagttttctttatattccatatttgaaaacttaaatatgtttaaagaaaacactatgtcactactataaatgtaggagcaaaattgccatttagcttatcataaatagaagatagcctaaaaataaatatgatgacaagaaaagagtgattaagcagatactcctgcttgccaacatgttgagtcccaggttcgctccccttttattgcaaaaatactttagcacatttttgtaagtaaatgtgtcccagcaccaaagggagactgtcttctagagttgatctaaaaggctgaatgaaacagggaataattttttcagcatgagattcagtggtatttagtgctttttcttttcataaatctcttgtagacatctcacattttgggaaatattgagaggaataggaaagaagcaaagcaacataatataaagactaaagactttgaggtatgagtattgttttcgaattgtgtctctgtcacttaacatgtagtttgatcttacaaagtattttccttttctgagattgtttccatctccaaacattgaagaccacatctacagcagggatttagtgacaatcacattagacaatgtatgtaaaagttcctcccacactaagcctcaaacattcagggtttagtaaataatttactttttctaaatttatttaaaatttatataggaaaattagctttttctatatccagctcccaagattttaggagtagtaaagacttgctttcctaattctatattggatcatatctgaatactctagagataccacctggttcatcacccataatatctcttttgctaattggaaaaaaattcctaggagcctaatacgaaccagacattgtggtaggaactaagttacagaagtgagtgattaaacacttgtcggcaaaaggtctaatggcagaaggaagtaaacagaaaattataataccatatttaatcagttctggttagcccatttttttttcatattttcacatttatgtgaaatgtgccttatatttgatgccatcttgtaaagatgaaaatggtaagtactattttggagagaagtccctggacttctggtgctcttggcagggcaggagaaagtagccctcagaaaaagcactccaaaggaggagttgcttagtgatatggaccaagggaggaggaaattggcaagaaagggagtggcatgtgcaaagacatagccatgtaagggatcatgttcagggcccatgaagcattctgtgcagcagcagcatgaggggagaatgaggggatggaccatgaggctaaaaggtgagttataggtcagatcatggagagccagggtaagggatctggacttttttctgaagaataagaaatcctttaagcaaggatctgggatgacttgatttgcaatatccatagatttcactgggtcactggcatggaagaaagtaggcaactacactgaggagcaaaatgaggaagagacttatcagaaatcaaaatccaacccacctctctgaagtgaactaatcaaggaaatgctctggagaggaggtcacctcagtgtcatcctgaggggtcagagcaggagccagcatgctctagacatgaatctgtggcactgggtggctgggctgtttgcctggactcaccctaagtcaacagaggctgtatttccatcaccatttccgggcaagcttgtgcttctggcatcatctccatgtgccctgggggcaaatttagctgagttttgaatgtgtgaatgccccattatatctgagtgtctgaaaatctctctcttcacaaacatgcactgaacaaacagaatctgttctcaataggaaacaactgtgccactggagttggcaggaggaagttggaaagaaagcaagtcacagctctgctgcctaccaagctgcctcttccagcttcctgttgaaggcccctttggttctctctccacaaaccagagggaaaatgctgggtattcgcattcacaacttcaattgtttcaaattaaactcccccaggagccgaattacctgagctaatgtatctcattattgtgcctcagtgcaatctaagaggtttcagataagatttcctgaagatagccattattccttcatctgttcaaaaataaggcacttgcaaaattgcaatcatgttcaccacagaaagtgttgctttgtttggtttcataaaagtagtgggtagaaagaacatattgacaacaaaatagaaaaagaaaggtctagaaaaaaatagtctccaccacatccgttaaatattttattgaagccccttgtatttttagggcctgacagaaaacctttgttgagcagcatgcagaacagtgttgcctgggcctgcctcgctagggagagcccaagaggcatgaattcaagcagacctgggattaaatcatggtactgtcacttactaattaagtttttctttttaagcaagtcacttaagttactcagaactcagctttccactcccacagaatatgtgttaggaaaatataatatgctactataaactgctccataataataggactctaaaggataaaaattgttcaagaaaaatttgaagaaggcagtctctggcttttaattctgcgaattaacttgaaaaatattgagatctattatatgtggcaggtaggtttgttgagtgtgtgtgtgcatgcatgcgtgtttgttggggtgaggggagcagtgagattgagaaggtgcattgcaggtagaagaaacaggatacgtaaaatctctacaaaaagaaggtgcatccaagtttgaggatttaaaaaggctcatgtgacagtaatgctgaaaaatgaattagaaaaattagactatacagggtgagttgggaccaggaatgctcatcatttagtgctttataaaactggtatttatctcattccctggagggaatagatgggacactcaggttaaaacaatttagggaaatttgaggaagataaataaagggactgtttataaaggtgtcagcaaggtgcaatgaaatcactagtgatagtgcaccattggggcctacttaccagacctaaaacaaagggataatgggagggagcaatggccttgaagagacccagggatacgaaagtttgaatgaagaagggctctgacagcagagtttgtgaaaggaacacagacagccctacaggaaggaaactcaacaaagccataaatattctgacctcacttgccttcctctgtctatcctcttgctggtaccttccactgactgaattctaccgcagccaaaggcaaaagagcctactgatgccatgatccacttgtgtcagctcccaaggcactagccagggcaaggaaaaagggagagtgggtctggaggaacaaatgaaagggacattctttctaaaggaatatgtctaatcaaatggcaaagagaagcttctagcctcaaaatcctttgccttctagcacccatggttctcatgctgacaggtacttctccactctgattgcttgagttgatggcctgtactaagcacttgttggctaagtaaccataaacaagtcatatcatctctcagtttcttcatctataaaatatgaataacaatagtaattttgattgggattattgaaaggataaatgcaataatacattgaaaacatgtaaaacagtgtctgacaaatagtaggcactacaaaaatgcttcctctcctgactcagattattgacatttcaaagaataaggaacaaaagtttagagacttttccaaaaacatcatataactagccaatgtgagaactcagagagagagacagagagagagagaaagagattccacttcaaaatagcaagtctaataatggtaatctacactctccctgaccactctcctacactgtgaattcctttaaggcaagcattatgtctcgttcattttgcatctcaggaacccattacgcacaagagttttttctcagacagtgtttgatgaatgagtatataaagcacagtgacagaaggtatagaagtaattactggaggacagaggagaactttccttgcaagtcgaaaatccttctctcttgtcttgtataactaattctataaataacaagatataacttggctttttcaacaaggtactgagattcagtaatatattgtaaaaaattaacatattgtatgattactctgaggtccattatttttgttgaatatttgaatcaccatttctgaagtagccccgtctccaggacatcccatatatgtcctacaagcagagatgatctatatcttgtaggagcatgttagagccaacattctctgcagtctagggtgtttgttatggtttggtagagaaatgatgtcttatttaacatatgtttttagtggtctcattggagttttatttatttcatcttgcactgaaagtatgacgacagcctggggcttctctgtgaaattgagtctgaaagtgtattaccaaggtgatcatcttaacatcttacttgcatggaaataaggtaggattcttaaattatagtagaggcaactcagtcatcttagggttaaaatggtcttataatgaatactgttcgtagtttgatgcccataaaaccacacagaaaatagactaggagtcaggagacacgggccatgtcattgatagtcagacagttgtttcctaaacattgaatagttgtcagtttggcttcatgtgaattcagagtaataacttgccttgccaccatctcagcaatgacattagaatcagatgcaattttatctgtgaacatgctgtgaataatataaagaataatgtaaagccaaagttattattcttctgtttactgtatttgacaaatatacattctttttcctatgtggtatctttgatattcagtgaggtttgtttcttccgtttggtcaaggcctggggctatgacaagtgtaggtaggctccagtttacaaaaaggaataactgccttctattcccttctagatttgggtagatattagtaggtttatggcaaaattttggaatattcacagcttgcaattgtataccagaaagcatactgctatattgtgcctcttagtcacagtgaacatttagtttaaaaaaacaaatatttattaatcacttattaaaagtcaggtgctgcattagctaaggggtctctaaataaaattaataaaatttgctgtttcctagggatgttcatggcttattacggtgcagtgcagatatagagtaagaactttgggtagataacctgatgtctctccatacctccatttccatcatgtgtaaaatatggataattatatctaccacttaatgtttctatgaagatgaaacaagtttggtcattataaagctttaatacattgtatgtcatgtaataggtgctgaactaatgctgacgagttgtttattattaggaaggacacacaaagaaacagatctctctatatctgctacatagtgacagacagaaatgatgctgttatatgaagaatatttacccatcttcttttactctcccagggtggaggcatgttttcttgtacactcaaatattagaatgtcacagacatgaatatgatgttgcagaaatcatagaaagaaaaacaacattttttctccagtgggaaatacatgtgtttctgttggtccctgccagcatatacaggtactctctgatgaagggacattttaggagacttaaattcatttgggggcctaaatgattaaaatgctacaaaagaaaaaaatattccaattatctctaggaatttcccaaaattttgattgttcttcatgaaattaagaagaaattgaaagcaaatttctttcaattgctttcaattgaaagcaaaatatatttcaaggactatgcagaaacaagattgacactttgtaaaattttaagatttatgaatcttatgggctataattaacttatcaagaatctttttgagttcaaataggtggatgtttttctgtgcaaagaacatagattttagctttcatatctttcaattctaatttgatatatactttaggattttgttttgttgtttcagttaaccagtgacaaagtggcatagagaataacttttggagaaacttagaaggtggggaagtcacaacaggctacagtaggctgtggttttctttctaaaggatacaggccatgtactgggtttttagggcccattaaggcagtggtaggtgaaaggggaggggtaggaaggtttctcagtgagcagtaaaggcatccctgatgtcaggcatgcataaaggtggtgggtagagggatcagcagacaggccagctgcaaaatgtgacatctacatccatctttgggaaagcattgtgttcattcatggtaaaaatgggggaaaattattgtggtagagacattgttaaaaaagtgatggaaacctaaagcatatatcatagtttacatgtataaccatatagtattacaaatctggacagtcctccaaatccctataatctcttctttgagatgtagttgcagtttgattatttcctagatggtaatgaatttgcctctgctgcttgcaagtgcatttacagtcacttcataaagcccttaaacacacttgtgaaggagcttcatgctcatcagaattagtctggactcatgtttcctgtgatgcatattgacttcatctgtagtacagctgcatctacaactctgtgaagatgcaaactgctagttcttcctgaggacaagtcaacgtgaaaaatcccaaatgagactgtaagttccactagcactgcatgaaaaatcagagcctagatacaggccaaagacctgttttggaccctaacctctgactgagttttcttcagaattagaatatattttcaaaagggacatagaattattttcacaaagatattttggggtctgtacatcacttgatgaaaatgaaagatggggaagggaattaacatttattgaacgactgcaaatatacaaggcttgtatgtatatttcgccttcataaaaatcctctgaaatagacataattatgccttgtaaataaaagcattactagggcagtggttgttgtcagtgcttaaaatagtacctgttacatactataatagatgctcaattagtatttgtgaaaaagagtaattgaattgaatcttgtagctgaagaaatagtagtaaagaaaagttaagtacttttcttaggaacgacctgcagagagactttgggctaaggcatggtgcatgtgggaagtgagaaaactcagattgggatgcaggtctatctgactgcaagacatatgattcttcaactatattttaatatccctccctgatggcattttttcatgaaaaaaaaaactatataattctcaataaggtggatgttactgatttctaagttatctatgaagcaggcagagctgctgacctccctggattattctacaacgaaatcctcccctcctgatcagtagaatagagatagattttacacgaatctttgtcagctgcctcaaatccttttttaggaacaaggatgagaaaacataatcacacaaataagtaatgctgacggtgtactgtgatttcattttcatttcaacaggtatttactgtgtgccaactatgttttcctgctttgggtatgcagtattagaaaaggaagatatagtggagaaaagatacaattcctgcctgaatttgctcagttttattttcggtggaaagaagaatccaatcagtgcttttaaaacctggttgtatataagaataacccatggtgtttgctgaaagaaccgaattagactatctgggtttgggtctgggaatttctatttttatcaagagccccagatcattctgatgcacagccacatttaggaaacactgaattagatgcaagctagaatcccttccagcttttgaattctatgactttctatcattacagaactttctcacaaaaatagggagaaaaaagaaatgtatgtttctgccaacagagcattaaggcaaaaaaaggatgagagtttgtaaggcagagattttgttctgtaaggtcaagggcagcttgggccagcaccagcccaaattctaaatggttcaggccagatgtagattccctaggtacttgataggaaagagcatggattatgttggaggggtagtgaaaagtacaaaagagtaggccaggaaggtttaaatgagtgcatttagcatagtgtattgcacatagtgaactgtcagtgaatttttgcttaagcgatgattattattagggtggtgggtgggtgattaggctgagcattgagataggaaagcacccacatttgatcagcagttagaaaggagattgaattggccccaatgaggaatacccaaaggaggttttaaataagacaaatgaagctgcattccctcggcattctatgtagtgtgtgggtgatttgtattgactgcttaatgctttcagagtgctagtcaacaatgttaagatacaaatataataaaagaaatcaggagaggcttagtatttcttgagcacccacactgtaccaaatactgtaaagtggcttgcatgttaaaccatttaatgcttaaatttacccactgaggcaggtgacattagtctcattttccagtagggaaactgagactcagttatatttaacccatggttatgtgaaagccatggtctaaacttcaggctgagttgagaagtacttaccattctcttttaactgtcacttagaaaaatcaccatgatggtttttattctagcatatgccttagtgaccataaattcactcattttttctaaggcccagaatgccccactgttttatttggtttgctttgcactttagttcaggtgtggctaactcaagggacttaaactaattatgaagaataagccagccctgttgcttgtacttccaatggcttttctcttagtaagatagtaaattatcatgtatgtctataccttattagcaaagctaaggaatgcaactgttttccttctttagaaaaaagaaactcagtacaaaatcaccttctctagacaaagccacttaaataggaatcagttctcttcattacagataatcaatataatggccattgagaattacatgctttaaaaaaagccatttattagtctttgtgtaggctagggttgttttataaacactaaaacataggcaaacagttgttaatgttttattatagataaatgacatttgttaatcgtgttaatgatcatagtggctaacattatttattgaatggttattgtatctaagcattaggcttttgaaatgctttccatattttatttgaatttcataaaaaccctatatactagatctcttttgatctccattttactgatgaagaaattaaattttacaaagattgaattcctttaaataccctgctagtaaatttaatgcaaggcctaatttggtttaactcttcagcccatcttttgaaacacatcactgaattagctctaagtaaataaatcttttcatatagcaaaatatcgttctacaactatgtaattatgtttctgaataatatttaaaggcatgagaaaatgtccatagcacaagagtaagggtgtatgacacatatcaaggaaatgtatatatacatttaggaaaatacttcaaggaaatacattgaaacattcacatttttcactaaatggttgaattatatgtgtactcttgtgttctgctcaaaacatctctgttttcatattttctataataactatttatagttagaaggataattacgtattaataattaaaatagaatctattaatgtagtaggattataaggaaatacatcaaaataatgagaaggttttatttaggcaacagactatgaaaatgcaaaaatataattcttttgcttataattttgacaggctcatcatagaaaatattttaaaaattgaaatggctgagttaccatacaagatcctttgtagtctagcccctggctacctttccagaattaattcttaaaactctctgtaagataaattctacttcctgattttaccatatcacttgaaggtactatactctttcacaagtcaatgcctatatatgtgattccatttgcctgcaatcacaaaactgtaatgtttttgagagcaaaggtcatatcatcttaactctggcatccaattttcctaacacagtacttacaatacagtaagccttttaaaatgtatatttgtagagcaaatacgtgatcttctttcacctgttcctccctctattttcagtttaacaaagtgattagatgatccaggctttagagacagtggaattaaaagagtggtgtataacattcacatttactctatgctttctgtttcaaagttttacagtgcaaatgtattcatatattacttatataatttaaaatcaaaagaggaggaaacatattttattaaaatgttctctacagaaaagttgagatattattattaggcattgtcatcttttaatcctttgttcaaagactgcctcttttctaaagcctccctgaattcctcataggctcagttcacttctctatcttcctagtttccattttgattttgcttctatacctacacattctgcatgaaatttttctataattttctataatgtgagtgaaagcacagagtctaaatcacctttatagactaaaggcttaactcatagtatatattggctaacaactgaacatgcacgtggaatcctttctcaaagaagtcacagattctgtaaaagacttcactgagaaattgacttttgattaaatgtttgttttgtcttctccttgttattctcagtgaagcatgtttggccaccctatctaaaattgcctcatgctatcccttgtcaaacaaacactattccccttccctcttatatttttctccttaacatttattatcatctgacatacttttttttttaactttagtttaagttcaggggtacaagtgcaggtttgttacataaacttgtgtcgtggggatttgttgtatagattatttcatcacccagatattaagcctgatacccattagttatttttactaaccctctacctccttttaccctccaccctctgaaacacccagtgtatgttgttcccttccctgtgtccctgtattctcatcgtttagctcccatttataagtgagaacatgcagtgtttggttttctgttcctgtgtctgctgaggataatggcctccagctccacccatgtccctgcaaaggacacagtctcatccttttttatggctggatataattacatggtgtatatgtatcacattttcttcatccagtctatcatgatgggcatttaggttgattccatgtcttttctattgctaatagggctgcaatgaacacacatgtgcatgtgtctttataacagaataatttacatattttggggtatatacccagtaatgggattgctgcatcaaatggtatttctgtctttaggtctttgaggaattgccacactgagttccacaagggctgaactaataatttacactcccaccaacagtgtataagggttcccttttctcccaaacctcatcaacatctattggctcttgactttaataataaccattctgactggcatgagatggtatctcattgtggttttgatttgcatttctctaatgatcagtgatgttgggcattttatcatataattgttggctgcatgcatgtcttcttttgaaaaatgcctgttcatgtcctttgcccactttttaatagggttgtttgtcttttccttgtacatttgtttaggttccttatagatactgggtattagacctttgtcagatacatagtttgcaaaaatgttctcccattctgtagcttgtctgtttactctgttaatagtgtcttttgttttgtagaaactctttattgcttgactctcttccctaaaatataaaagtcccgtgaagacagaacctggcatttaggaggtatccaattgatagttgttgaacaaatccatgtcacgtacaaaatcacagagatatgcatggaagacaggaaaaatggaaggtctctactatacaccatctaagcccttttttgaatattgttttgacaataaatgagtggctgtgaacttttaagataatacactggaaaaagctttgaggggaaagtgtttatacctatgactgagtgcagatatgttttcccttgcagacaattaagtgaaggtggaagtaagcatcattttattacatataaataatctgctaagaggccactctcagcctctggtacaaggtaacttgagataggagttgcctgcgagccagccttttaccttaaaatcctgttcaggatcctgccattcataccaactgggtgaataaggctatgaagtttcaccccacaaatcatagtcaaaacagttttagctgaaaacactcaatgcagaaaaaaacagctactggccacttttttttctctgtaatagggagacatattcagcttatccaaaatgaacacattttagaaaaagttaaaaataatattggagagcgtccttctgtctaatctccattaaaattgttatgtgccctgtgcaaaagccatttatatggacagactcacacaggtttgcaggaaaatcattactctgtgtgtgtgtgtgtgtgtgtgtgcgtgtgtgtgtgtgtgtgtgtgtgcctgtattgaatttatactgcttggcacaaaaccagtctctatcaagagcaacaaaatccagtaaggttcacaatatctcagatgtgttttttcataatttaaaaataaatacacagtggttaatgtgggatagccatcacgtagcatttctatatgtggcttcaaatcctggctctaccactttaccacttgtgtgattttaagtacattctttaaccttcctgaaatttattctccttaggtgcaaaaatatggtaatcacacaaccttaaaataggattcttagggagattacatgagcgaatacatgtaaaaacatttagcaccacgatggtgatacaaagcacactcaacaatcgttggctataacagtgaatattttcatcatgaaaagagcaactaatttttctcctttctagaaattcaatcttttttggtgggagtgcaaggttgagaaaggtcccgggaagagttcgcatcttgtcattaaagccacccctgcatcattggaatatttgaactaagaatgcactatttcatattttattgattctattaactgaagaatatagcactgcaaactgtacaaaagttagaccactcttcttaatttctaatgtttaccaagtatctggtggttacaaaaacacagtctaatattacagtttatagcattatctttcataagtgactttaatcatacatgcttatactgttaatataaatgttaataattattccaaacaagaataaacatctccagattcatactgttacaaatgcacatccataacttgattttgtgccatttgggtaagtctccatcttgtcactgatggttggaaataagtgaaaaacatcctatctatgaactcactttcagtaatgaagtttttatgcctctcagtaatgaagtttttatgcctccaaggtgaatatagataagaacatcctcttttactgaaatcatcaaatatgtgaaaagaaattgacaaaggaaaagacagcttttgttctccacagtactggatgcaaatgtgaaagactgttcacttttatgaagatatacctcattacttcttaatttctttccagaaaaacagactggggatgtaaggtgtgactaaatgactagtgatatctaattttcacaagctgaacacatggcccgacactgggtatttggtcaattcacatttctaaattaattagcaaagcagtgagaaggaaatatcaaataatggaatattctcttggttcacatttggtcaaaatttcattgcctggctgagaattactaacaattaacacctgtgcatttagcctgcaaccatatttggcattatgtttggttttagcctttactggagggtggaatagcagaattatactgttaaaccactcctctaaaactgtggaaaaatgagttggtatcactgtaaggatgccctgatgacctggtgtgaaatctgcctccaaccatttgtagcttctcagggaatctgctgagctttctgacacaactccaacctgcctcagggcccttgctgtgactgcgttttcaacacttctccaagtgttgagcagagggagaactcggaagtgagaggaattactttatggtaacttttgtacatttcagaagccataacatgcagaaatctcagtgcagctgctctacttcctagatctctcagatttgtccaggagggactggcacaatcaatctttatatactaagacaagggagatacctggacaaaaagctagacatatactattgtttactgtataacaaaatggtctgttttgtttggattttccagcaattcatggctatgctataatttctttaataagtagattttaatttttagcatagttttatgtttataaagataataatgcagaaaacacagatttcccatataccgcctcatccccagtttcccctaatattaacatcttgtattattgtagaatagttgttacaattgatgaatcaatattgatacattattattgactgaagtctatagtttactttagggttcactctgtgttgtacatgctatggcttttgacaaatttataatgacatgtatccaccattatagcctcatacacaataaaatttcaggccctaaaaatcccctgtgccctgcccattcatccttcttctcctgctccctcctcccttgaaacccgtcaaccactaatatttttactgtttccatagtttttctttattcagaatgtcatatattaagaataatacagtatgtagtcttttcagattggctttttttttttctcatagcaatatgctctcaaggctcctccatgatttttcatagcttgatagctcatttcttttcatcactgactactattctattgtatgaatgtgccacagtttataccattcacccactgaaggacatcttggttgcttccaagttttggcaattatgaataaattcatgaatacatatttatgtgtaggtttttgtgtgggcataagttttcagctcaactggcaaaatgcaaaggggcatgattgcttgatagtatggtaagagtatgttttgttatgtaggaaactgtttgttcgtttgtattccaaagtggctatgccatttcgaattcccacaagcaatcaataagacttcctgttgctccatgctttttttcttgcttgtctctcaaacaaatggttgttactatggaagaggtcattaagctacatgagttctacaaaagatgtgggaaacctctgaacactcaagcaactagataacaacttttcactgtggaacattccttccccttatcattgaggttttaaacagcagtgtcaacctttgtgtactcactccatcactcttcatagctcctagcatgatccttatcttagccaggcatcaggaccctctaacctcatgcttactcttgtagcatcacttcaggctctttgttcacttggcagccaggatgccctttttatttatttattccttacttcttaaatcttgtttcattttagattcagggagtacatgtgcatgttgctatatgggcatattatgtactgctggggattgggcttctatttggatatccattacctaaatagtgaacattatactcaataggtactgagaatgcccttttaaaaatgaaaatccaaatttaaactctcttaggagatagttcaaatccttaatataatctatgaggacttacatgtgctcgtagctacctattcctccagatccatctttgaccattttctttcctgcttagtttaactcatctctattggctgccttctcattccacatgagtgttgttactaatctgccactgagcctaagcacataccatccctgatagtggaaaggtatcttctttcctacccaatcttcacctgttaaaatcatattctttcttcaggtctcctctgcactgaccttttctcaggaggccgtcggtccctgccactctgcttacactgtgtcctaaagttacttgcttcccaatactccatatacttactcctaactaactgccctccatggtgttattgcacagttcttaacttgatatttatcttcttctctagatagtatgttttgtgatggtagggttgcatctattttactcactagtttattctttggaccagtaatagtgatggggcattgtaatatattaataagtacttacttactgcatgaatggatggataataacaaacataggtggctggcaagatggccaaatacaaacagctccagtctgcagctcccagtgagatcaatgcaggtgggtgatttctgcatttccagctgaggtaccttgctcttctcactgggactggttagacagtaggtgcagcccatggagggtgagctgaagcagggtggggcatcacttcttccgggaagtacaaggggttggggaactccttcccctagccaagggaggctagggctgtgctgtaagaaacggtggattctggcccagatactatgcttttgacaaagtcttcacaacccgcagaccagagattccctcaggtgcctatgccaccagggttttgggtttcaagcacaaaactgggtggccatttgggcagacagtgagctagctgcagtttttattcatactccagtaatgcctggatgccatgatacagaaccattcactcccctggaaagggggctgaagccagggagccaagtggatcccatcctcatggagcccagcaagctaagatacgctggtttaaaattcttgccaccagcacagcagtctgaagttgacctgggacactcaagtttggtggggggagaggtgtccaccattatcaaggcttgagtaggtggttttcccctcacagtgtaaacaaagccaccaggaagtttgaactgggcagagcccaccacagctcagcaaagctgctgtagccagactgcctctctagattactcctcactggtcagggcatctctgaaagaaaggcagcagccccagtcaggggcttatagatcaaactctcatctccttgggacagagcacctgggcgaaggggtgactgtgggcgcagcttcagcagacttaaatgttcctggctgccagctgtgaatagagcagtggatctcccatcacagcactcaagctctgctaagggacagactgcctcctcaagtgggtccctgacccccatgcctctggactgggagacacctcccatcagggatcgacagacacctcatacaggagagctctagctggcatctggtgggtacccctatgggatgaggcttccagaggaggaaacaggcagcaatttttcctgttctgcagcctttgctggtaatacctaggcaaacagggcctggagtggacctccagcaaactccagcagacctgcagcagaggggcctgactgttagaaggaaaactaacaaacagaaaggaatagcatcaacatcaacaaaaaggatgtccacaaaaaactccatctgaaggtcaccaacatcaaagaccaaaggtagataaatccacgaagatgagaaaaaaacagtgcaaaaaggttgaacattccaagaaccagactgcctcttctcctccaaaggatcacaactccttgccagcaaggaaacaaaactggatggagaatgagtttgatgaactgacagaagtaggcttcagaaagtgagtagtaacaaactcctctgagctaaaggagcatgttctaacccaatgtaaagaagctaagaaccttgaaaaaagatgagaggaattgctgactagaataaccagtttagagaagaacataaatgacctaatggagctgaaaaacacagcacaagaacttcatgaagcatagataagtatcaatagtctaaccaattaagcagaagaaaggatatcagagattgaagatcaacttaatgaaataaagtgtgaagacaagattagagaaaaaagaatgaaaaggaacgaacaaagcctccaagatatatgggactatgtgaaaagaccaaacctgtgtttgattggtgtacctgaaagtgatgaggagaatgaaaccaagttggaaaacactctttaggatattatccaggagaacttctccaacctaggaagacaggccaacattcaaattcagaaaatatacaaaaacaccacaaagataatcctcaggaagagcaatcccaagacacataatcgtcagtttcaccaatgttgaaatgaaggaataaatgttaagagcagccagagagaaaggtcagattacccacaaagggaagcccatcagactaacagtggatctcttggcagaaactctacaagtcagaagatcatgggggccaatattcaacattcttaaagaaaataattgtcaacccagaatttcatatccagccaactaaacttcataagtgaaggagaaataaaatcctttacagacaagcaaatgctgagagatgttgtcatcaccaggcctgccttacaaaagctcctgaagaaagcactaaatatggcaaggaaaaaccagtaccggccactgcaaaaacatgccaaattgtaaagaccatcaatactatgaagaaactgcatcaacgaatgggcaaaataaccagctagcatcataatgacaggattaagttcacacataacaatattagccttaaatgtaaatgggctaaatgcctcaattaaaagacatagtcaggcaaattggataaagagtcaagacccatcagtgtgctgtattcaggagacccatctcatgtgcaaagacgcacataggctcaaaataaagggatggaggaagatctaccaagcaaatggaaaacagaaatcaggggttgcaatcctagtctctgataaaacagactttaaaccaacaaaggtcaaaagagacaaagaagggcattatataatggtaactggatcaatgcaacaagaagagctaactatcctaaatatataagcacccaatacaggagcacccagattcataaagcaagttctaagagaccaacaaagagacttagattcaaacgcaataatagtggaagactttaacactgcactgtcaatattagagagatcgatgagacagaaaattatcaaggatattcaggatttgaactcagctctggaccaagcggacccaatagacatctacagaactctcctccccaaatcaagagaatatacattcttctcagcaccacatcacacttattctaaaattgatcacataattggaagtaaaacacacttcagcaaatgcaaaagaatggaaatcatagcaaacagtctctcagaccacagtgcattagaactcaggattaagaaagtcactcaaaaccacacaactacatggaaactgaacaacctgctcctgaatgactactgagtaaataacaaaattaaggcagaaataaataagttgcttgaaaccaatgagaacaaagacacaacgtaccagaatctctgggacacagctaaagcagtgtttagagggagatttactaaatgcccacaggggaaagcaggaaagatctaaaatcaacacattaacatcacaattaaaagaactagaaaaggaagagcaaacaaattcaacagctagcagaagacaagaaataacttagatcagaggaaaactaaaggagatagagacatgaaaaacccttcaaaaaaatcagcgaatccaggagctggttttttgaaaagattaacaaaatagaccactacccagactaataaaaaagaaaaaaagagaagaatcaaatagactcaatagaaaatgataaaggggatatcaccactaatcccacagaaacacaaactaccatcagagaatactataaacacctctacacaaataaactagaaaatctagaagaaatggataaatttctggacacatactccctcccaagactaaacaaggaagagttcaaatccctgaatagactaataacaagttctgaaattgaggccttaattaatagcctaaccaaaaaaaaagcccaggaccagatggattcacaaccgaattctactagaggtacaccgaggagctggtaccattacttctgaaactattccaaacaatagaaaaagaggggctcctccctaactcattttatgtggccagcatcatcctgataccaaaacctggcagagacacaacaaaaaaagaaaatttcaggccagtatccctgaggaacatcaacatgaaaatcctcaataaaatactggcaaaatgaatccagcagcacatcaaaaagcttatccaccagtatcaagtcggcttcatccctgggatgcaaggctggttcaacatatgcaaatcaataaacacaatccatcacataaacagaaccagtgacaaaaaccacatgattatgtcaatagatgcagaaaaggccttcgataaaattcaacaccccttcatgctaaaaactctcaataaactaggtattgatggaacgtatctcaaaataataagttatttatgacaaactcacagccaatatcacactgaataggcaaaagctggaagcattccctttgaaaaccagtacaagacaaggatgccctctctcaccactcctattcaacatagtattggaagttctggctagggcaatcaggcaagagaaagaaataaaaggtattcaaataggtagagaggaagtaaaattgtctctgtttgcagatgacatgattgtgtctttttagaaaaccccatcatcatagcccaaaatctccttaagctgataagcaacttcagcaaaatctcaggatacaaaatcaatgtgggaaaattcacaagcattcctatacaccatgaacagacaaacagagagccaaataatgagggaactcccattcacagttgctacaaagagaataaaatacctaggaatccaacttagaagggatgtgaaggacctcttcaaggagaactacaaaccactgcccaaaaaaaaaaataagaggacacaaacaaatggaaaaacagtccatgctaatggataggaagaattatattgtgaaaatggccatatttcccaaagtaatttatagatttaatgctatccccatcaggctaccattgactttcttcaaagaattagtaaaacctactttaaaattcatatggaaccataaaagagcccatatagccaagacaatcctaaataaaaagaacaaagctggaaaatcatgctacctgactacaagctatactacaaggctgcagtaaccaaaacgcatggtactggtaccaaaacagataaatagaccaatggaacagaacagaggcctcagaaataacatcacacatctacagccatctgatctttctttgacaaacctgacaaaaacaagcaatggggaaaggatctcctatttaataaatggtgttgggaaaactggctagccatatgtagaaaactaaaactggaccccttccttacaccttatacaaaaattaactcaagatgtgttaaagatttaaatgtaagacctaaaatcataaaagccctacaacataacctaggcaatagcattcaggacataggcatgggcaaggacttcatgactaaaacaccaaaagcaatggcaacaaaagccaaaattgacaaatgggatctaattaaactaaagagcttctgcacagcaaaaggaactatcatcagagtgaacaggcaacctacagaatgggagaaaatttttgcaatctactcatctgacaaagggctaatatccagaatctacaaagaactcaaacaaatttacaaggaaaagacaaccccatcaaaaagtgggtgaaggatatgaacagacacttctcaaaagacatttatgcggccaacaaacatataaaaaaagctcatcatcactggtcattagagaaatgcaaaacaaagccacaatgagataccatctcatgccaattagaatggcgattattaaaaagtcaggaaacatgctggagagggtgtggagaaataggaatgctttcacactgttggtgggaatataaattagttaaaccattgtggaagacagtgtggcaattcctcaaggatctagtgccagaaataccatttaacccagcaatcccattactgggtatatacccaaaggattataaatcattctactgtaaagacacatgcacacatatgtttattgcagcactgttcataatagcaaagacttggaaccaaccgaaatgttcatcaatgatagactagataaaaaaatgtggcacatacacaccatggaatactatgaagccataaaaaaaggatgagttcatgtcctttgcagagacatggatgaagctggaaaccatcattctcagcaaacgaacacacgaacagaaaaccaaacaccacatgttctcacttataagtggaagttgaacaatgagaacacatggacacagggaggggaacaccatacactggggcctgtcagggagtcgggggctaggggagggatagcattaggagaaatacctaatgtagatgatgggttgatgggtgcaacaaaccaccatggcacgtgtatacctatgtaacaaacctgcacgttctacacatgtatcccagaacataaagtataataaaaaaacataaatattaccattctggatagtagttactatgaattaagagcaatttattaatgcactactgcaaacagaaacttctattatccacaaaaaatgccatttttttaatggctccagaaagctgagaaagtcctttatgatacacacttatcatatggacaaggttttcatgacttcattcctgcccacttctccagcttcataattcaccacttctacttatacatgagtctctagtaatgttaaactgcttcctaatacccacaggcatcatgctgttttgtagctccatggcattacttagtattattctactgcttgaaaagcgcactcccattgcctgacaaatcacctttgattctttggatacaccttagacctcacgtctttcaagaagccttctttgaacaccagtgcagaccaattatatctctatgccgtcacatcactctgtgtagtcctacatcatggtgcaaatgttcaacaaatgtttaatggaagaaagtgaatcacttgccaagttcaaccaacatcactggaatattttggtttatcttcctatcactcttgagactaggagtgacattattgatgggattttgttgttgttgttgttgttaactgcaatatccccagtgtattacaatgtgcctggcctggagtagccacctgacctatatttacagaaattaactgaaagatcaaggtaaaccagtattaagatgtgtcagatttgctcaagagtagtttaccaaaacaatcacagcatccattttgttcatcctagataacctaatagtttatttaaaattgaattttctgactttctgaacagctatcagaatttattccttttaggctataaaaagggtgtgttccagctgcaggctgagctgacctaagaccattgaatcaatgctcagtataaatgatgccttgcaaaaatgaccacaaaagtaagatttgtccagagtctcttggattacattctagtgtccttttcactaattgaggtaataattattcatccaatccctctttgaaacatccctgcctaccaccaactttgaccactcctttctctgagccccactacacactgtacatgtctctatcatagcacttagcaaactaaactaaaaccaattgttgaaatgtagtctcctgtttgactgaaaattccctgaatgcaagattactttattaatttctacacttcaagaatctaatccagtggctagcccatggacatatcaattaatgtttttcgaatgaatgaaccaatgaacctatgtccaaaggaattagttgagttgtagtgttattaataaatgtcataaatatataaaacaaaaaattgcaatatttgaaaacaagatataattaaccttgactctggggaaggaactgacgtttgctgaacttctatgatgtgccacacactgtgctgggcacgagggactttgtcaatgttatcttgtcacaccttcacaacaataataaatttgtaaataaaatcgccttatttttcagatgaggacacttgaatttagagaaaaggattataaatttaagataattctgatatcaaagtttcttttcctgctgttcagagaatatgacttaaagtgaaaaatactcagaatgagtgtgaatatatgaagaaagaagataaagagacttctgattaagggttagtggagtgaaaaatactctttaccatgcaaaattttattggctcagattacaaggtctccttccatccacttgactgtcccctgcccacccctctggttagatagaaatcattctgccctagagactgtggatgtcctgtcttggctatagttttccaggactgagtggcagggatagatgccttaaattaagactcttgccaaagaagactttcaaagcaatgatttcttcagtgcattttccgtttgtttatgaatttccttagtacttttattatagcacaatctattgatcttgctaaatgaatttcatagacatgacccaataaatctatttatcaatatttaattataacagcaaatggaaaaattcattttctataggatagaactctaccttgtactataacgtgtagtttctctgagtattgatgcattattctcgtcactagattagaagctttttgaaaatggaaacaaattcagcttagcttagctgcttatccccagcatctaagataatatcttgagtataacagctgccaattaaaaagagtcagtcattgaataacttaaaatatatatcatcctctaatctgtttgggaaggttctggaaatcctgataaaaatatacaggttgagataagaaataatttttcaagtttatatatatacatgaaatatgagactcagtgaaatcaaatacttctcagactatgcattgtgagggatggaacccacgttccggactctgaattatctcttttcaatttaagcatgttggaggctaggagttgtcttaatatggcataccttgaaaacccagcgaattttctatgagattttctgttttcagaaattgcaagctattatttaagctatggtagttttagacacattaacaagtgaaaattaagaagctgaaaatagcagtctttgtggttacatattaagatttctgagagttgacccacaggtctagacattttctctgcttctttatgttatacaatagcagataaacttctcgagaacgtgtaaattttattcttgtaactgtttattgtcctaggggagtgcaaggacattaataaactttagagaaaggcagttggcattcatgaaaacaaaatgcagtagtgagagaaaaatagggaaaaagagggtctatgaccaatcccacccttaccttagaggtttcttgctgattctagatcactagtttcctgctgtctgcttgcttggcatttctaagaccatgaacagtatttaccaaagtatggcgtaagggatgctgggaatatacaagattattttaggtcactattgatgaatatttttatttcaatagtcatgcatttttataattaacttatatttataaaattgctgtttttcacttagaggtggaattcctgcaattcagtagcaaaaaattaaataacctaaacaacagaggagcaaataaacatttctccaaagaaagcacactaatggccaataggtatatgaaaggaccctccatatcacaaattacggagtgatgcaaatcaaaactacaataagatatcatctcacacctgttattattatgttttaaaaagataagtgttggcaaaaatgtggagaaattagaccccttgtacactgttgggaggaatgtaaaatggtacagtagctatgaaaaacagaaataccatataatacaacaatcctacttctggatatatatctaaaagcattgtaaggaagatctcaaagagacccaccctcccatgttttttgcaacattattcactatagccaattatttccaataaatgaatgactgaagttcaggaaacagttacaacataagttgatccaaatatcttctattttaaattttttcttgcaaaatagtaaattctcttggttacagttacttaacatgctgtaactttgtaactttttagattacagaatattttcatcattttctgtctgtcacagatgctagtgacaaaattctgtgtatcatttttcttcaaaatataacacttggtacagtaagtgctaaacaaagacaaccaattatggatttattaagtgtttgttattgacaatgaatatggaaaattggaaatggattccagagatggagtcaacaatatttggtaaccagatggctgtgctagctgaccaaggagagacatcatagatggattctgggtttgctaaattagtattttaattagatagtaacatattaaaataaataagttctctaatctactcataaactaatttcatcttattgagattgcacatttgatttttacaattcaaaataaacctatcttaagatcttaagctagtcctgcttttctaacacttgagttattcattcttaataaaatcatcttatataactcgaagaaatacattgtttagttttatttttttaaatgatgatattcaccacattctcactcctgtctcatgggcttttccttcatttgcccaaagatagctgttactttaacagtgatatgaaatctctcagcttctctggcactttgtggtcagtaaattttgtctaaaaatgtagctttgccaacattcattttgctgaaaaatgaaataaaacgagttttcaggataaacgttttctgtgcccattaccttgttgtttggtttcacactggtaaaactttgtttgtccctgttgctatcatctttgccaactttctctccacatagcaatctgcaataataacttccccaggagtgagcttagtcctcagtctctgagccaaggaaatcctggaagtaggttggggcttccttcccactgactggtaaacaggatctgaaatgggtctgctgccttcacgcctgatatcctgggcaggtaggcagccccagggtgtacctaggaacaatgccacacacttgcattgacatctgtctgtgtattctgtcttcccattaatttatatctggaaaataattcaacatcctttcattttaatctcaaatctgtgaagtcaccatgtcaaaatgtcagaccgttcgggagacattgactgcgttaatactgtccttcacactactgatacactacatgcacagccagccacaggctctttcccaagatcatgaagtggtgtactcgtgtaattgataaccaaattcaaaagatataattattaattatttctatgctggagcaaccatatggcctatgttttcctgtgacatttccttttatgattgttctcccagagttacaacacttctgagcactctcgaagttagacaatcatttgtggtcatttagacaatcatttagataatcatttgtggtcaacctatttatgtccttagaaaaacctgttcaccacttttagtctcagttaaaggtattgaacactatgatttctaatgacaatttcagttttaacatttacaaaatataaggtcagcctcaagtacacagaaatgcaacaaacctaaaaaaaactttcttgaaagtaacggatgcctaatgtttacatgaaattaactttatttttggatacagaaactgacttctgcgggatctttgtgttttaatgtgcaaattgattttatgattatccaacccttactcaggtaaagaagggtaagttctgaaggtcctggaggcttgttttctcccaaatttttgtatctctttgcaagtggctagatgtgtatatcttagtcaactcaaaaacagggcaggttgatgccagcaactgaattttggagcccacctttactaaaaaggctattttctcaaccaacaaatgtctcttattacatagtagagttaatgttccctgatttcctttccaactttgttacaaatatgtgagtgtgaggggcatggggtcctgctttgctggcatttttcatggtgcctccagctggtctactcaggcacatttccctgcaggatgggaattgaaggggattctggataattcactgattctctgccatgtaatcccttgcaggaaaatactgtaatacaccatgacaagattaaagtgccactttcatggtatcagtagccattatactagggacactgaactgtttatcaatatactaaaaatgaggcagctcagtttgacaagaaaagtgttggaaaaggtctgacccctatgctaagtttcccgtgctgtgcctcagcaggcttgtcgcacagcctccaagtctgtcccttcatctaggaaatacatgcagtggatagatcagattaagtgctaaaccagtaagttatctaaacaaattgattatagaatctaggattaggaagaaggaggtcactagaggaagaaggagaaattgaatcacacatactgtgttgagacctaggtgtacctgcaacttaaagctcacactatgaaaagatttcatgtcttcaatgaagatgatacattctcataagttactgcttcttatgctcagacacagatttcattgtggatgtctcctttaacagtataatgctatcagggcacacatctaggtctcaaccttttcacagacagaggtaagagttgaattgtccctgcatgtgtagcctctacagctatgttgaagtcaagaagagtgttttttctctgggaggcttggtgctttaatccagtaggtattcaatgaacacttaaatgttgattaaaagtaatgaaattcaggactgtataacatgtattaaacatcttttatgggctaagtttttacaggtaatttcttgcttcaaaaataagaaaattgaacctcagagagtccataatgcttatgaatggaacaataattactgatttttttgaagcccaagtatagtgatctgtcctctgtactgacatgccagtatggagacaacaacaaaatagttacatgagagtcttgtacagaacattttgtgatattttttcatcatatatttagaaaataaaaaggaagggaaggagcttgtcatgattttaagcaggctcatcttggccatagatttttatcacatctaatcttctttcacatctatctatactacaatatgcatgatccatttaaacagatttaaaagacaaactgaaatttagctttaaaataactttttaaatgtcatcaagttatatttggaaactttatgagagcagttatacaatcctataattatcatgttcatgaacctttccaacaagtatacaattcatgattacaatgtttttgaaagatagatgtgaaaatgaataaactagaataaagacagttgtgaaatttcatctagtgaaaatagatttttaaaattcatgtattcagagagtattttttgaagcaagacagtttgagtctggctaaatgattgaaatcacaagaattttttgaaatgtttctgtattttatgttattttattatttgtactttagcacaattataaaatctatttttattataatatgtggcagaatagagtgaaaaaagattatataaactggtaacttaagaaacacatttcaacatttgtgcaataaataaatatttaataaatgttgtgggaaaatcaatgatcagaaccacagaaaaatgttgtcttcagattacagaattgcacttgaaatgctgcatttcctaaattttgttataattaaatatgtatacacatccaagcctttatttaaaactgtcccatctattgtaggaaaagctgggtaaaaaatgtattaagaggtctctttaattccaccatctgcttctgcaaatgtgaagagctctgagttcatgattcttaatcagtccatttaaacatgaacaactatttcacagttaagaaagcaatgcaaatacctgtggaatacttcttctcttaatgttgaatgtttaaatcacataaagtggtcaatggatatgccctgatccttccttccacctcatctaacacagtcactcttatacatctctgtttaccaatcttgacattatcctgcccaaaaaacttccatggcttcttacggactactgaatgaaatcatgacattttgtcattgctttcaacactttccctaatgaaatctcaatactcatgcccagctagccttctacaaatacccaatgctccagtcctgaacctttcattgaaatcaactgctcttggctcttggtcacgcgtttcttacactctcttcttcgcctatctttacatgctccaattccagatgtcatccaatgtgtggctaaaatgctgccttggtcatgaagtatatttttcactttccattagaatacatttctatatttccaaaatttccataaaattaaaattacgtatttcatagcacatagcattgtttacattgtcattttatatcctttactagactataagcacttgggcttataaatcctatgtttgctttctgtaaccttcgtagagctagaactactattctctccttggcatatggtaaacaagacttacaaaaatctcactaatgcgtaattcttatgcattcttcactcgaattcaccaaatgttgacatattacataaattagtacagtttttcaacaccagggaacaccatttctaaactattaactaatccattgacctttttcaaagtttatcaattgccccactaaagtattctataggcaaaaatcttattcaggatcatatactccatatacttattgtatcatcttacatttattttaatttaggacagattttcagcctttctttgtttttgatgactttgtgaagaataatggctgatatggttaggctttgtgtccctaccaaaatctcgtcttgaattgtaattcccacgtggggagggtggaaagtgtttggattatgggggcgggttgtcccatgttgttctcgtgatcacgagtgaattctcacgagactggatggttttataagtgtttggcaagttcctccttcgctcacacttctcttttctgccaccttgtgaagaaggtacttgcttctacttacatcatgattgtcggtttcctgaggcctccccagccatgtggaactgtgggtcaattaaacctctttcctttataaattacccagtcttgggcaattgttcatagcagtgtgagaatgggctaatacactggctaattgttttacagaatatagcacaatttggtttgttccatattactcctgattatatttaatatgtagattaggcatttatagtaagaacacaacagaagttattttgagacttcttgggacattatataaagaagctcatgacactgatttgtctcattatgttagtgttcaatttgatcacttggctaacattacttttatcgagtttctccagtataagtttactatttttactttgtaatggctaagtacattgtagaatactttcagaatatgaaaatatcctatttctcattacttccacacactaattttagcagttattgattactgaaactattattttggtgtttaccacaggataatttttttccatctttttaactttttctatactcactaattcaaattctgccatggggaataatagctttctattgcctcccttatttctttatatttagttatttacctttcttattattgactcatggatgtttgttcaactaatattttaataagactattaaatatatcttggagcagtacatatatttttagagaatatatgtttaagattcagttgggtactgttctcagtattccacttgtttcaactattaattgtcatagtaaccataagaagttggtagtgttaccatactcatttcaaagataaggaagttgagacacaggagaattaggtaaccttcccacattactccaccagagtgacagagttgagattaggacctcagcaatctggctttagagtccatgctgttaacaaaaataataaatttaatctaataaggcttcgtgagactcaggagtagtttttctctctctcatcattagcacatcttcaaccaaagccagtatgtgcacaaggcatgctcagatctcagcatcatgggaccaggagatggtgaaggaagctaggattaagcagaatttgcttccaagagtaaaggatttggcaggttggaggaagattatctagccacagaggtaagtcctagtaaggatggtggagcaatctgagatataccagaatacggtcccatcatagcccaaatgggatctgttggtggtatcttcctgctatgttcactgctatagtagattaggattgtatactatgtgttcaggatagaagaacagctttacctgtagcaattaattagtcaaatatagaaggcagacaaagagttgggaaactaggcggcaaccacagcttaagaggagttcactggtaggtaattaaatgatatttatgatgaaaataacaaatatcagcgtggctagtcaggaccagctgacactactggtctggaataccatgaagataatcaggcaaactacagagtacagaaatgaagcaaaaattcacttttgcaactggaccagtacagtagggagaatgaaatattgcaacttggttgcaatagggcacctgcttcggtaggtgtagcaacacagtaatctcactcccaggtttaggcctacagtgattagacttcttgctaaacttcatttgatggggctgagacttctgacattcttattgcttctgccaggaaagtctttacagttccaactcaaaaactgtaaatatttgaacctatacatgggattcctttgacatttattcttacattcatgcattcactccttatcaaacacatacaatgtgccatgaaaatgtgcaggggttagaccatgaccaagacataatctatactatagtatattaatctataccatcaagtaatttattttctagtaaggtagttcttcaataatatatgcaagacataatctatactatactaatctatactatcaagtaatttattttctagtgaggtagttctctaataagtactgagcgcacatggaaagcagtagtggctcaaagttctggtggtgtgtgtgggtgggagggttaagagaggatttcctggaggaaatagatccacctgtgaggataatggaggcagagaaaggtagacaagcagcaacaggaacatacacctgtttaataaaagcaaacacatttaaaacaatatggaagtggcccagcaagatatctaccccagtaaaagaaattcatgaaaaccacccccactgccatctgattaccatgttcagctgcggtgaagtggaaggaaggttaggctgtgccacagatatttatagactcttaaatagctgtaaaagcgtggcattgaatgacatttgtgtaacccctttcctaataatagggattagagctgcagaagatctaggtggtcatgtagttcaatctctgatcatttctaattctagaaaggtgtaataataattatttacatttgcataatactttataaagcactttcatagccattatcttatttgctcctcaaaacaattttctgaaataagcaggaataatatcatcaaaattataaaaaacaattttctgaaataagcaggaataatattatcaaaattattattgcctggaaaaggaaacttaagacggtaggaaatttacattaatggctagagatgataacactagggagtggagtcaaatctgggatccaaatttctaacctcttatccaatgttctttccataataccacctgctttaatttgctaaccaagggagagctgatacttagcaactgggagtctcatatcctctcttggtgactctccaggtatttattgttcctttctgtgaagagcctatgaggagagggagaaatcatgttacacagagaaagtccttcaaagtacgacctctctggaacacctatcttagtttctctttggcagtttgtagaaaaggaatgtttttgtccttacctcaggctttctatttgagaatctgtgggtgtaaggaatgcatttttaacaagcccatttgggaatattgatgccatctgggaagtgtaaaagtaattacagaactgcttctacagagtgttggtaggctctaccatctaagaccccctaccccagtcagaatagatgaagcagaaacaagacgaggaggaagctccagtcagctcctcttcatgcagaaatggcatcaaggactagtattagagaggatatagcccccgacaaattctatcaacttctgaaaagatgcatttaaaaacagcgagattgctatgaaaatataccttcaaggagactctcctaggctctccttccaacagaattgccatttagccctgttttatagaaaccccatgtctgttcttgcatgggctattacagcaggacccacagttttaagggaaaagggtgatggaccatctcacttcttctgtaagaatccagtaggcaagtaaatgtgtaaagctctgaggaaaatatcaagagaaaatatctactcaagttgccactacttggcaccaaactgggtacacgatagacttcatgttatgttcaggttttactagtacaagattctagggggaaggggaaagtggtgagcagatgatattttcataacctgagtataatggaactttatctcaatctcagtttccaaacatctaggacatccacacttctcatgccaaataatttgcctcactgctggattaagttcagggtgactggaaatgacagagccaggcctttctcataacgaccctcaatggtgacctcctcatagaaggcattgtatcttttcttctgtggactctcacaggctgaatgggcttgcaggattcagagccagtgagagatatgattacaaagcctcaggataagccttaggccattttaccaggatccaaattatcagtgaaccaaacagcctggctggaggagatttgaggcaaatacaatcacattgcatcgtatcagaaacctaataacaattttccacaagtagtcactaaccaaaaatggcatattgtagccccataagcagcagatacttctaattagctctagatgattgaccacacatacagatttggctatacatgctagaagtaattgcagttaattgtcaatggtaatgaagcttgtattgactagttaggcaaacatcaaaagcaaaattcaaagctgtttcaagaaaatattgaaatgatacaaaggttgctgaacaaggcaactgtccacagatttgtgaagttaatgtaagaagcatactagtaaggttccatcctatatcacaattttaagggcagattaatcatatacctcccatttcctaaggtctaaatttaaaaatctaggaccatagttagataaataactttgcgtcttctttcagtggaaagccaaatgagagcaatttgatttacattaagtattttcaagtgaataatattaatgaaaggccagagggaaaaaatgacaggaaagaaaattataccgaggcctaatagcaatacattacaaacagacagggagacattaacagctagacattctgtgcagcaaaccattatttatgacaaggtcacctttgctttaagtagatattcagcagtcattgcataataggctagtggggacttcagaaatcttaaaacctcgcccctttattttatagcttttgcaactgaagcccaggagtggggaatggaagagaaggaaaggaacaagtatcgagcacctatggtatgaaaatgcacatttctatgcctttcacacaccccacctttcaatccctacatgaaccttgaaaggcaggtgtcactggtctcaagtcatgctttaggaaattaacgcttcacagcagaaatggtagggcgtgtcctactgcaccatgatgccttcctaaaaagaaaataaaggtggctcatttggtgaaccagcactgctctggtattagaatccaatcctgactcaggaatcaacccataacaactctatcagaagtactttcgagaatctaaaaaataatatccaagaaccatttaaaaagtgaaaacatttggcaaacactgagtttaaggttgaggtaagtcctacatactccagaatatgtatctatatgcttactcagaaataaggaagtctagtagagtacattgattaaaaatgatgactgacattgattgaagagagagtgtatgcctgtctgtatactagactattttaattgatactcaattataattgttatattttacacatagcaaataaatataccgtagaattgttaagtgacttcacaagttatatagtcaagaaatggaaaagccagattttaaacccagggttatggtcacccaaagcttttgctttttctctactactcacttctcctaatttttttttctttttatttttctttttttttttttctgagacagaatcttgttctgttctatcacccaggctggagtgcagtggtacaatcacagctcactgcaacctcaacccttcgggctcaatccacccacccacctcagcctcagcctcccaagtagatgggactacaggcacgtgccaccccacctagctaatattgtattttttgtagagacagggtttcaccattgttcccaggctggtcttaaactcctgagatcaagctatccacctgtctcagcctccccaagtgcagggattacaggcatgagccaccatgtccagcctgatactctttactcttcactataacattcttaggctgagcagttcgtttggaccttggccttgtagatcttgtaacttctatcttttattttcttcatattttgtaacttcaaacttttatgtttcttttctgtaccagtcttgtgtctccaaaaagatggaaaacttaagtgtctctctatttaattccaacacccagtgtgagacctcacagattgttggcagagaaaatgtcaatagtgatatctgtgagaggagctgcttttggtaggctgtagtgatagagcctctagcagccaatccacctcagcgtttttattcaatcactttttgctcatgctgagaaattcctgaggcattcaagaagtaggcatttctgaaaagccccatctactacttaagtgaccttgggaatattatttagtccgtctgtgtcttggttccctcatctttaaaacgaacctaagatcacatatctcagaagcttgagtaaaaattagaagaaataattctttgttgagtgactggcatgtaataagcatgcaataaatgttgatcattatagccccctttggttccaacctttgctaatcacccttgaataatccttagattgataacccttggaatccctctgctcctccttgacctctttaacacggcccaacaaacagcttaactcaggtgttgtctctctaggaatagcatcatcattattcttactcccacagctctggcttggttaataatacattttttttgtgtgtttcctctgaaatatatatagacttccacaataacttctacaacactgtaaagtagtttttcccctttaattttcctttttccttctactgggcaataatatgcttgacaacagggatggtgcctaaggtatctttgtttagcctgattctagcctagtaagtgtcacatttgtgctgaattaatcccagatatcatatacaaacaaacaaattattcctatactggagactatagtggacaatttattttcttgaggcagaaatgggattcaatttggcctcaatgattctggagacaaaaaaaaaaaaataagcttaagccaacatctttttccaatatacgagctgatttattttcacctgcattcatcatatactaactgcttattaaatgaaaataaattatctgagtttctgacttcttgctatagccaaagatagagactgttaatatgctagaatagctattttctatatattcacacatcaaagatggttgtaatcagaaaaaaagtagcatgtaagaagttgggaataaagaagtatggctgctgttgccaatatcaaaacttaaaaatttaatggagtcaagaaacctaaccataaaaatccaaaaatcaatgaagcatatcgtttagaccttgtgtttctttctgaaactttcaggtatacagaatatccaatttaaacagaatttttaaaaatgtcatatattattttttactttgaaatgaacaagattcacaaagtaagtatactgtgagtataatattgtcattgcataaagaagacaccccgttatccaattattttaatgagataatattccatttctaacaaacaaccttctgtttctcactaaaaccaaaggctctcaacctggtttcccattttctggtagtgacgagttaaggcttcaaaactgtttccaaaaacacagctcatttttccacaaactctaatgatttattcagatgcatgtggttttcaccatgtcaatgtgaatacagcataacaagctgggtaacacattccttagacttaagcattggagataaacagattatgactgaaactgacctaagacttggagtagatatagaacgaagataaatgcctgaatttagataaacatgaagcttcttacttatgttcctgttaaactaccagatcactagaccccactagaatatttctgaactctaggctgtacgtgtacctctaaattttaaaaagcctctctagatgatagatacacacagtaaagtgtaaggactacaaagtgatttcctaaaaatggaaaggtgtcaagtagttcttccttatctaacatgcaggtagataagaaaaattcactagaatatacatactttacttctcagattttgtggtaagaaaaagtgagtgcagtttgtctaaccggctatccaggaaaaaaaaaaaaagatcacgtaacgaggagtaacacagaataatggactaaaaacatatagaaataccattttaatagttgttcaaccaccttctgcttagaaactgatttgtgttattttttattaaaatcaattattcattgacccagagggccaattagaagcagctgtggtctgcagcactcatggagaggaatataaaagggtgagtgaattcagcaccttcgactgaaatatccaggttcttacattgggattgactaggcaaacaacctgacccacgaagaaggaagaaaagtcagaggtgaagtatgttccactctggagtagcagagagccaaaggaacccccatccccaggcaagggaagcagtaagtgattgtacaaccctgcccaggaaaccacacctctcccatggatctttgcaacccatggatcaaaatatcccctatgaggtgatccccaccggggctttgggtctgataaacagagttgtgtggagtctcagcagagcagccactcaggcacacacagagactgggagttttacatactccagccctgggattcctagcaaggcatgaaagccaaccatagctatacctaggaagggagcttaatccagggagccaagcagtattgttctgcaggccctacttccatgtcacctcacaagttaagaaccactggcttggaatcctaggcagccaacagcagtgggttgaggtcttcctgagatgggtctgagttcccagggggaggggtagccatcatctctgtggttcagttgagtcagctgctccagcctgcaggctgtggagaacataagtggtctggatgagaaagggttcaccgcaatgcagtgtacctgctctaccagaaagcatccagactgcttctctgggcaggtccctgatcccgttcctcctgactgaatgagaccttccaatggaggtctccagccacctcctacaggtgaatgcaggctggcaacaggtcagtacccccccaggaccaagcttccagaaaagacactggatgccatcttgctatttcacagccttcactggtgatacctccaggtatgggaaaaactgaggcaactgggttctggagtggacccccagcaaaccacagcagccctacagtagagtggcctgattgttaaaaacaaccaaaccgaaaacaacaacaataacatcaacagagaaaccccacagaaaccccattcaaaggtcaacaacctcaaaagtcaaaggtagatcagcccacaaagatgagaaagaatcaacacaaaaatgctgaaaactcaaaaagccaaagtacctcttctcctctaaatgactacaacacctctcgagcaaggacccagaactggactgaggctgagatggctgaattgacagaagtaggcttcaaaaggtgggtaataacgaacttcactgaactaaaggagcatgttgtaacctaatgctaagaaggaaaaagtgataaaacaataaaggagctgatagccagaatggccagtttagagagaaacataactgatgtaatggagataaaaaacacaagagaacttcacaacgcactcacaagtatcaatagcaaaatagaccaagtggaggaaagaatctcagaccttgaaaactatctttctgaaatttgacagacagacaagattagataaaaaagaattaaaataaattaacaaaacctctgagaaatatgggattatgtaaaaagactaaacttatgacagattggggtaccaaaaagaggtggggaaagtggaaccaagtaggaagacatacttcatggtatcattcatgagaacttccccaacctagcaaggcaggccaacattcaaattcaggaaatacagagaaacccagtaagatactccacaaaaatatcaagccatagacacataatcattagattctcacaggttgaaatggaagaaaaaatattaaggacagccggagagaaaggccaggtcacttacaaaggaaaacctattagactaacagtggacctctcagcagaaaccctacaagccagaagagattggggccaatattcaacattcttaaaggaaagaaattccaacccagagtttcatatctggacaaactaaactttataagtaaggagaatttttttttgagacaagcaaatgctgagggaattcttcaccatgaggcctgccttgcaagagctcctgaaggaagcactaaatatggaaaggaaaaaccgttgccagctactacaaaaacacactgaagtacacagaccagtgacactatgaaggaaccacacaaacaagtctgaaaaataaccagctagcataatgatgatagaatcaaattcacatatatcaatactaaccttaaatgtaaatgggctaaatgacccaattaaaagacacagaatgaaaagctggacgaagagccaagacccattgtaatgctgtctttaagagacccatctcacatgcaaagacacacacaggatcaaaacaaaaggatggaggaaaagggatagcaagaaaatagaaaacagaaaaaagaagtggttgcaatcctagattctgacaaaacagattttaaccaacaaagatcaaaaatgacaaataagggcattacataatggtaaagtcttcaattcaacaagaagagctaactatcctaaatatatatgcacccaatgcaagagcacctggattcataaagcaagttcttagagacctccaaagagacttagactcccacataataataatgggaaactttaacattccactgacaatattagatcattgggatagaaaattaacaaagatatgcaggatctaaacttagctctggatcaagtggccctgatagatatctacagaattctccacccaaattcaatagaatatacattcttaccaccacacatcactttaaaattgatctcataattgggagtaaaacactcctcagtgaatgcaaaagaacttaaatcataacaaacagtctctcagatcacagcacaaattagaactcaatattaagaaattcactgaaaaccacacacctacatgaaaattgaacaacctcttccagaatgactcttgggtaaataatgaaattaaggcagacatcaaaaagtttgttgaaactaatgagtataaagaggcatctctgggatgctgtaaggcatggttaagagggaaatttatagcactcaatgcccacatcaaaaactagaaagatcacaagttagaaacttcacatctcaactaaaagaactagagaaacaagaggaaagaaacagaactagagaaacaagaggaaacaaaccccaaagatagcagaagccaaaaaaaaaaaaaaaaaaaaaaacaaagaacaaaatcagagtggaaataaaggaaatagagacatgcaaaacccatcaagaaatgaacaaatccaggagctgttcttttgaaaaaattaataaaacagaccactagctagattaaaaagaaggaaaaagagaagaatcaaataaatacaatcagaaaggataaggtgcatattaccacttaccccataggaatttaaacaaccatcagagaatattataaacacctctatgcacataaactagaaaatctagaagaaaccgatacatttctggacacatacaccctctcaagactgaaccggggagaaactgaatccctgaatagactaataatgagttctgaaattgagggagtaataaatagcctaccaaccaacaaaagctcaggaccagacagattcacagctgaattctaccagaggtacaaagaagagctggtactatttctactgaaactattccaaacaattgaaagggagtgactccccgttaagtcattctatgaggccagcatcatcctgacaccaaaacctggcagagatacaacaaaggaaagttcaggccaatatccttgttgaacatgaatgcaaaaatcctcaataaaatactggcagactgaatccagcagcacatcaaaaagcttatccaccataatcgagttcgcttcattctcaggatgcaaggttgtttcaacatatgcaaatcaataaatgtaattcatcacataaacagaactaaagacaaaaaccacacgattatccaaatagatgcagaaaaggcctgtgataaaatccaacatcccttcatattaaaaactctcaataaactaggtattgaaggaacatacctcaaaataataaaagctatatatgacaaatctacagtcaatatcatactgaatgtgcaaaagctggaagcagttccctttaaaactggccacaagacaatgatgccctctctcacacctcctattaaacatagtattgaaagttctggccagggcaatcaggcaagagaaataaataaatggtattcaaataggaagagaaaaagtcaaattatctttgtttgcagatgatgtgatcctatatatagacaaccccatagtctcagcacaaaagtttattaaggtgagaagcaacatcagcaaagtctcaggatataaagtcaaagtgcaaaaattgctagcattcatatataccaacaacaggcgagccagaagccaatcatgaatgaactcccattcacaattgctacaaaaagaataaaatacataggaatacagttaacatgggaagtgaaggacctcttcaaggagaactacaaaacactgctcaaataaatgagagaggacacaaacaaatggagaaacattccatgctcatggataggaataatcaatattgtgaaaatggccatactgcccaaagtaatttatggattcaattatattctcattaaactacctttgccatttttcacagaattagagaaaatattttaaatttcatatgaaaccaaaaaagagcccaaatgggcaagacagtgctaagcaaaaaggacaaagctgaaggcatcatgctaccttacctgacttcaaactgtaatacaagagtacagtaaccaaagcagcatactactggtccaagaacagacacataaaccaatggaacagaagagagaactcagaaataagactgcacacttacaactatctaatctttgacaaacctgacaaaaaacagtaatggtgaaaagatttcttatttaataaatggtgctcaaagaacaggttagctatatccagaaaattgaaactggaccccttccttacaccatatgcaaaaattaattcaagatggattaaagaattaagtgtaaaactcaaaactataaaaaccctagaaaaacatctaggcaataccattcaggacagaggcatgagcaaatatttcatgatgaaatcaccaaaagcaattgcaacaaaagcaaaaattgacaaatagtatttaattaaactaaagagcttcttcagagcaaaataaactatcagactgaacagacaacctacagattgggggaaattttctgcaatctatccatctgacaaaaatcttatatccagattctacaaggaacttaaacaaatttatgagaaaaaacaaccccatcaaaaactgggcaaaggacatgaacagacatttctcaaaagaatacatacatgtggccaataaacatatgaaaaaagctcagtattactgatcattagataaatgtaaatcaaaaccacaatgagataccatctcacaccagtcagtatggtgattattaaaaagtcaaaaaataacagatgatggcgagatcgttggtagaaatgtacattagttcaaccattgtggaagacagtgtggcaattccataaagacctagaggcagaaatatcatttgacccagcaatcccattactaggtacatactcaaaggaatataaaccattatattataaagatacatgcatgcatatattcattgaagcactattcacagtagcaaagacatggaatcaacctaaatccccatcaatgataggctggataaagaaaatgtgttacatagacactgtattagtccattttcacactgatgatataggcattcccgagactgagcaatttacaaaagaaaaaggtttactggcctcacatttccacatggctgaggaggcctcacaattatggcagaagatgaaaggcacgtctcacattgcagcagacaagaaaaaagagcttgagcagggaaactcccgtttttaaaaacatcagatctcatgagacttatgcactatcacaaaaacagcacgggaaagacctgcccccatgattcaattatctcctgctgggtccctcccacaacacgtgggaattatgggaactacaagatgagatttgggtagagacagagaaccaaaccatatcatacaccatggaatactatgtaggcaccaaaaggaataagatcatgtccttttcagggacatggatggatttggaaaccattatcctcagcaaattaatgcaggaacagaaaaccaaacatcacctgttctgacttataaatgggagctgagtgatgagaacactggacacagggaggggagcaacacacactgggtcctgtcagggaatgctggggaggttggtggagggattgctaatggatgcaaggcttattacctaggtgatgggaagatctgtacagcaaaccaccatggcacttgtttacctatataacgaacctgcccatcctgctcctgtactcctgaacttaaaataaaagttgaagaagaaaattaattattcattataatgtaggtatattgactctatcaatcaggtgtggcaggaaaacaacattgaatattctaccagaatggaagggaaccaatactcaaaggtaggcacttgaatatacatctgagattctcaaaggtggtcattacactcccagatgtatccttatcaattcctacattttctataaaaaatttacagttattgggtattacattttttgagaattataagtgcatatgtgagggtctgtatgtatctgtgttcatacatattaactatcatcatcatcatatttttccacctttttatcccctcctaaattcaaagatggggaaactcaaactataacttgccaaagtctgacatcaaattctgcagttatactacagttggggttggtctgttctccaaatcaattgtctctgtgctctgcccaagtgctcctaaagacttcagcttatttttgggtcatcactcataggctgtgcagctctgaacaattttacaacacttctgtaggccttgctctcctcatatgcaaaacagagatatatagtccccactttctctacagaattactgagattcaaatgaaatattatattgaagaacactctgtaatcctgctaaacactagagaaatataatggattaacaatccttataagaaactgaagcaaatgtgtatttagatgtttcaataaggcatttggaaatagaagatatctcatcaaagacaagagcttggggattctcaagagctcaaattgtaactagcttctcccaatagtttcagaaaacagagtctcagagaaggtacaagatgccgtaaattaatatatctgaaatgggaaaaaacataaagtagaacgacttggtcaatattaacatgaacttgaccaaattaattttttcatataaagttatggtttaaagatgagagctaccatatctgtgtaggttaggaagagtttttaatcatatggtaggaaaaaattgaatttctttaagtgaacagtgtcctatcacaatggaaatgtaagtacctagaaaatcagtattttcattttatatttacattgcaataacagatgttagcatgattttgttgcaaactctctatatccacccctgctaagacaaacataattaaaataatttatggaattgtagtatgcctaagcagtttttgagttagagacacagcaaattttttctatgcccaaagatggcctctatgatctttaagtagttctgatatttaccaggacccatttgcctccaaacagagaattaaataattttgaatttagaagctgcccttgagaatattgaatctggcacttttattgtcaaggtgagaattttctaccttagggaatgtgaggatttacacagagtcacacaggaaatggatgccaaaagtaggatactgtgccaggttttctaactacaggtccagtgatgttttccctaaatttcttactaaaacaaaagccaaaaaaatatgactctacaaaaacaaacagaggttgggactgattgtcctcaccatgaacaaggcttatatttacctctttgtatctgctcctagcagccattttctgtctctacattctacccatctagggattggtgatccataaatttttgcctccaatagacatggaaacagccttactttagcattctaacagtctgactgtgtttcgtgttattccagtttcatcttcaataaaattgccatttagaataaagaaatactagtcatgagtggtcataaatggaagagatcatataaatcatgtatttcaatactcaaatttacagatgacagactagaacccagagaaatactccatccaaagatagaaaatcagtagaagagtctacattataattcaagattttagggtctcagatcttttcattttatacatctgtgctgtcatattcagtcagcaagagttcactaggcagttattcacatggcatttgtagttataaaataagagataagacatcagcatgacaagattttataaaaaatataaagtcgaattaatatgtctcatatagtactatatgattttttgagtttctataaaatgtaaatgatgaatacatacaaaaaattatatagcaactatgttatataaactctaaactataaattataaactataactttgttgtataaactataaactataaattatacattgtatattacacattaaaatcagcaaaattgaagataggacaatggaaattattgagtctgaggaacaaaaagtaaaaaggtaggagaagagtaaaaagataagggacctatctgtaggacaatatcaagtaggataacctatgtactgtggcagtcccagaagaataagagaaaggatgacagagaatatgtgaagaacaaatggctgaaaacttcacacatttgatgaaagacatgaatataaatatctaagaagctcaatgaactccaattaaatggaactcaaaaaactcacaccaagatacattaaaatcaaactttttaaagacaaacacaaagagaaaatcttgaaaacaatcagaaataagtggctcatcacatgcaaggggtcctcaaaaataatatgaacagatttttcctccagaaatattcgaggccaggagctggggaaaatatacattcaaagcagtcaaaggaaaaaaaaccgatctgtcaaatgagaattccatatctggcaaaaatgtcctttgaaagttcgggagatacactgcaagcttccctcgggactgcagccaccctccacatcattttgccagtgcacatgtatgcaggtagatttttgcattccctgtcctgctagcacatgtgtgcatgtgcactctgccatgcctctgctgctggtggaatgcactccaccccacttcccctaccctactgccattgcagttggagcctttgtgaacacagagcctgccagcctcacccccaccaatgctgtgctcctgcaacaacactgccattagagtgaaactagtatggatgacggtggaaccacccctgcctgctctgagcagccacagagagagcacacagacttgtgcccaccagtgtctcacccccatcaatgtcccacccccctgctaacaccaccaccagtggaaccacaaacacagtcaccaataagggatgtcctcctccagttacgctgtctcccccactgctacgaatgcaatacagaggcaggaaccttggcacccactagcaccctgctgcagtcaatgagtgtgaaccccaccatgctacctctgccactggcacatgtgaacaagaatggatcctgctgccatagccctacaaaatgctttggcacctcccattgatgtttagggaccagtggtccaagagcaccatggcttccccaaccgcccaccgattgtagttggtttctaaccttgaggagccagagaggaaagtcagactcgcaagtcccctagagtttgagggcacagtccaggagatggaagctgagccttgccccactaaaatctcccagaaataaagccaatcaactgaacccaccttataccacaatcaaatcctcaaataaaaataacaaaaaccaatccaaaggacagaaacttcaaagattgaaggaacaccagcctacaaagatgagaaagaacaagcacaagaactctaagtcagaaaggcagagtgccttctttcctgcaaatcactgcactacctctccagcaaagtgttctcaatcaggctgagatgtctgaaattacagtagtatttgaaattgggtaggaatgaagatcactgagaggcagtagtacactgaagcccaatccaaggaagctaagaatcacagtaaaatgatgcatgagttgacagacaaaatggccagtatagaaaagtatgtaaccaacccaatagacgtggaagacacactacaagaatttcataatgcaattgcaagtactatcaagtaataagcaaaatagaccatactgaagaaagaacctcagagctttaagactggctttctgaaataagacagtcagagaagaatagagaaaaaaaaataaaaaggaacaaacaaaacttcagaaaaatatgagattatgtaaagggaccaaatctaagattcattggtgttctcgaaagcgttggggagaatggaatcaacttggaaagcatatttcaggatatcattcataagaacttttacaacctagccagagaggcaaatgtttatattcaggaaatgcagaaaactccagtaagattcttcacaagaagatcatcccgaagacacataatctcagaatctccaaggttaaactggaagaataaatattagtggcagctggagagaaagctcaggtcacttacaaagggaaatccatcatgctaacagtagacctctcagcagaaaccctacaagccagaagagattgaagccaacattcttacagaaaagaaattcgaacccagaatttcatatctggccaaactaagcttcatacatgaaggagaaataaggttattttcacacaagcaaatactgagggaacctgttaccaccaaacctgccttacaactcccaaagaaagaactaaatatagaacggaaacatcattaccatccactacaaaaacacactgaagtacacagaccagtgacactataaagcaaccaaacaagtctacataataaccagctaacatcatgatgacaagatcaaatccacacatatcaatactcatcttggatgtaaatgggctaaatctcccaattaaagacacagggtagcaagctagattaagaagcaagacccaatgtacggtctcttcaggagacccatctcacaggcaatgacacacaaaggttcaaaattaagggacagagaaaaatctaccaagcaaacagaaaacagaaaaaaagcaggcattgcaatcctaatttcagacaaaacagaatttaaaccaacaaacatcaaaaagaacaaagaagggaattacataatggtaaagggttcaattcaacaagaagagctaactatcctaaatatatatgtactaaatacaagagcaccctgattcataaagcaagttcttagggacctacaaagggacttagattcccacacaataatagtgggagatttcagcacctcactgacagtattagacagctcactgaggcagaaaattaacaaagatatccaggatctaaaatcagcactgaattaaatagacctgacagacatctacagaactctccaccccaaaacaaaggaatatatattctttgattgccacatggtacatattttaaaactgaccacataatcagacataaaacacccctcagcaaatgcaaaagaactgaaattataacaactactctctcagaccacaacaaaatcaaattagaaatcaagactaagaaatgcactcaaaaccatacaattacatggaaattgaataatgtgctcctgaatgactttggggtaaataatgaaattaaggcagaaatcaagaagttctttgaaactaatgggaacaaagatgcaacataccagaatttctgagacaaactaaggcaatgttaaggaaatttatagcactaaatacccacatcaaaaagttagaaagatttcaatttaataacctaacatcaaaactaaaataactagagaatcaacagcaaaccaatcccaaagctagcagaagacaagaaataactaaaatcagagctgaactgaaggaaattaagaaacaaacaaacattcaaaagatcaatgaattggggagttggttttttcagaaatattataaaatagactgctagctagactaataaagagaagatctaaataaataaaattagaaatgacaaaggtgattttaccacggaccccatagaaatacaagtaaccaccagaaaatattgtgaatgcctctatgcacacaaactagaaaatctagaggaaatgggtaaattcttggatacatgtactctgctaagactgaaccgggaataaattgactccctgaacagaccaataacaagctctgaaattgaatcagttataaatagcctaccaaccaaaacaattctcagtgccatatggattcacagccaaattctactagatgtacaaaaaagagctggtatcatttctgctgaaactatttcaaaaaattgaggagggaatcctgcctaactcattctacaaagccaacatcatcttgataccaaaatctcacagagatacaacaaaaaaagaaaacttcaggccaatacccttcatgaacattgatgcaaaaatcctcaacaaaatactagcaaaccaaatccagcagctcatcaaaaagcttatccgtcatgatcaagtaggcgttatctctgggctgcaaggttggttcaagggatgcaaaccaataaacatgatgagccacataaacagaactaaagccaaaaaccacatgattatttcaatagatgcagaaaagtctcaaaaaatgcaatactgcttcatgttaaaaaacccttaataaactagttattgaaggaacataaaacaataagagtcatctatgacaaacccacagccaacaccatactgactgggtaaaagctggaagcatttgctttgaaaatcagcacaagatgaggatgccctctctcaccactcctattcaccatagtattcgaagtcctggccagagaaatcgggcaacagaaagaaataaagggcatccaagtaggaagagaggaagtcaaactatccctgtgtacagattatatgattctatacctagaaaaccccatagtcttggcccaacagctccttaagctgataaacaacttcatcaaaattttaggctacaaaaccaacattaaaatgttcactagtattcctaaacaccaacaaccatcaaaccaagagccaaatcagaaagacattcccattcacaacttctcccttaaaaataaaataactaggaatacagctaaccaggaatgtgaaagatctctacaaggagaattacaaaacactgctcaaagaaatcagagatgacacaaacaaatgaaaaatcattccatgttgatgaataagaagaatcaacatcattaaaatgaccagactgtccaaagtaatttatagattcaatgctattcctatcaaactatcaatgatactcttcacagaactagaaaaaactattttaaaattcatctggaaccaaaaaaaggttccgaatagccaagacaattccaagcaaaaggaacaaagccagagacatcacactacctgacttccagctatactacaggactacagtaaccaaaaaagcatggtactggtacacagacacatagatcaacagaacataatagaggacccagaaataatgccacacttacaaccatctgatctttgagaaagctgaaaaaaagtaatggagaaaggaccctctattcaatgaatggtactgggatagctggctagccatatgcagaagattcaaactgttcccctttctcaagccatatacaaaaatcaactcaagatggattaaatacttaaatgtaaaaccccaaaaaccttggaatacaacctaggtaataccattctggacataggaatgagcaaagattttatgacaaagacaccagaagcaattgcaacaaaatcaaaaactgagaaatgagatctaattaaacttaagagcttctgcacagcaaaagaaactatcaacagagtaaaccaataaccaacagaatgggagaaaatttttgcaaactgtgcatctgacaaaggtctaatatccagcatctataaggaacttaaatctacaagtaaaaagcaaacaaccccattaaaatgtggacaaagtacatgaacacttttcaaaataatacatatttgcagccaacaagcataagaaaaaacattcagtgtcactgatcattagagaagtgcaagtcaaaaccacaatgagataccatctcacaccactcagaatgtattattaaaaagtcaaaaaataaaagatgctggcaaggttccttagaaaaggggaaacttatacactgttgatgggtgtgtaaactagttcaactattgtggaaagcagtgtggtacctcctcaaagagctgaaagcagaagtgtcatttgaccaagcaatttcattacttggtatatattcaaatgaatataaattgttctatcataaagacacatgcacatataagttattcataatagtaaagacatggagtcaacctaaatggccatcagtagtaggtagactggtaaagaaaacatagtacatgtgcaccatggagtactatgcagtcataaaaaagaatgaggtcatgtcttttgcacgaacatgtaatggactggaggtcattatccttagccaactaacacaggaacagaaaaccaaatactgcatgttctcaattacaagtgggagctaactgatgagaacatgtggacacatagaggagaataacagacgtgggagactaccaggggttggagcgggaaaggagggagaggatcaggaaaaataactgatgagtactaggtttaacacctgggtgacaaaataatttgtacaacaaacccccatgacacgagtttacctatatagcaaacctgcacatgtacccctgaacctaaaataaaagtttaaaaagtgagggagatattaagacattctaagacaagtagaagctggaagaattaattagcactaaatcttttatacatgaaataggccttgagggagtctgtagggttaaattaagggacactagataataactcaaagccataagaagacataacaatgtcactgaaggtaaatatgtccacagtcataaaaattactaccattgtaacaatggtttacaatgccacttcttgttttctacatgactaaattacataatcaaacactaaaattattagtttaaagctaggattaactttggttagtaaatccacattttattttcctcataatttataagacaaatgtgtttaaagtattattagcatatgtgtttgggctcacaatgtgtaaaattgtaatggtaaaatcaacagctcaaaggcgtgaggacagagttgttaaaagaacagaatctctatatgttattaaagttattaaagttaaacaggtataaattcaaattacagtgttaaaagtataaggtgttagatgtaatccccatggtaaccacaaataagatagctatagagtatctacaaaaataaaatttgtcacgataaaaaatcagataaacccaaaggaagttattaatgcagaaaatgagggcatatagaaaagaaaaagcaaaatgacagaaatgtcactccttatcatttattgccttaaatgtaaataatttatccaattaaaggacagagattggcagaatgaacaaaacaattgatccaaatctgtgttgtctaccagagacccactgagattcaaaggtacaaatagactgaaagtgaaagaatgaaaaaagatacgccatgcaaatacaaaccaaaagacagaaaatattattatattactgttagaaaaaagagactttaaatttgaaagtgtcacatgagacaagaagggcatcacatattgagaaaatatgttcaatacaacaagaagatataaacatctacatacacaagaacagacaatcaaaatatatgaagcaaaaatgaacagatttaaagagagaatagtcctatcataacggttgcagacttcaacacctcattctcaataatgattacaacaacaagacaaaagataaggaaggaaataaagacaacacaataaaccaactagatgtaacagacatatacagaagaacactctaccaaacaacacaacatagacattgtttttatgtgcatatgggacattttccagaataaaatacacatattttaccacaaattaagtctcaatagatttttttatagatgtcatacaaagttattttctctgactacaaaagagtgaaattagaaatcagtaacaggtgtaaaaatggaaaacttacaaaattgtgggaaataaataaccattcttagacaatacatgaatcaaaaaaacaaatcacaggggaaattggaaaatacttaaagatgaatgaaagtgaaaacacaatataccaaaaattatgggatgcagcaaaagcagtgccaaggaggaaatttatagctataaacacttatattaaaaaattagaaaaattcaaatcagcaacctaactttaagatactagaataaaaacaaactaaacccaaagatagaagaaggaaggaaataatgaagattagagcacatataacttaaatagaaaagtaatagagactagaaagattatagagaaaatcaataaaaccaaacttggttttttcaaaagatcaacaaaattgataacttttaggtagatggacaaacaaaaggggagaagactcaattactaaagttagaaataaaagtggagacatgatgaaaaattctagggaaataaaaaggattataaagagtattatgaataattgtacagtaacaatttgataacctagatgaaatgaacaaattcttacaaacacacaaaacctccaagactaaatcataaagaaatagaatatctgaatagacctgtaagtagtaaggatattgagtctgtaagcaaaatgtctcccaaaaaagaaaaaccctgggaatcaaaaaaatctccctacaaagaaaagccctgggtctgatagcttcatgagtgaattctaccaactgtttaaggaaaaactaacaccaatacttctcaaattttcctaaaattaatatggaatttcaagtgagctcaaatagccaagacaatttgaaaaaaaaaaaaaaaaaaaacaaagtggaaggactcacactttccaatttaaaacttactacaaagccatagtaatcgtaacagtgtggttttagcatctagattaatggaatagaacagagagcctagaaacaatccttcacatatacagtcaaatggtttttgagaagggtgtcaagaccattcttgagaagggaaaatggcagtcttcaacaaatgatgcttggataactggatatccacacacaaaataataaggttgaacccttacctaacaccatatgcaaaaattgactcaagtggatgaaagacctaaatataattcttaaattatacaactcaaagaaaaaaaaacttaatgaaaatgcttcatggcattgtatttgggaatgatttgttggatataacatcaaaggcacaggcacaacaacaaaaaatagacaaatttgacttcaggaatatgttttaaaattgtgtatacaaagacactatcaacagaataaaaaggaaacacacagaatgggagaaaatgtttgcaacttatatatataagggacttatatccagaaaatatagagaagtcctaaaactcaacaacaaaatcactctgattcaaaaaaaggcaaagaacttgaatagagatttacccaaagaaggtatctgaatggtccatacacacatgaaaagatgctcatggataggaagaatcaatattattaaaatggccatattgcccaaagcaattagtagattaaaatgtcattcctatcaaactaccaatgatattcttgacatgactagataaaactattttataatttctatgaagccacaaaggagctcaaatagctaaggcaatcctcagcaagaagtacaaagctggaggcatcacattacctgacttcaaactatactacggggctcccataaccaaaatggcacggtactggtacacaaacagacaaatagacaaatggaatggaatagagagcccagaaataatgtcacacacctacaactatcagatcattgacaaacctagcaaaaagaagcaatggggaatgaactctattcacttaatggtactgggatagctggctagccatatgcagaagattgaaactagaaccctactttacaccacacacaaaaatcaaatcaaaatggatcaaagacttcaatgtaaaatccaaaactataaaaatcctggaagataacctaggcaatcgcattctggacataggaccaggcaaagatttcatgaccaaagataccaaaagcaattgcaacagaaacaaaaattgacaattctagttaaactaaatagcatctacagagcaaaaggaactatcaacagagtaaacagacaacctacagaatggaagaaaatatttgcaaactatgtatctgacaaaggtctaatatccggtatctacaaggaagttaaacaaattcacaagcaaaaaccaaacaaccccattaaaaaatgggcaaaggatgtgaacagatatttttcaaaagacatacatgtgaccaactagtatatgagaatatcctcaacatcactaatcgttagaaaaatgcaaataaaaaactcagtgagatgccatctcaccccagtcagaatggctatttaatttttttctcttgtttgatacagctggagtgcagtgtcataatcacagttcacttcaaccccatcttcagcctcccagtatgctgggattagagacctgagccattgttcctggccgagaatggctattatgtaaaattcaaaaaataaaagatgctggtgaagttgcagagaaaagggaacacatatacactactagtgggagtgtaattcagccattgtgaaaagcggtgtgtcaattcctcaaataactaaaacagaattgctatttgatccagaaatcgcattattaggcatatcctcaaaagaatgtaaattttctaccataaaaacacatgtatgtgtatattcattgcagcactattcacaatagcaaagacgtgaaatcaacctcaatgcccaccaatggtcgactggataaagaaaatgtggtacatgtacaccatggaatactatgcagccatacaaaagaataagataatgtcctttgcatcaacatgtgtgaagctggaggtcattatcctaagcaaagtaatacaggagcagaaaaccaaatactgcatgttctcacttgcaagtgtgagctaaacaacaagaacacatggatactaggaggcgaacaacggacattgggacctacttgagggtggatggtaggaggagggagaggatcagaataaatacctattggatcctatgcttattacctgagtggcaaaataatctgtgcaccaaatccctgtaagacccagtttacctatattaacaaacctgcacatgtaccccagaacctaaaaaaaaattaaagatgcttagcataattaatcattagggacattcaaatcaaaactatgagataccaccttacacccaataggatagcaacactataaaaagaaaaaagtaataacaagtgttggtaagaatgtagggaaattggaaccctcgtatgctgtttatagaagtataaaacagtatagctgctgtggcaaacagtatgatgggtccttaaaaaattagaaatataatttccatatgatccagaaatttcacttctgggtacatacccaaaacgttgaaaacaaggtatcaaagagataatgtttacacccatgttcaaagtgtattatttgccacagttaaaatgtgaaagcaaccccagtgcccactgatggatggacggatggataagaaaacataatatatgcatacaatgaaatattattcaaccttaaaaagaaggaatttctttcatagctataacatggatgactttgaggagataatgttaaatgaagtaatccaatcacagaaaagacaaatgatgtataattccatttatattaggtactttgagtagtcaaaattataaagacagaaagtagaatggtggttaccagacgctggtgggaggagagaatggatagttactgtttaataggtatagaggttcacttttacaagataaaaagagttatggggatagatggtggtaaggtttgcacaacattatgaatttaataccagtgaaccatacacttaacaatgttgaatatgatccatttttgttatatgtatgaaccacctataaaaattgaaaaaaaaaagagataatttaaaaatagccacacctgaaaggtcatcacactggtccttatatgaaagagacaagagagtgaatggggagagagatgggatgacagaagttggcatgatgtgaagaaaaggccacgtgaaggggtgatgaggagttattgaagatggaccaaaggatacagacagcctctggaagctgaaaaaggcaagaaaaaagatttccctctgaaggctccagaaggtgtgtagcccagatgacaccttcactttatacactggacctccagaaatgtaacagaataaaattttgttgttttatgcttcccttcaaacctccatgaataaaatagcctcaccaaggagttgctggcctaagttaactttagaaatgaatggaatctgtaagactaggctaaagaaactgcatgttaagtactgcgctctagtcaataaatttgtttcccatagggatatggggtaacaattctgattctgatatataaatattccttaagcaaggaagcaaatgaatagctcatggtggcagccaggttttccacttctggagtgggaatttgtggattggcatggtgaggagatgagattgatccatatggtaattgtttagacttggagacaacaataagaactcatgttcaacttaatatagatatagatcgttacatgtagagatatttatggacttgtgtatatacacaggtcattatacacacatttatttctttgttttgccaactgttaagtgtctaaaagaaatggcactagagcagtaatgagtatatgcaacacccagatccagatcttgatttctattattattttccaaagaaagtaaccagtgttgcttggagaaatggctggttcaggtgcaggaaatataaaagatgagcctggagcatgttgtggttccattgggtaaggaagccctcacaaagcaacaataacagcaacagcaagaacaaaatacattgatggcagtatgtcaaaaaggcacaagaatcaactgaaagaactcctagtggacaaagattgacaatttgagcagcaaaatagtgctggattttaattctaagattaacatctgcaagtccagactgatgtgaataaaaaatcgaataaattaataagtggaggacaataatcaacgatgcaaaagaattccaaataaattatgtaaatgcttcatcctaaaggagggagagcaaaactctccactgttaagtatgagctgtgcaaagggacttccttctaaagagtaaagtatggaagtggggaggagatagtaaatttacagcagagtaacctggcacacactacttcagtcaggtgatcaaggtcaataccaacagttataaatcatgttgatagtatacaccctggatatgatgtgattaaaatagtactttacctctgtgatctacctctctaaaacccataaccctaatttacccatgagacaaatctcaatttggagacattctaaaaaatgcctgacctatactcatcaaaactttcaaagtaattgaaagcaaataaggtatgaaaaactgttacagccaagaggagcctaaggagtccagataactacatgtaatatggtatactggatgcgaccccagaacagaaaaagggcattagataaaaacaaagggaatcttaataaactatggacttcttaataaatattctcttactaaataattatgtattgatattgtttcattaattttaacaaatatactacactaatgtaatgtgttaataataaactctgtgtatgtcagaggaaagagaggtaatgtaggaattctttgtactatatgctcaattttttagtgaatctaaaacttctcttaaaaatgaagttgattcatagaaaatcaattgaacaaatgttgcttttggttaattgatgatataactaaatagttcctgttttaaccttgtggaaagcagaaattgttggcttggttatatatttgatttattactatgtgatggatggtatgtgtcaccaaaactgaacagaattttatcacatgaaaggagtaacaggaatatgcttccagaaaagaatgtattcttgacagaaattgataggggttacattttgggggcatctaatgatttaaatcttttatgacacatgtattactagaatttgtcagaacgttaatctaagtacaatcatgtgataatgtattcggtttgaaacagaataacaaaggggcatttgtcacttagcgtcagaatggattcctggacagatatgaccatattgccactcagcagtagccaagaaatttaaatgacttttcctcattttttagtcacttaaatcagacatgtatcccttactacatggcaaaccatgtgcttaagaaaaataatacttgataaaatcagaaaacaaacatcttaatatgtagctaatagcatagacagacaaggaaatatttttagagatcacctagccctggcctgtcgagtatggtagcttctagccccttgaatgtggctagcaggaattaagacatgcttgtattagggttctccagaaggatagaactaataggatatatgtatatatgaaaggaagtttattaaggagaatgggcccagacgatcacaaggtaaagtcccacaataggccatatgcaagctgaggaaaaaagaaggcaggaggggctcagtctaagtccaacagcctaaaagtacggaaactgacaatggagccttcattccacggctgaaggcccaagagtccctagcaacccactggtgtaagtgcaggagtccaaaggctgaaaaacctggagtctgatgttcaagggcaagaggaacagatgggagcatgtagcatgggagaaagatgaaagccagaagacagcaagcaagcttctcccaccttcttctgcctgctttgttctaatgggcgctggatggtgcccatccacattgagggtcttcctctccagtccactgactcaaacgttaatctcctctggcaacaccctcacagacatacccagaaacaatacttacagctatctaggcatccttcaatccaatcaaggtaacagctaacattaataatcacaattatgtgagtgtgaaatacactcatggttttgaagacttagtaccaaaagagaaagcaaaatagctcaataatttttatataatcggcatacagaaaagtttcatctccctgaacatctccctccattcccatggcaatcactggtttgttctccctcactatggttttgtctttttgagaatgtcataaacatgaaatcatgtagtttgtaacctttggagactgacttcttttactcagcatactgcccttgagttgcttcatgtatcaacgcttatcaatcttttttttttttaactgagcagtattatgtgtggatattccactgtttattcacccattgaaggacattttgttttgttttacttactgtatcttgaaactcttaacattttattttaaacataaagatatctattgaaacattattattgctcttagtttaaattcaggactaatatgtgattggtaaaaacaaaaatgaaagcaaaaaaatgtaaaagagaagaaacaaaatgtgggttcactcctctgaccctcaaatacacatgaaggcagtaagaagctcttaaccgttttctttgcctcattgcagacttgctttatttcttacattcctttttgaaaactcttttaaatatcaatcatgtactttttttattttttttttactatctggccctttatttatttttattcattttttattttattgtactttaagttctagagtacatgtgcacaatgtgcaggtttgacacataggtatacatgtgccatgttgctttgctgcacccatcaactcatcatttacattaggtagttctcctaatgctatttctcccccagccccccatacccctacaggcctcagtgtgtgatgttccccgcgctgtgtccaagtgatctcactgttcaattcccacctatgagtgagaacatgcggtgtttggttttctgtccgagcgatagtttgctgagaatgatggtttccagcttcatccatgtccctacaaaggacatgaactcatccttttttatggctgcatagtattccatggtgtatatgtgacacattttcttaatccagtctatcattgatggacatttgggttggttccaagtctttgctattgtgaatggtgccgcaataaacatatgtgtgcatgtgtctttatagcagcatgatttataatcctttgggtatatacccagtaatgggattgctgggtcaaatgataactctagttctagatccttgaggaatcaccacactgtcttccacaatggtggaactaatttacactcccaccaacagtgtaaaagcattcctatttctccacatcctctccagcacctgttgtttcctgactttttaatgattgccattctaactggcatgagatggtatctcattgtggttttgatttgcatttctctgatggccagtgatgatgagcattttttcatgtgtctgttggctgcatagatgtcttcttttgagaagtgtctgtctgttcatatcctttgtccactttttgatgtggctgttttttttcttgtaaatttgtttgagttctttgtagattctggatattagcccttcgtcaggtgggtagattgcaaaaattttctcctattctgtaggttgcctgttcactctgatgatagtttcttttgtcatgcagaagctctttagtttaattagatgccatttgtctattttggcttttgttgccattgcttttggtgttttagtcatgaaacccttgcccatgcctatgtcctgaatggtaatgcctaggttttcttctagggtttttatggttttaggtctaacatttatgtctttaatccatcttgaattaatttttgtataaggtgtaaggaagggatccagtttcagctttctacatatggctagccagctttcccagcaccatttattaaatagggaatcctttccccatttcttgtttttatcaggtttgtcaaaaatcagatggttgtagatgtatggtattatttctgaggcctctattctgttccattggtctatacatctgttttggtaccagtaccatgctgttttggttactgtagccttgtaatatactttgaagtcaggtagcatgatgcctctagctttgttctttttgcttagtattatcttggcaatgaaggctcttttttggttccatatgaactttaaagtagtttcttccaattctgtgaagaaagtcattggaagcttgatggggatggcattgaatctataaattactttgggcagtatggcaattttcacaatattgatttttcctatccatgagcatggaaagtttctccatttgttcatgtcctcttttatttcattgagcagtggtttgtagttttccttgaggaggtccttcacatcccttgtaagttggattcctaggcattttattccctttgtagcaactgtgaatgggagttcacacatgatttggctctctgtttgtcttcatggtgtaggggaatgctgtgatttttgcacattgattttgtatcctgagactttgctgaagttgcttatcagcttaaggagattttgggctgagacaatagggttttctaaacatacaatcatgtcatctgcaaacaggaacaatttgacttcctcatttcctaattgaataccctttatttctttctcttgcctgattgccctggccagaacttccaacaccatgctgaataggagtggtgagagagggcatccctgtcttatgtcggttttcaaagggaatgcttacagtttttgctcattcagtatgacattggctgtgggtttgtcataaatagctcttattattttgagatacgttccatcaatacctagtttactgagagtttttagcctgaagggctgttgaattttgatgaaggtcttttctgcatctattgagataatcatgtggtttttgtccttggttctgttcatgtgatggattaggtttattgcgtatgttgaagcagccttgcatctcagggatgaagccaacttgatcgtggtggataagctttttgatgtgctgctggattcagtttgccagtattttattgaggatttttgcattgatgttcatcagggatattggtctaaaattctcttttgttgttgtgtctctgccaggctttggtatcaggatgatgctggcctcataaaatgagttagttagggaggattccctctttttctattgattggaatagtttcagaaggaatggtaccagctcctcattgtagaattcggctgtgaatccttctggtcctggactttttttggttggtaggctattcattattgcctcaatttctgagcctgttattggtctattcagagattcaacttcttcctggtttagtcttgggagcgtgtatgcgtccaggaatttatccatttcttctagattttctagtttatttgcatagaggggtttatagtattctctgatggtagtttgtatttctgtgggatcagtggtgatatcccctttatcattttttattgcatctatttgattcttctcttttctcctttacttgtcttcctagcagtctatcaattttgttgatcttttcaaaaaaccggctcctgcattcattgattttttgaagggtttttttgcgtgtctatctccttcagttctgctctgatcttagttatttcttgccttctgctagcttttgaatgtgtttgctcttgcttctctagttcttttaattgtgatgttagggtgtcaattttagatctttcctgctttctcttgtgggcatttagtgctataaatttccctctacatactgcattaaatgtgtcccagagattctggtatgttgtgtctttgttctcattggtttcaaagaacatctttatttttgccttcatttcgttatttacccagtagtcattcaggagcaagttgttcagtttccatgtagttgagcagttttgagtgagtttattaatcctgagtactaatttgattgcactgtggtctgagagacagtttgttgtgatttctgcttttttacatttgctgaggagtgatttacttccaattatgtggtcaatcttagaataagtgcaatgtgttgctgagaagactgtgtattcagttgatttcgggtagagagttctgtagatgtctattaggtctgcttgtttcagagctgagttcaggtcctggatatccttgttaaccttctgtcttgttgatctgtctaatattgacagtggggtgttaaagtctcccattatcattgtgtgggagtctaagtctctttctaggtctctaaggacttgctttatgaatctgggtgctcctgtattgggtgcatatatatttaggatagttagctcttcttgttgaattgatccctttaccattatgtaatggccttctttgtctcctttgatctttgtgggtttaaagtctgttttatcatagaataggattgcaacccctgttttttttgctttccatttgtttggtagatcttcctccatccctttattttgagcctgtgtgtgtctttgcatgtgagatgggtctcctgcctacagcacactgatgggtcttgactctatccaatttgacagtctgtatcttttaattggggcatttagaccatttacatttaaggttaatattgttatatgtgaatttggtctggtcattatgatgctagctggtttattttgcccattaattgatgcagtttcttcatagcatcgatggtctttacaatttggcacatttttgcagtggcttgtactggttgtttctttccatgtttagtgcttcctgcgggagctcttgtaacgcaggcctggtggtgacaatatctctcagcatttgcttctctgtagaggattttatttctccttcacttatgaagcttagtttggctggatattaaattccgggttgaaaattcttttctttaagaatgttgaatattggcccccactctcttctggcttgtagggtttctgctgagagatctgctgttagtctgatgggcttccctttgtgggtaacttgacctttctctctgtctgcccttaacactttttccttcatttcaaccttggcaaatctgacaattatgtgtcttggggttgctcttcttgaggagaatatttgtggtgttctctgtatttcttgaatttgaatgttgtcctgccttgctaggttggggaagttctcctggataatatcctgaagagtgttttccaacttggttccattctccccctcactttcaggtacaccaatcaaacgtagatttggtcttttcacatagtcccatagttcttggaggctttgttcatttctttttactccttctctaaccttgtcttctcgctttatttcattaatttgatcttcaatcattgataccgtttcttccacctgattgaatcagctattgaagcttatgcatgcatcacgtagttctcatgccatggtttccagctccatcaggtcatttaaggtcttctctatgctgtttattctagctagccattcatcttatcttttttcaaggtttttagcttccttgcagtgggttcagcatccttctttagcttggagaaatttgttattaccaaccttctgcagcctacttctgtcaaatcgtcaaagtcattctatgtccagctttgttccattgctggcaaggagctgcaatcctttggagaaggggcactctgatttttagaattttcagcttttctgctccagtttctccccatctttgtggttttatctacctttggtctttgatgttggtgacctacagatggggtttggtgtagattacctttttgttgatgttgatgctatttctttgtgtttgttagttttccttctaacagtcaggtccctcagctgcaggtcagttggagtttgctggagtttcactccataccccatttgcctgggtatcaccagtggaggctgcagaacagagaatattgcagaacagcaaatattgctgcctgatccttcctctggaagcttcgtttcagaggagcagccacctatatgaggtacctgtcggcccctacttggagatatctcccagttaggctacacaggggtcagggacccacttaaggaggcagtctgtccattctcagagctcaaatgccatgctaggagaacaccgctctcttcagagctgtcagacagggacgtttaagtctgcagaaattgtctgctgccttttgttcagctatgccctgcccaccgagatggagtctagaggcagtaggccttgttgacctgtgatgggctccgcccatttggagcttccttggccactctgtttacctactcaagcctcatcaatggcgacacccctcccccagccaggctacagcctggcagagtgatctcagactgatgtgctagcagggagcaaggctccatgggcgtgcgacctgcttagccaggcatgggagagaatcaccttgtctgccggttgttaagaccttgggaaaagcacagtattttggcaggagtgtcccgtttttccacatagtctgtcacggcttccctttgctaggaaagggaaatcccccaaccccttgcgcttcccaggtgaggtgatgccccaccctgctttggctcaccctctgtgggctgcacccactgtccaaccagtcccagtgagatcaaccaggcacttcagttggaaatgcagaaatcacccgtcttctgcatcgatcacattaggagatgcagactggagctgttcctatttggccatcttggaatgcccactgctcttcatttttatgttgttattaaaatacttaaaactatgaattggcttatatttgagtcctctcacactatagttttattagacaacattggtctagtctaagttgctttttatgtaaagaaagaacctatggcccagagaacttatgatcagtgccaggtcctgtctttaagtgatctggatatttttaaacaaaaatgtttctctatttaactggggagaagagttttttcaagttatctatcactaagaaaattttcacttaggcttcatgaagttcaaatacattttacataacattttcactgttttctactcaaggaagatcttggcctactgcccttctgggttaaataaaatgagctaccatttattgagtgcttatgccatgtagaccagtgctgcaatttgtataataaatagcttacataatttattattgagtttaattctcacaaaaatcttttatagatgaagaacctgatgctcagagagcaatttgcttaagcaaccacattaatcagaatgtggtaaacatagtatttaaatggggttcttgttctaaagcttgtgttctctccactgttctcaactgcttctgaacacatgaagttatttgtgtaagctgctacagctgtcaataggaaccctgtaaggattatttagcctttcacagctgtttgggattagtaagaagttgatattccttcaattcttcatctggcagaacctagcatggtaatatttgctctaaagaaaataagaatctctcatatttttttcctctggtgcctggaatacatcagactccgctgggtttagaggatcatactgcaacagaagttaaggaggaaggagcaccgtcgagtctagataagtgctcagttttcctgctgtttagcaaacccccaattatctgaaaatttcaataacagaatttttttctgtgctctttcagaaacaagaggaaatgacatcaaagttttctaatttcagaattaaagaaattaatatactcacacacacaccctcatacccacccacgcacagagctatacaggagattcatcacccttggagctgctgctcctcctcctaagttctatattgcagctaaaatttttccttatttggattcttagtcaccgaaaagcaaacaccagaaatcatctgattcaaatgatccattttcacctcgtacatcaacactgttgctaaggtcggtgaattccaactccatgatgtttcttgcatccttcccttgttctttgtcatggcaactgccctagtcactggtcccattcctttttcctggattagtgccccatctccctcttgttcactatgttccagtcattttgtttttctttaatctcctcagaatccagagctatgccctgtgcctggaatgttctccccatgccctctttggctaagtctgactaatttttcagatctcaactcttctgcagaatcccttcctgacctgcacagatgagggaggtcttcttttaataggctctcatggtatcctgttttccttgtggcacttacaatgataacaattaattgtacaatcatatccttaatagctgtcttccctgctggaatgcccttaaatattatgctgggctgctttatactacactgtgctgcttttttctaataaacaatttcctgtattacttccattggggcatctttgaaaatttctaaaatatttataaatgcaacaagtgcttattcatttatttctaactcccattatagatggttgagaacatgagtttatagtcatgacttaacactcctcttcttagcctccctatataaggctgatcaagctgccgttacgttttatgatgttgggagagtaccttagcttgtgggtgagtcaatcttctcaactgaaaaatggggataataatagtactgaacacttcagagctttacagataaaagtaaatcaggtaatattcagatgaaagttaattcagataatatatttgagggtacaaacaaaatgtccatgaaagttggcaagtattaatttacatttcaggggtatctgtatatttatttattcattatttttattaaaaaatgttgtaaagatgggggtctcactatgttgcccaggctggtctcaaacttctggccccctacatcagcctcccaaagtgctggaattacagtcacgagccaccatgccagaccctgtatatttttcctattgaaaaagtgttcagtataacttctcagaagcaaattccaattaccaaggggaacagctctcaagtgtgagacaaatttgcatcctcctttgatctattcatacatttcatttctgtagtcattaaacatggctttttttttccactaagaaatctttaaacttattgaaaataacctcaggctgatcctagtctttcttagtaactgtacatatggcatatagagctggaaaaacacataaattagacaatagagaagcaaccaagctgtgttttatatatatacatatatatgtatatatatatatatatatatgtatatatttggtgtatccttttgtgcagaggcttattttgaagagcatgtgggagaggaagtgtttaagaaaataagaatgaagggaaagagaaaattcaacatctgtaagacgcatgtatgtgattatcataactgggcatgtctgactctaaagagtattaaaatatgctctgagaatcagcagcaaagaactggaaacactacataaatggagatggacctcacaagatacattcaagcatcctaattatacaggtacacatctttcatttgttcaaagatatattcaggacccaaactactgtattcagacctctatgcccatatttatgtctggatgtacacttaaaggaggcaaaggcacggtgcagtactttgctcagaatttccaggcaggctgattgtcctggctatgattccagtcatcataaatacatttgattctcacaaatggttccctggttgcatccagcaggtccatttgtaaggcaagtagttagcttgttctgctgctctgtgactttttgaagagttcctgcattcctgctaagcatgaacaaagcaggaagacattaatgtgctgaccacaatctcctctggccacctcagggaaactagcatcatggattaaatcatttctttgctaaatgacacctgttgaaactgacaagccaacaaagctgagatcccatgctgagcagaagaattacaagcaatggggctgcccacagcattgctgcatgacagtgggtgactgagaatcacattaacacagtagtgaattcacacacttgatttccaagcattcctcacatgctatccttcttgggtgtaaattttgcatttattcattgaaaagtattgtgattcataaaattataatttttattataatttggattctctacagactttgttactgtattgcatggtatttattaatatgtatattattaaatctaatttttttacaaaagcttttaaaacatgaatttctaataagaaaatgacaattcttctagaagtagcagtgataataataacaataataataataattgctgtattagtctgttttcacactgctgataaagatgtacttgagactgggcaatttacaaaagaaataggtgtaatggacttacagttccacgtgtctagggaagcctcacaataatggcagaaagcaaggaggagcaagtcacatcttacatgggtgacagcaggcgaaaagagagcttgtgcagggaaactcccatttttaaaaccatcagatcccataagacttattcactgtcacaagaaaagcatagcaaagacctgcccttgtgattcaatcacctcccacggggtcccttccacaacacatgggaattcatgatgagatttgggtggggacacagtcaaaccatatcaatgggtaacttttactaattgcatatttttttgacataaacttccatatcaccttatatatattggcttatttaagattgtccctgttataaatgaagctttaagtctctgttctttgaaaattggaaagctttaggtttcaccatgttatggaagaaaaattgtctctgtgaatataattcccaaataattaaaatatcaattcacatggtccaaagctgacgggttgttgttctggcaggtttcagaggaaacatcaatagtgataatggctgaactcattcatggaccactcactatatatgccaagccgagtgctaagcccttcacagatattatttacttttatcccggcaacaaatgtattagttaaaaattaatattgtttccttctgacagatgacaattgaagtttggagattaagctatttgctaaggatcaccatgctagattgtggcaaaactagatccagaactaaagtccgcctgacttaaaggctggactctacattactgtgctaactggtggtatttaaatcaattatttcctaaacattttgtttgtgtctacacttttaaaagggagagaaaacattttcccataatcttaggggtttaactatcccctcttacagtaattttgggacatcttcaaatcaaactcaacataaaggacttgtgttcaaatgatttatgaattatagtcagacctgaatctttagaatcctgtaaacaatcaaacactaaattttgggtatcttcctcactgtccatatacattatcattgaacttctgtgaaataatattttatcactctagatgttatttatcacatacaagatggctatttaaaattttacaggcactagcacactaaaaagaaacaaataataatgcaggtaggtaggtgtgtcagagctgtaattggaataaatgcaacgacaagggaaacaatagaagcaaatgtcatagtttgagcagcaaccatattgtatagttaggtctattaaacaataaccatgattttccaagagtttcacttttaattcaaatgttttgttttctccctctctctctctggaaaatgaaggcaactctacccatactcatcttggatgctagaacatccatgtgactgaggcacagatgatatatgaatgactcaaaagggcacttctgtgtcttacttttttgtatgcacttagaaaacatcttagcattagttctcttatgaaaatgaatgaaaatacctacttttcagggttttaggaggattatataggttagtacctgcaaagcatctatacactggcacataggaaacattccatcttttgatcccataaatctgctagcagtgagtccttctgtacaaagaagaaaaaataattccccattatcagtggagtactgatgacagcctcataccagcttataggagccgattacattaatttcttcccagcttctaatgatgctaaaaattaagctcaatttttatacatttaccactataccaccatggccataatttatcttccatattctgtcctctaggaaatcttttagtagcaggtaggttagaaaataactactggaaataaaacaagcatgtatcttgtttgtgttaggcagcagcctcatattctgctgagatgtcaaagacaatgcaatgtgacctaattatatactgatccattagatgagattttcaatatcttagagtgaaaatctgctagttcagaaataccagtaggaagcacacttttcctattctccacttatgtgcccaccataggaataactgatcaatacactcttctcactgagtttacacatacttctgtgccacatattacactaagtgctttgaatacaaatcatatttaatcatgcaagtaattttctttgataagtatcacccaccacttaatataaaggaataaaataaggctcacaaggctaagtaaaggacctgatgttgaagagctgtgttagagattgactggctagaacacagactgcaaagcctgtgttcttcatcggtgtattctatcccttcccattctattgaataaatactgtgttgtaatgggtagaaattattcattttataaatgaaggtaactgagggattaggaaatgaaggcttttaaaacatgattccataaatgcaggatttcatttctccctatagaattacaaaataaaagcaagtccataaacccgattagcagatacagggctgcccgtctttgggaatgttaatctctggtcacatgttgcaaatgtttaactgttctatccatcacataatctcttcttgtaaatttatcatgaaatatatttacagctctctatatgacatataaatcatagactaagagctgaatttagccaacattttgaaatcattcccaagagatgttgcggtataaaattttatattcagtttagcacactatgttaacgaacacactaaaaccgcaggacatttcaattactagaattaaacagacctcttaaagtattccaaatgtattctgcagaggcttgtcagtggaggtggagtgtatgggattatctttctatctcaactgaaatgatcccacagtaagcgtttggttacttagtaacattaaaattgcagttaagttcccttacaattagtggccttcaaataaatagttttgagaactaattacatactttggcagaatttcattctttctgttttggtagttattctggtaaatttctaaatgtagtgggcatgatcttcctctccaaatgcttttttacgttttaaagaagaaaggctagtttgtactgaaacttgatttggagatgaatagatcaagaagaaatggacgtaagttgttcaaagaataaattgaaaaagatgaaataaagatttttgtcccattacttatgacctcaaaacatctatagttaaaataattaggcagatgaacaatcatatctaagaatatttgtgtacttacgatgttaaaaacatgatagaagatgatgtattatcctcggagacacaacatcatgcagtcaaagcattcagttctttggcctagttagtcatttctactacaggtatttgcaaattttaggaaaactctgttgtgactgatgaagtgaagcctcaaatttttattgaacattctataattaaagaagttaagaaagagtatccatatgttaccatttttgacatggttagcaacaatagtagtgactatgcaccatttatcttcaggcagggtggaaagtaaactactggaaagaaaacaagctgatacttgatgtgtaagagcactttcctgctttgctcaggttccaaagacaataaatgttacctattcatatattgacacattagataggatgcccattcacttagtgtaaaaatctgctagttcagaactaccaaggggaagcatacattttctgttctctgcttttatactcatgtgtccaagagatatcaaatatttgtcatacactgtgccaggtacatgaatatgacatggtccctagtacaaagagaattgtgatctgagaaatagatgataaacatacaacatagtgaaatggaactatccataagacgtagcagcaggtgatggaggtaacactgggcatgtgttctgaatgtgaataggaatttgataggtaagagtcatttcatctcagctataattttctccaataagtcattgttgacattgctcccttgcaccacccagaatgaatttgaggtggtacctctgagctcaaagaattcttaatgcattgctttgccatgacttgatataattagctaacatcacaaatcctctgaaagcttccaaaagccaaagtgcttatagttcttacattaaccaatctactctctttagctttttgaactcatctctttcaactcatctcagccaactagactctttgctacttgcgcaatgtgtggaacatgttctacttctgagcttttgttcttgctgtgccctcaacctggagagctctttccataggtaccaacatggctccccctgccccatctttaagtcttctcacatatcatcttctcattaaggacattcctgactaccttattttaaaacatcattcccacagacacttttttgatgcccctttcctgctttatttatttttttacgttacatacctttctgtgtctattatctatcccctttcctcgctccacttaaatatgagcttcatgaagacaggggcttctgttcgttttgctaattgctggactctgggacaagaagagcttctggcacataagaggcaatctataaatgtttgtagaatgatttaaaactgaaataatgtatgtattattcagaatacacagtaagtttttataatgtttcagatgccctttgaagatggctgttaggtggaaaagactgacagtatacaagtaaataagtaaataaaatgtactaattacagattgtagttaatagaatgaacaaaacaagcagatatctttatttaaaaatatgatatatgatatgatgtgtgtgtgtgtgtgtgtgtgtgtgtgtgtgtgtgtgtgtgtcttttaaaccaggacaatcagaaaatgcccctctgaagagataagctgagatccgacatccaagcatcactcatttatagagttggtgagcagaggtcagtactattcaaagcagaggatggagtaactgttaaaaaatatccagggcaggaaagaaatgaaatttttttatatcacaaaaattaaaaaggagaggatgtggaagacagtggaatgagcaagggttattggtggaggccacaccatacaaggttgtaggagacatgataaggcatttggatttatttgaagagtttttggaaagtatcaaatgattttaattggggaaatggcatgatttcctatagattttaaagagtcttctcttttaaagatcctgtgtagtgcgtgaataggactgtgacaagaatggaactggaataataggaggctcttatagccatccaggtgagatcccatgatttgggttaagaatattaatgatggtgatgcatggatatgtttaagattgactttaaggatagatcattaggtgttggattgcatttaggaggtaaagaaaagagagagaggaaaaacaagtcttcattttctggctttggtaataaaataatatcatttattgagatagggaatgtagggaaatgaatggggaaaaagggataaaaaagggatagaaatttggtttctttctggatatgttaagtttgaaaggcttatgtgatatccaagtggagatgtcacgtaggcaggtcaatacataggctagatctatgcctgtcttcatcattatacaatgaatttcccaagggaagatattttactgtattcgtccctaggtcagcagttggcaaaatggttgttttataaatgttgccctgaaagactactctctttatatcctgctgggcttaccagctagacacactgggcactctagctttgggaggaacatctccttattcttctttgctccttagatcagaacaggccattgcatataaattgttagctccagaataacttttcaaaaatattttacttcattttgaaaatagacctgacaaaccctttggatataacacaataagctaggtggtgtatttttagaagaaacaaagcagatcaatcataatagtaatattgtaagaggaaatatgaaaaattttagactcagggatcctgagagggattggaaaacagcgggaataaagtcaaaggaagccatgggccatgtgaggtgttaaagcacatggaaaaaaatgggatggtaggaagaatttttatgaacaagcagatcatattgttatccaataattccatttaccaaaagtattgaaattatcattttatattttattccacagggtatatatttcacatgacatctcttctaattgagaacagaaacatagtccaacttggctctaaaagttgtaaggatatattactaaaaatatgttaaaatatttgagatatttagaaatgtgactatctgatggaagtagattaaaacataaatgcttcttaatttccaattctgtttaaagaaactatgctgttttcaaaattctgtcagttgctagggaaactagaaagggggctattaaattgtatatggaaagctattttccaaaatacattaagtggaagatgtgagtagttagataaaacttttcataggcaagaaaacgtgtgaaatcctaggtgaaggatgaacgcctcctcaattgacagtttgatagagattctgtgcctcctttaccatgaaccattgttattttagagggcagcaatgttctcattgtcctcttggggaatgtattcttaaggaaggtgagtaatcctggaagaaaagctaagatctttttggaccaataatgttaatatagttacaggaaagatcactaggctaaaaattaggagaatcgtgttctaaaccagacccagatatgaacttaggaaagctagttcttccctggtctccaattccagcatctggatatgagtgaaataattgttagagttccttttgcctataatcatttaatctgtgagtgacaggtgaatggcaatccacaaagtagaggataatacctttaacaagaaggaaattgtgggtgatgagatcaattgtcaaggtctggaggccaagttccatttaaataacataaaagcaaagaaaaaaaagaaaaaagaaaaaaagaaagagaagaaaactttaagtgaaaatttaagaatgaattatttcggtaaggcttatctgtaagttaatgtacctgctaatatataatgattttcatttttgttataaattgaacattttttgttcaagtacactgtatttagccatttttgatatttttaatactcagagaatttataaacattcctaaaatccttttatgaaccttatcttttagaatgatagaagtctcttgattattcccttgtggtaccatattaaaaatgcaaaggaaattttctaactcctcaaaccacacaccagtggcattccaaagcctacagaatagctagtgaatatgaagttaaccagtccaaatgacctttccttccacttattcttacggtaaattatatgctgtaccaatattaatgtacttgcagcttcctaaaattcaacaaatatttattgaacatctacaatgtacaaggcaaattttttttttctttttttgatatggagtcccactctgttgcccaggctggagggcagtggcgcaatcttagctcactgcaacctctgcctcccgggttcaagcagttttcctgcctcagtctcccaagtagctggcagctgggagattacaggcatgcaacaccacgcctggcaaatttttgtatttttaatagagatgggattttgccatgttggccaggctggccttcaattcctgacttcagatgatccaccctcctcagcctcccaaagtgctgggattacaagcatgaaccactgcacctggctcgtacaagcaacttctaagaattctcccatatcctgtatgctatttttgctctaaatccatattttcttctatctacccattaattcattcataatgtatgagtcatattatttacaaacacagaacatcacacactgcacagtgtttatcaatctctgtgtttgtttttcccatcaaactttgacttgagtaacataattctgtcttgcttgtatttgctgaataagcaaattaatttttaaaaactatgcatgaattaattttaaagatactccataacagcaactttggctggaaatatttgttctatgaaaaattttaccatgtgagtgttacaacttcagatgaagcaggaaactcttcttttttaatatatagaatagtactaggagagaaggtatgataactaatttaaaaaataaatatatgaggctcgatgtatgtgacagatagatcaactctcaggatagtaggagaggacaggatgcctagaatggaagagaaaaagcatgaagtacaaatcaggaataaggacaaggggtagggtatcttaggcaacagaggtaatggtttgaaagtaggaaatatcacgatatactgtagtttggaaaggtaaatctggagcatttaggagtaaaaatgaacacagtagaagataagtttagaaaggaaggcaacggctagcatatgatgggctgcaaatgcaatgacaaataatttgaactttatcttgcaggcaatggggagcctctggaaatttataacagttagaattaaattttagaaagatcactggcagcaatgtggaagatgaattgcaagcacaggagaggaaatggaaacagaaaatactagacaattggaatggtaagaaattacaaaagtctgcaaacagtgacagtgtgaacgcagaggaatgaacacataggaaagaagttaaaccagtagcatgaacaggatttattccttaattaaaatttagggataaagttgtaagagaagattatatctactctcattgttttcaagacttaaaccaggaggacaggaggaagtggcaatggtaagataatgcactggctgggtttgagatgcttacgaaaaatgcactggaaatgtcatataagcagctgaatatgcaggtgaatacgttaggagagaattgtgagttgaaaacatacatttaggaaaacataagatgcttgagaagagcaactttgtcttgtttactctttattctcaactccacacataaagactgaaccttcagcaaatgctgagctgctactgctaatgttgaactgatactatcacccacttccaacctcccttgattagaaaactaatagatgcaagtctcctgacacataataaggatgcaataaatggaaatttcattgataacttgataacttggacaaggacagccctttttgtttctattatatattctagaatataaaatatgaatacatgacaaatgaccaacattacaatatatactgaagtatatggggcaagtgctattaaataaaggacatttaaattattttaagatactctatcaatattttaaaagcatacaagtttgtggcataatcagtattgaaatgaaatcaattctaaatcatgtttgacttctagttagaggtttatattctttcatttaatcagtgtttaccttgtattctgtaaattcatttggttttcactgggcttttatgtcattaatttcttatttaataatttgtaacatcccattttagcttagctgaaaaaagagtaaaatggattttatggcattgatcagtgtactacctaggtcaatgtaaaagctaggtagtagaacatgttttgaaaccaaagcaagttgggagagcatgttagtcagaatatggaatcccaggaataagactcactctttaggttatttcatctcagcacccaattttattaccaacaacctagttttttaaaaaaatattgtagtggcattagaaagttgggctttacactaaaatcaatagccctgttttcttagtaggggcctgaaaatatctcatagatattattgctctagaaagagtccatttcatgcacagatgagtctgcatgtatgaatcttacctgggcaatatcagttatgaggaacttaggacatttattctattgttctaatttgggctatttataggccagaattagcatctttggtgcccaatctctaaatagaaaaaacaaaaagctaaacatatgtggtaatgtggtgaccaagaaaactactctttttatgggtttccattaacatactgtgttcaaaaagcaaaacatgtttatgacaggactcctattatttctagtatcaaagaaatgacagtaacattacaactaggggatatttctagagattggtctgataaagctccagcttacttctccattgtaaaaaaagttatcttaaagatgggaatttttctatacaactcaatcaatatttagtctgcacatattgtgtgtcccacccaacatactgaggtatttgggaaggggtatgaaaactataagacatggttctgaggtgaaatactgctttttaaattgtcttttcttaaaccaattattagtgtttttttaatgaaattataccataaccatttgtatttacatacgcttagaatatgtgcaagtattattgaaaaatatttaaaaattacaaagttttaaacatgtaagatgggccttgtggcccatgtaagatgggcatgatctatttttgatactatttagagactatttctgatactatttagagtaagacgggccttgtaatatgcatcatcatgatctatttctgatactatttagagtatagcactagccttatgtttatgatcactatgcattcttatagttacagattatacccttctgttcagactcttatctccaaattgatgatatgtattacagagcagttgccacctaactgaataactcatatcaatcctaactgaaagcacaacagcacttaaatatataatctagcccaaacttaaacctaaggtagggatttctataggaacaagaaagcatatatatgaactgtattttttcattgtttcaattaattttaacctgtggtataagctatgtgctttccagatttacacatatataaaaatttgacatataattcgagagaattaatggattttatagtgaacatctaaggactgctaggtatttctggacctcaggtttaaaaacatgggaataactcattgatggtagaaccgtagtatcaatctggcatttaagatatggtatatttttgcatattctgaggaaggttcttctttttataagacacagaaatagaaataatagtattgggaagaattttaattagatctaagaataacattcctaatgtggatataaaaattaagatgtgtttctgggattctcagtaaagcttatattttatgatatagtcattacataattttccagaactataatagtttcagaacaaacctactgggagggccaatacgggagtcaggaagcactcaagaagttaagtaagaaagaaggatctgaaagaagcagggataggttgggaaaggaaacaacagagaagactgttttttttgtttgttcgtttgtttgtttttgtagagacaggtcttgctctgtcaccgtggctaaagtgtagtggtgtgatcacagctcagtgacacttcaacctgctgggctcctgtggtcctcctgtctcagcctcctgagtagctgggactgactacaggcacacaccactatgcctggctaattttatatacagacaaggatctctttatgtttctcaggctggtcttgaattcctggcctaaagcaatctgcctgcctcagcctttagcctcgaaaattgctgggattgaaggtgagagataattaatataatggtttggaatccttaatatacctggaacatgcatgttcttaagcattcccgtccccactattctgcttcaggggaccagcatctctcacctggactagtgcaataacctcctgaatggtctacctgcctctaatgttaccccatgttcaagccactatttgcactaaattaaaatgtttctagtaatatgagttatttcactttcctctgtaacaccattctgtggacactttttgttcttatcaatctgaattatttaccatggcttaaaattccctggcagatctgtgagagtgtagtcagcctgaaaaattgggttacagtcagaccacatactttgaataaattatgtgtttttattttttaaaaaaatattctgttagacatttagaggatgaatcaaggtggaaatactagaggcaaaatgatcagttagaaatctattccagttgacatgttaggaacataaagtaaggtgagtccatgggcatggatgtgaggagcatcatggaggtaagtttaatggaacttgaaaataaagtatatgtatttgatattaaatagcttcaaacctgagcaataaagaagatgatgatgaacgagtgttaaggtgaagcatcatatcctgttactggagggttattatggttactttgtctgcttggataaagaattaggccaaatagtacatttcataataaatcttcctcctagatgggctacacatagcatccaatgttcttcatgagaccagttagtgcaaaaaaatagctaagatagctatggctgtaaagcccagagatctctgatatggtgtgattaccatccttcacgatctattacataagaaagaatttccactgtgtgcctccaatgaaagaccaaaatgcaataagtagaacttacagaaatttcagataagaacaaacaagaatattttaacaatcagagctagaacatgtagaaaaatggtagaattcccattatatgaacatgagactatattgagagggattgagatctccacatgtagaagttctacaaatattagggcatatggaactgaaagggcctttaattcacaagcgagaaagcagtatcccagagaggggcaggcaacttggccaaagttgtacagctggttacagattctgatccagtttcagattcacagcccagtgacctccatgctacataatagtggctacccaaggccaaggagccagtgttgtgactacctcaaagacatcataaaggaaaggcttgaagtggactatgcagttggaagagaagggaaaataagttgaccatgaacaaagatactctactaggatggatcatatactagggaagggcaaatataatagtgaaaggattgctttccatttgaaggtatctgtgaagccattagaaataactaattactgttaataataacaataatacctacaatattgaacagattttttaatgcaagcttctgtgatgagtgttcaagatatcatgacaaccctatcaatgagatattattagcactctccattttacatatgcataaatgaaggcttaaagaggctgtataatttgccaaaaatcatttctgtagtaagcagctgaactgagtcccagaattcagcctatgttcataaccattttgccatattgctaatgtgggtatcatagtggatcccttagcctgagaaaacaacgagtttaatagttgcatatgtccctattgtgtaggagagccctggagagacattttagaagctttcttgataaaaaaagaaaaacaattagctaatcatctggattgttacttatttaatgaaacgtattagtaatttgaaatagactacaatgaattactcagagaaaatgggttcaactaattggttcagaaaagtcttctgaaggatataattaaattgcctagtgtactattactgctagcataaacactattactgatcttcaggaccacttgcatttccaacgtaatttaaaataagtagtgggagagacaagatccatggacacaatgtgtttcaaggaatcagccatgtggttagctaatgaaagcaaagcaaggtcagtatttgaactgtttccagcaattagcattctgttatatttttgttcctatgaatcatcaatttcaaataactcttaaacacctttttaatagaaaatactatcttatttaataccatacttctgggtcctagtatgctgtttggaataaaagatccttaataatgtatgctgaataagtgaattaaatttttataaaaagtgtcttttcttttaaattttacaaaagacataatttaaaatatacatatgacactcaccacatgacttattgaagattagatcagaacataatatttgacttcaattctgtatggttacttctgtgaagatttatgataaaaaagccaggaacaaatggtaaggaatgcaattattttttaagtgccatgatattttcatgactgattttcattaagcatgggaagtcatatctgccatggatcctgcattatatatgtcttataaataggctaaaatgatttgaacttcataaactgataaaaatgctcttgagatcttaggatcttaggatctttacataattctttgtcacaagttgacttctgtgaagatcatgaagcaatattgttctctagggaagatgtggaaagaaacaggtgcctgtatttctttttgtgattacctagatgaaaggaaagtacacacacacacacgtgtgtgtgtgtgtgtgtgtgtgtgtgtgtgtgtgtgtgtgtacagaaacaagcatagttttattacactcttagaacctggataatttcttagtacagagtggacaaacaggaaatgtttgctgttgaattaatgtatacaaaattagtttcagagactgtacaaacattgatatcatctctgcaaaatctaggtgttcaacatgagaagactggattcttttacttgttgttgttgtttgttttgttttttgtttttgtttttttagagacagagtcttgctctgtcacccaggctggagtgcagtggtgcaatctcggctcactgcaacctccgcctcctgggttcaagagattctcctgactcagcctcccaagtagctgggtttacaggcatgcaccaccacgctccgctaatttttagtagagacggagtttcaccatgttgatcaggctggtcttgaactcctgacctcctgatccatccgcctcggcctcccaaagtgctgggattataggcgtaagccactgtgcccagcccaagattgggtttttaattataaacccacttaaaaaaatcctgagaaaatgccagatataataagcatatcttaaatgacctaagcaatagcacaaataatcttactattaaattattctaatttgcttgagatgatactaagacactgtaagcagcagaaactagaatttagtaagtccagcatcactaattttacaatgctaataatctcttctttcttttgctttttaaaataggttctaaatttgttggattctcttacctgtcacaatataggatcctattttggtataagataattaagatgggtttttgattatttctatctagattttgaatatattatttactgcatccctttaaacattttcatgaattgctgttgttaaaaaaaaaaagcattatggatcttgatctcttcctctctctctcttgcctcacctccctttatatttagttggggagctaagaataaacatagaaaataataactcttaatatgtcatgagtatcatgacacatggtaaaataccatgctgatttttccttccatgcatattataatgtttccttcatcccatgcttctctctcactgactggaatctcatgctctcctgtctgctctttctcctttctcttagcaaatagcaaactcctcttttttccttaagtcccaggtcaagtatcaatttctaatggaaattatctttctgagactacatgttctcttttacctaatcagtgttgagtgatatttagctttgatttcaatcaatgttatcattggatatgacaatatcgttcaattttttttctcccatcctcttcatttgtctgaaaaatgccttgagggcaggcactatgtccaattaatctttcatctatcagtcccaaaacttttattaaatatttgctatgtgtaaagcactgtatttgttgctggaaattcttgaccctaagttcagtatattacacagaaaacacttttgtagaatgaataaatgggactttataatacatcaaggaaattctacaaggcttattttaagaaaaggtcttaaatgaaaagctggtgaatgtggggcagcgatcaaggcaggacaaagagcaaccatcttcatctcacatcattaagtttaaaagttatgtattttccccaggtttaacgatattggtctggaaaataaagagaaaataaatatgtatgtttttggaaagcctgtggtgttgtaaaagttatttatcacggtcataattgttgttttgtggataggagcatttgagagaaagctgggattgaaatccctgacactgagtcaaagtcatgagtgtttctctactctttgctacctaatgaaaacaccaaaaaaaaaaaaaaaaaaaaaacaacaacaacaacaaaaaaaaactgcaacagtggagcttattttatatgacaatccagggaagactcaaaaggagtaaagcatgaaaccttggcacctgttctaagctagatctagatgtatgttaaattaaaaaggtataaagaaaaaataaaagcttttgttttcataaataaatctctgtttagtatccaaagttagtaaagatgtgaaaaacagaaactcttgtgcccttttgaagggaaattttataatacgcataaagagttctaaaaagtacatggccttcaacttaaaaagtatttggcacttttagaaatttctcttaaaagctactaagaaaatgttcacatatttttatatgagaattttcattgaattgctgcttataattatgaaaattagatttgcattaattttctaaataacttacagcagaaccttaaaaaagattaaacacattaaaaatgaagatttaaagctaaccgtttaacatagcaatttatcaacaatagttaagttagggactataaaacagtatatacagtattaatatcattttttgtaactatctatatatgtatacttcaagagaattaggcacattattatacatgtgatgcattttgatataggtatgtgagtgcatggaaatttttgaagcatatgaacaaattatgttttattatgagtgcagtggagttatatataatatggataagtagacaatgaaataaataatacaaagaagtagaaactcatacagcaaagatatcccaaacttaaaataacacactcatcatctttaatggaaactagatatgctttcagcctaagtttaaatatggatatatatggcccccagtctcgagtttccctagagcaacattagctattttgtgtatccatggtcacagcagttctacgataataaaagtcagaagatttctcctttttcttatccttcacctacagaaatgaaaatggcattcatagtttagaaagttcttagctcaaactaaatactggataatgcagtaaagcacatatcaataatcccaattgaaacagtctgggctttgatcccagacttcctggcaaacaacagactctgtgggccaataggcaatggaaatgagaatcaacctcccagtgaaaagagaaaccaacatcatgaatgaggtcctaacttgaaagaaaaatctaagaagcaatttctgaaacagccccacagggagtttatgcacatttgtgagaaaagtaaaaaataaataaataaataaacaaacaaaacctcggggctggcagggaatttacctatcatttagcttgattctttcatttcacagatgaagaaattgaggcttaaaaggagggcaaattgccaaagttgctctaaaaattagttctataaagtcaaatctcctgattcctaacctactgcagttcttatgtaggactctccagccaaaacagtactgtttttgtgtgctatgcaattttcttgacaaagagagattgtcatagcaattccttttctgacaatcacaggcagagttatgtagttctttcatggttctacagtacttaaaaaaaaaaccttctagattacttgcaaaacaatatcaaaatttttgcttatctatttccagtagtaaattttgtgttcctgaaggacaagaatcatattgtgtttaccttaaatccttagtgccaattgcattgcacaaaatatagcaggtactcagcaaatatttcataaatgaatgattgttttattctgttcattagattcactagtgaggagaggcactcctaatggactagccaagggacattatgatatgatggaaacagcaagttctcataggtgacacctggatttaagtccctcctctatcagttcctaatggcaatgacaccttcaattgccctgagcaacacattccttatgcataagttgggagaaatcatacctgctaggctactttccagtgtggccatgaggatcaattgtgataaatgtgaaaataacagcaattttattaatagcaaattattacgtgaatggaaggaatatgtgtggggggcttttaaacagggtctagctttttcagggcataccattcaaacacaatgcccattatagtaaaataaaatatataggattgtttctactgataaatgctatatgcttcaggtatgttttatagaaatccaaagtcattggctatattgtactggggtaatgacagcccagaggcataccattaagcctttgacttttgagtgatgcatccacagatttagggattccataaacttgtagagattttaagttccaaaattttctcctaaaatgtataaataattgctggtagggaataagaaaagtacattgccatgtagatactgagaagctggccaaaggatttgttcctatatgtctccagatgtgagatttttatttgtgtctcactgaagctataaattactgttaagttggtgcaaaagtaattgcagttttgccattaaaagtaatgtaattactttttgagaggcaccctcaaaggtaatttgcaccagcctaacatggttcatgcttctgggtttcttctagtataggagacattgtaaatgttaaattccatattgccagcagtctgctagaactgcacagaacaatttagttatttgagacaaatatatctacttgtaaataatcatccatgcaagggttattagcatcaaattaaggaacaactgaatcttaacaaaacccacaaacataaattgtatgagttaaaagagtgtattaagaggacaatgtgggaggcataggtgagagtgaggcataggtgagaaacccacatgctagaataacttgacttctttcacagagatagtaagtatagtcaaatgaaaggcacatttgcttcaaaggcacacatttctccaattaagtttgaatttcaattctagtcctgctatttactagttatacattaacaaattttataacctctatgaggagaaaagctcctcatggtgtcaggagccagagaatttagtatgctgagcagaggttaacccttttctggttacacccatgtggatgatgcaataagggtcaggaatattcctaagctgcaggaaaccccttctctgcaccaagcagaaacaagcgtgggggagggaaatgtggagaaatgctttagaatatctcttttaagtttcaggaagcgaggttctatttttcctgggtttctttgattttatgcttgctttcaaatcttgcagtgacagtgatgagagctcatggatcaacattaaagagtagggtcataaagacaaagaactaagaaaaacacttcttctggtgtaggctttaagactctgagatccagctcagctcacaaaaatcagaagttctacatagcaaagacatagaatcaacctaagtatccatcaacagataattgaataaagaaaatgtatatatactatttatagtgtatacatagtattctgccattgaaagaataaaatcatgtcttttgcagaaacatgaatgaaactagaggtcattataataaatgaaacaactcagaaacagaaagtcaatagatgcagaaaaggcgtttgacaaaattcaacaaccttcatgctaaaaactctcaataaattaggtattgatgggacatatcccaaaataataagagctatctatgacaaactcacagccaatatcatactgaatgggcaaaaattggaagcattccctttgaaaactggcacaagacaaggatgccctctctcaccactcctattcaacatagtgttggaagttctggccagggcaattaggcaggagaaggaaataaagggtattcaattaggaaaagaggaagtcaaattgtccctgtttgcagatgacatgattgtatatctagaaaaccccatcatctcagcccaaaatctccttaagctgataagcaacttcagcaaattctcaggatacaaaatcaatatacaaaaatcacaagcattcttatacaccaataacagacaaacagagagccaaatcatgagtgaactctcattcacaattgcttcaaagagaataaactacctaggaatccaacttacaagggacatgaaggaactcttcaagaagaactacaaagcactgctcaatgaaataaaagaggatacaaacaaatggaagaacattccatgctcatgggtaggaagaatcaatatcatgaaaatggccatactgcccaaggtaatttatagattcaatgccatccccatcaagctaccaatgactttcttcacagaattggaaaaaactactttaaagttcatatggaaccaaaaaagagcctgcatcaccaagtcaatcctaagccaaaagaacaaagctggaggcatcacgctacctgacttcaaagtatactacaaggctacagtaaccaaaacagcatggtactggtaccaaaacagagatatagatcaatggaacagaacagagccctcagaaataacaccgcatatctacaactatctgatctttgacaaacttgagaaaaacaagcaatggggaaaggattccctatttaataaatggtgctgggaaaactggctagccatatgtagaaagctgaaactggatcccttccttacaccttatacaaaaattaattcaagatggattaaagacttaaacgttggacctaaaaccataacaacctagaagaaaacctaggtattaccattcaggacataggcatgggcaaggacttcatgtctaaaacaccaaaaacaatggcaacagaagccaaaattgacaaatgggatctaattaaactaaagagcttctacacagcaaaagaaactaccatcagagtgaacaggcaacctacaaaatgggagaaaattttcgcaacctactcatctgacaaagggctaatatccagaagctacaatgaactcaaacaaatttacaagaaaaaaacaaacaaccccatcgaaaagtgggcgaaggacatgaacagatacttctcaaaagaagacatttatgcagccaaaaaccacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttagtgggactataaactagttcaacccttgtggaagtcagtgtggcgattcctcggggatctagaactagaaataccatttgacccagccatcccattactgggtatatacccaaaggactataaatcatgctgctataaagacacatgcacacgtatgtttattgtggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaactggaaatcatcattctcagtaaactatcgcaagaacaaaaaaccaaacaccgcatattctcactcataggttggaattgaacaatgagaacacatggacacaggaaggggaacatcacactctggggactgttgtggggtggcgggagcggggagggatagctttagtagttatacctaatgctaaatgacgagttaatgggtgcagcacaccagcatggcacatgtatacatatgtaactagcctgcacattgtgcacatgtaccctaaaacttaaagtataataataataaaataaaataaaaaaacaaaaacaaacaaacaaaacaaatactgcaggttctcacttgtaagtgggagctaaatggcatgtacacatggacatacagtggggaataatagatattggagattcagaaacataggagggtggcagaggatgagggatgagaaattacttaatgggtacaatgtaccttattaggtgatagttacactaaaagcccagacttcactacacaatatatccatgtaaaaatgcacttatatcctttaaattgaacaaattaaaaaactaaagaaagagaagtcttatgccaaaagcttgattgtaataaattcagtgatttttgtacagactatttcctgtaaatgcatgtgttggagggattgttgcaaccctagcaggcagtttgttaaagacctggagccagagtttctgttgtatcaactttcacatgcatcaactcatgagtgctgatatttctccatatacttattttaatttattttatttatttatttattttgagacagagtctcactctgttgccaggctggagtgcagtggcgtaatctcggctcactgcaacctccgcctcccggattcaagtgattctcctgcctcagcctcctgtgtagctgagattacaggcatgcgccaccacgcccggctaatttttgtatttttagtagagatggagtttcaccatgttggccaggatggtctcaatctcttgaccttgtgatccacccgccttggcctcccaaactgctgggattacaggtgtgagccaccacgcacggcccgtatacttattaaaaacagaaaatattgatttttaatatgttaaatgttggtttccaaaaaatagagcagtttaaccatcttcatagctttactaatacaaagcaaaaagaaatttcaatgcaaatggaacggtattgatttgactatgaatcttcactcttctaatcaagcattcttttaaaaattctaaagacttagagagtatgtcttatggttaatgttttgtcttctccttccttttgttctcagtgattagcacataatatatactcaataatgttttctcagtaagggaacccatcaatctcatgaataaatatatctctctgacgtttttcccctaattgacaattacctgaacttttgggtgtaggaatcttccctttatttttttccttgacactgacatattaaatttctgatcaaggcttctatttctataactagctttgatactctgccccagatctctagggtcagactcttccagaggcagctgtcaagtgctgccaatagcactggaaaggaagataataattcaaatcccaattctgcatctactagtggcatggcattgaacaatttgcttcatccctttggacctcagttttctcatctgcacaatgtaaagaaaaaactttgtggttcttaactagaagtgctcaccaaaatcatctatggacctctattaaacatacacaagccaagattcatacaaagagattctgattcagtaggtccacagggaggaggagagcaagaaaatgtctgtttttctaaaatgatccataaatttcacagtctgtagtttcagaaattccaggaattctcaatcatttatttgcaagaatttattaaagatatggtgtgttctttttattttaaatcctctggaagaaatacactagatgtttcaacattgacttaattcattttaattattccattaatcatcaattttaatggtcaatttaattattaacaaatgagttcgaattcctttggtttctgcctatagttaatcaagttctagaggcaagaaagtaatatagaatattttaggcagttgatctcaactgtgaaaataactagctttcaagaattgactaatgctagagaggatagctctgtggctgacaatactgaggttactttacatggggctagatttatacctaattatggagtagatcaagctcatctctggtgctttttattcccttcaacaccctcatcctgggaatcatgtgggcatacagtattttaggattttttttggtatcctgtgaaactttccccatctttttatacttgtattctttcaatgtgttaaggttctaatacactaattgatccccagatagtattgttacctctccacatcttcatttctttacccctaaactgtaagatattgcttaaattttaaaagagaacttcaagacaatgattatcttcttttaagacttgattcaaatattgcttcttctgtgaagtcttccctaacttgcccaggcaaaacaaggttttactttccctaggctgtatttgcattttattttatgttgtacaaattatctgttgacatggatttctcactggactctacatctcttaatggtaaaggcattgcctttttacctctatatctgcattttctgccataaaccttgacatagacagttttaaaaaatgcttattgaacacatgaatgggtggaaaatgtcagaatttcaaaaaatgtttaaaagctgtcttaaaccttcaggcaaccttagaaaggggatctttggaatcctctcaaatgaagcatattactgaatttgtaccctacctacaaacctatactagactcaactctgtccctagcctgtaatgtccattcaataaaatcttgtcactttattttattttagaaagcttatcctatctacaataggagtgttattttaaaatctgaagagaaaagaaaaagagaaactggttaggagacttttgctcaaatgggaagcaattaagattgaaactagattggtgtcagtgggagaataagaaaaggacccacttggtaagcacttactgctgggccctgtgagtcgagcaattgatggtatgccatctttttgagaaaccttctaactacaagttatcattggtaatcagtctgttaagcaagtctgtcaccaaaagagagatctgatattcaaattgcatttagtgtttcaaaaaacagagtgcaggcagattttcttcatataaactacttttttttaggcatctgaaattaatgaattgcaaaattcaaataacatgttttatacaatttgaataaaaatgtgctaagagaaactgagttatacgtattagtcaattaacaagctgcttctcatttgccatgtagtttttataacactttagaacatttctttctcagtatttgttatcatttatagaataattttaatccccaaaataggcatattagacattttatagcatatgttttcatagaatattcatttataaatttctagatactggttaatctataatagggtgtttactgattactatataatatctactattcaataattgtgtatgtgatggtatatatattacatactggcaattatttatagaagagacattttacatagtatatatatggaatgcacagacatgtgtatttaagccttgttacttgctatctcatatttgaattttccactagaatataagttttgaaatgactttattttctaatctctaatagcaagatataagaaaatctggctgtccttagatactgtatatatgtactttacagccatagaattttagttgcagcatgcagggtatgtatttaccatgtaaactgtatagttaaaataatttacagatggtcagataaataaatagaaagaatattaaacaatgtgtttgcatttagattatcatttttaatgtttccactatacaggaacagataagcagagaatggcatggatctttatagttaaatagcatggatttgtgaaaaaccactttagtgaagtgaaaaagtatatttccacagacattattaagaggtgagaatttctcaaagccacattgtaacatagtgaccataacatatgacacttctcagtgtcatcatgttatattggaatgtaaaatattattgcaagaaagataataaaaatggcatcaaaattagctaccttaacagcttctctttttcaatctcttagtcttcctagatgaactcctggcttggcagaaatctctgaattctgctcgttccatgttcatgaatactaataatgtacctcgaaatatgatcccttaacatgaattaattctgcttcccaggatatatttttatttttcacatttcacaaagatttatgagaaataattgtttggcatttatcggcatccatgttccactaattaacatccttgtatatccatggggaagaatagacagaatctaacaatccacttcctttatcttttaacaacgtgtttgtttctgtttggagactgttaattagtttaaccttagactctttaaaagcattttatttcttttttaattcacaagttactgagaaaaagcatagagcaactgattcaaattaagaacaaagcattatctcatatatttcttataagggaggaattaattgaaaaataatctcatcgtggagagagggaaatatccagctggaggagaggaggtgataagtcactgtattttcttatgtttcatcagacttctttcccctctaaggggcaagttagaggcttattctaataagctcttaactgtagccagtttattcaagtttaagctctcagcttcatcatatattggcttttcaatcttaagcaagccaattaggatggtggcagaggagtgtagaggttatatagattcatttggtcatttgtttcctttggtcagccaggcactttgctttatgtagttcatctcatttaatctttgtaaagattattatttttactgttcatcaaagtaggcatgattaactttgctatattctagaaaatggaaacccagtgatattaaacaaccaagttaatgactggtaaagataataaacatacacttgggcaatttggggaaagaaataaaataatatatgtactttgaaaacaaggcagcattaaagacatgtaagatatgacatcatatagggacattcaatcaagatgaactgagaccaggtataatgcagttaatatgtcaaaaaaaaaaagttgaggagattcttcaggaatatggttgccagatttagcaaataaaaatatcaaatatctgttaaatttgaattttagaaaactagttaatttagcataaatatatcccatgcaatcttagggatagctgatactaaacaaatgtgtttcttaaacctgatatttgaatttaattgtgtgtcttgtattttatctaactgccctactcagggactttcctttataagaaataaaggctagagaggcctctactactgaggacaggaactgggaaagctgttacagtaggacctctgtgctttgattatgcatctaatatgatgactttcattattggagattaggccccaagtatgagaaagactgaagagtaaaatggtttggaaaaactgcagcctagattagcaagtttgagataatggaagggtgctatgtatggcagtaacactgagatccataaaagccagtaataattaggtttggatagctgagtaaagctttggttaaaaaaacttgggctggctcttgaaaaatgagtatatgaagaggaataaaagaggattagtctctggtggcattagtaaaaataaaacatgggaatgagtccttttcaaatatcaattctgtacaaacatctgtagctacacaaatattacatgaagaaacagctgagaaaaaagtaaatgctcatatataagattagcaaggtatggtggggcccagcaagacagggattaaattaggaagagagtagatactgaagatcggtcagggagctgttagagtaagcatcctgaagaaggcataaacaggcagaatgaatcctgttcgttgctcctacaaacatgcagcataggaggaagggaaacagcttttactgagaagctgtatttgtgtcagtcattgatattttatcatattaaatattcaaagttaaattaattgtgaagtataaatatgtatgtcagtatgaagatgaccaatgccaaccaggatcattgaataaaaaagagttttgtttaatctatttattgccatctatgtccaaagaggaagtcaatattggcagatagtctccttgtgctcaaagagttcaaaaaactatgtcacaacttaagagaaacagaactggaattaggaaatctggttgtgctattaacaagttaacagagtttattcatctgtaaaacgggaacaagactatctcagagaaaaagtataaagattctattagataagttttgggcaaagattatctcagctctaatattctaagttccctcctatggaaaagccattattctagaaacacctttttttgttttttttccattctcaagatgctatgccttaacaacactggggggtggatcacttagaaggacaacaattcaagtattcaaatacgtgtttccagcaggacagagactaagctggtgcctttgaggacaaataacagaagattttttttggaaaacattctgaacacattttgatagactttgtgacagtttggagaaaaaagatacagagcattaaaagcgggatatgaaatctaaaatataaggaaacaaggactttgggaatctgaaccaggaaacagaaactcagtttgaatattttataacaaagacctgttgtagaatccacagtattctctactattctgtgctgtagaaaaattatgaccctgggttcttttagatacagaaagaagaaaatattccagcaggtctctcttagaagtagagaagaacatttgctttttggtctgatatcagccttagagcatttttgcagattgggctcactctgtagaatgaaagtagaatgaattctcaaaattagggagaacggtctctataatttaatacctataggacaaactatatgtatgacaagatgagaagtaatgatacaaaattatgtactgttttatgtattaagtgagatatcttacataaagcataccacaggcacacaatatatggtgatttccttccctctccaatcacaccctgccccttccagatccaatgcatatcctcttccaggggtaccatgcgccaacttacccagagctcagtggtacaaatttacagcacctatcagtgataacagccagaaatgacatactcttcccaaaaaaggcttttctctgcagcgtagagggtagaattaggtcagttatgtaagactcatattaaacgagtacactttgggccactttggtgatattgttaatgtttctgccttcaagtggttacaaaaggaaggtgaagttaatttcccttgcttcggaagttctgttttataagtctgaagggtacaatattgaaatgataacctacattcaatattaaccatttgctgccaaagtaaatactatatttcgataatttcataaatatccaagagaaattgtcccaatattcacatatattgaagttagctcatcaggaaaagtcattttagtgatgaggctctgaagaggcccccaaaaattgagataattatagtgatacgtcaactgcaaaaaccatatttgtgagagatgctcagttatgtctgaataagaatcttagaattatagaatgttccaactggagaggatcttgtctaacacatttatcatagagataaagcaattaagacctggaaatgttaaattatttgcttaggattgcccaagaaatggaagagatggttctgaaccaggtcttttgacttaatttttttctaatgcatttgttatagagataaagcaactaagacaaggagatgttatttgttctgcattgttcagtaagtggaagagacaaaaatatttttcaatcaacaaactcttactgttgatgttaatatggctgacactgcctctctgccttaaagtgtattacaataaaatgcaaagacacctatgaaaacctttcatcataaaagacgaaatttcatttttttcccaaaacccaggttttaacacagaaaactttgagctccaagaattaaaatactctttttgaagctagaatactaaacatccaattttgcatgtagggaaatagaaacaaatattttaaatgttttgaacatagttttcacagctagaaaattacttaaaaaaaggcctctcaatctctgtctatgcttgtttcattcatattttatagcttttctcacctgaattctggtaaatccttatctttctgtcttacctccctatcactcatcctgaatttcatatatttatatttgatttttgttttaactccggggaagattagtatttatctcattttaatattttctctttgtgcatttcagtacattgctttagtattctaatgtcctccaaaatttagatttcttgcaaaagaaactgctgattcttaccaggtttgtatcacaaataaatcttttaaataccgtcttttagtcttccaacaagttgctgacattttattcatgtttgtatccctgtgacttgcaggtagggggtactaaatgctgtctgctaagtgcatgaatgattaatggaacagcacaaaggggagcaccccaggctggggattttttagttctctcactaggtttgccaagatgtttcaatcagtattccttgagtaccacttcagagtcagcctgagtgtgacttattctaccaccatctactttacttcaattttctataactcatttaaaaaaagaatgccaatgaaaattctgtcatatgcttgaaacattttggggctcatgttagtggaatgacttctagttttcccagcttcttccagtgcaagttttctaaacatatctcaaaaagccccagttttatatcacaacagtttcatgagaaagtgaaacagtttcatgagaaagtgaaacagactatgaaccttttgtactgatccatagtatctctagaaattaagcaaagtagatacacagatgagtatgcatatatttttacatataacatataaagattcatataaaatgttgaatcatctggagaatttcaggcttgggtaggaatatacaatactgaataaagtggctcataacgttttataaaagaaatattatctttttatttcatctcatttgactccacctatatatcctaaaaatttttacaataatactttccctgattaaccattaattcaaaagataaaaaaaaacaagacttagccttctaaattccagttgcttattggatgtaatagtacttttaattactaaatgattccaaaattaatactattggactctgacttctgaccataatgttttaacagaaatcagatataccatcctatgtgaaacaattaaaaaactggacaagatatacaaaacaatagttttcaagaaatacaatattgaacaatgtaggagagtaatccctgagaaatgagaaacaaacaagatgaaccctacaattgccctagcccatagccacaagggaatttccaggccattgcaacaggagtctgaggacacaaaggcttctaacatctacaagatagaggactagagaagaggactctgacaatccacagagggccttttttgggtatttagcaaataatttatcagtacctgaatgtgagttagccattacagcctgcaaaacatacagtctgaaagtattgaatcgaacagtactcaggatacacagaagacctggaatagtgcctgtacccataaatctaagtaggaagtcttataattcacagacacagtagaatactcagaagactattgcctctgcagtggagaatatttctatatatatactaaacacagctgtagtcctacctaacaaattataaaatagtagcagtaaagaacaagctgcttccaactaactgaactgcatcccagaacaaaattgaagagatttataaagataaaaagaatacaacaatcacaaaagtaaaatttacaatatctgaattgcaatttaaacaagctatcaggcatacagaatagtgggaaaaaaacaaccaataatgaaaaaaaataacaagtaattgaaactttcccagaattgaaataaacattaccatggatcaaagtgtcaattcattaagtagtagaataatcctaatcatgtaagcacctaataataggtctgtaaaatacataaagcaaaaatgaatgaaactgtaaaaataaaaagaattcacaagcacagtcataatttaaatgtccctctctcaataacttgacaaaacaagtcaactgaaaaataagaatatagtagacttgaacaacccatcactcaacaagggctaactgaaatttatagaatattccaccaaacaatggcagcatatacattattttcaaggacacacaaaacacttaccaatatggaccatattctaagccataaatcaagctttaataaatttaaaacaattcaagtcatacaaagtatacttttgaccacaatagaattaaattatatatcagtaccagaaggatatctgaaaaatcttcaatatttgggaactaaataaaacatttataataactcatgtgtcaaggacaaaaatcaaaatgaaaatcagaagatattttgaagtatatacaaataaaacacaacatattaaaatttgtgagttatcaatttagggcattatatgctatattagaaaagaaagaaggttcttaattgagtttgtgttgctataacagaataccagagactgggtagtttataaagcaaaaagcttaatttggcccataattttgatgtatagaaggttcaagattggtcatctgcatctggtcagagtctcaggctgatttcacttattgtggaaaataacagaagggaagcttgtatgtgcagagatcacaaggtgatagaggaaacaaagaaagaggcgaggtgttagcctctttttaacaaccactgcttgtgggaactaacagagtgagaactcactcatctctgacagtgggcattaatctattcatgaggaatcggttcccatacccacatacctgtcattaggccccacctccaacattgaaatcaaatttcaacattaaatgtttgggggacaagcatgcaaaccagagaaaaacgtcacaaatcagaggcttcagcccctgccttaagaaattggaaacagaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcgatggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaagaaattggaaacaggctgggtgcagtggctcatgcctgtaatcccagcactctgggaggcctaggcaggtggatcatgagattaggaatttgagaccagcctggccaacatagtgaagccccatctctactaaaaatacaaaaattagccagacatggtggcacgtgcctgtagtcccagctactcaggaggctaaggcaggagaattacttgaacctgggaggcagaggttgtggtgagccgagatcatgccactgcactccagcgtgggcaacagagcaagactccatctcaaaaaaaaaaaaaaaagaaaagaaaagaaaaagaaattggaaacagaacaaatgaagataaaaataagcagaaaatagcaaataaaaatcaaagcaaaaaatcaatgaaagagaacacagaaaaacaatttaaaaaatcagtgaatcaaaaaagctagttatttgagaaaaatcaataaaactgataaatctctatccagattggtccaaaaaaaaaaaaaaaggaaagaaaaggcacgaataaccaatatgagtttttagagaagttatattgctacaaattatataatattaaatggatcataaaaaaacagtgtaaacaattttatgcccacaattttgacaatttaaataaaatagaaaagttccttcataattaattctggaagaaacagataactctaacagatctatctatctgtctgtcggtctgtctatctatctacataaatttgaaaaatcaatgtgtacctttttaccaaacaaatgaacaagcaaaaaacttcaaattttattgttgagtttattttaataatttgagattggtttattaaatacataattaaactaaagaaccaaaatatcactccatgaagagaacaaaatttggctcatatagttgattagtggtaaaatatcttcaaattggtttggaattttttagtagaaacacatatggatattttacacaaataattttggatacgtttgcttattttgccactgtttacacgtaaacagtacataaaatgctcttttgatttaggaaattctaatattagataccacagaatttaaatttctctttttttttctattgattatttttccaccagacttctttgtttgaacttgtggacctatccaattttcagctgtacttgatacaattcccaaaccctgaaaaattattttccagtttcatgtcatcatgtgatatcaactcaaaaagtgttaatatttaaccatacttaaatttttgcattgatttctaatttctttgactaatgtttataaaaataccatcaactagtgtaaggtatttttattacctaccaaccaatcaacatacaaaaattcaaaatcactctgaatgtgttagaaaacaaactgaatgctccttgagggaaatataataacactgagttatttattaaattattggatgctaacattgtggtagccaggtactaagtcctttaaatatcttttctgtttcctacaaaaatgtgagattaatttataataatcattatgcataagaaaaatgaggtttaaataaattaagtaacttggctgagatctcatgctgataatccacagtgttaagaactgaacgagctctgttaaactttgaagtctatatttttagccaacatgttacactgcttccctaagtctgtttctttcatttctatagtcattgtaacttagaagcagtaagtactcacagaatgcttattacatgctgagaaagttgattgctaacattttcattacttaaactaatctaaacctcagttcctttttggtatgaaaagatagtttataaaatataaacataaaaaactataaatctacctctattataaaaaaagaaaaaataaaaatgaatgaactggctaaaggatctatgaaagcttgatttttataatgccttggaggacagatgaaattttatatgtcttagttgggacaccacatttggtttacttgccaccattattgctggctttattcagcaatatgttgtatcatgattatgacagaaaaataatcagcctgtgacattcctcaaatgcctccattctgtacaaaagtattacccaacctgtatcttaaaactatatacatgatgatatgctgacttttggctccataaaaataagaaaaattattttattcagtaaacttggagaagcagaatgatgaatacatcttcaagatgtgaataagtcatgttctttctagtagcaagattagatttataaatgtaggactgctttgatacttgtataattttcttattatttttaaacacttattacatagaaattattgctttgcaagtgatagtagaccaatatatttattatatttgcagaaggcattattcatgcctgtcattcaaattattattctgaaagtagctctaataaagtagttcatttgcacaacaaagctgactaataaacatatgtctctaaatcacagtttatataaatattcaatgaaatcagcagaagacactaaaagtaaatgcagatttcaattttatgcaaagggaaattaaaaaaagacagcattattgtatagactcaaaaagttgttatggttggacagaacccccaaagtcattgaatccattaattgaatctattatgagagtttacatttgtccttgataaatttcaactttctagaatatgtccagtttttccatcagaaaggatttttttccttccaattcttattctataattagtcacattggtttaaacttccagctctaggtgaaggacaaatttcaaaagcaacattttcaagacttcatacaaatcactaacaagaatgcttccaaagagagagaggcagtcctaatagagtggaaagagcataggtcttggaatcaaaataaataggtttgaggcttgatgccataatttctgagcttatgaccttggccacatcacataacactgtgaactccagctttctcctctgaagcagagaaaatgtatcaaaatatgaagatactttatcaactgaaaatgactatatacatttacatatttgtctagattgtgcagtagatatgctactgaagaatatttttcagttgctattaataaacattatttaaataatgaatcagtctaaattaacatgtagctattaattcatctaaactcacatatttatataaccttagacaataactgcacagatttttcccagatatcttgctaagtttgttatctcaatagtcattttttgaaacaaaaatgaaagaattcatgttgttaatggcaatagcatgatttgtcattaattcttgttaaaaatgaaaataagtttactttttcttaaatcatctttagcaaatatttgtgggttactgtggctcacttaattcctttttaaggacttcgtcttagttaattttgtgttgctataacagaatacctgaaaatgggtggtttaataagaacacagatttgtttcttacagttctggaggctgggcagtccaaggttcaaggacccatatctggcaagcactttcttgctgctttatcccatgttggcagacaaaaaggcgagcaaatatgtgtgcgagagagaaaggaaaggggctgaactcatcttttttactagaagcccactcctgccataagtaacccatttccattataatataattaatctattcatgagctcaaagcccttatgacctaatcacctcttaaagtcctccctctcaacactgttgtactggggattaagtttcccacacatgaactttgggggacatattcaaatcatagcagattaatttttaaaaataagccagtgtacatgcctgtaatcccagcactttgggaggccaaggcaggcagatcatgaggacaggagatcgagaccattctgggtaacacagtgaaaccccatctctactaaaaaatacaaaaaaaaaaaaattagctgggcttggtggcgcacacctgtaatccaagctactcaggagaatggtgtgaacccgggaggcagaacttgcagtgagctgagatggcatcacagcactccagcctgggcaacagagcaaaactccatctcaaaaaaaaaaaaaaaaaaagccaatataatcagtaatatcagtaatattatttttccattattgctattctttctcgagccctgtaccttttgaaataaggtgttcactggtttgctggtctttgcagagaagtattagataaaagcactttataatttgaaaaactatgatgaacctggcttttacagttattaaccctgcaatcttgggcaaatagctttgcctctcagagcactgaattgctaactgatagaaatgcagaaaacattttttaatttgttaatttgtgatgaaaattaaaggaaataatgtatacaaaatatttcgtaaatgtctaactccaaatgttacctctctatgtcttgttttgttatcatctcactttcctctgtgaaacagaatgaagtatttctaagtgtgtcctttggaggcatggattcctaaacatataatacaagtagaaaatacagtgagcactaaaaaatagtttttctaaaatttgcataagcgaacaaaagcacaaaaattattcctgatgaaagtgattttctttaggggcactggaaaatatagcctcatacaaggaaagaaaaattatttttattctgatgtataagacatcatttcagaaatatatacaaatggagggtgttgcctacagatacacatcactgaagccaggaagtttttaagccaaggtaacaatcaatgacctcagttgaattcccgaaagggctctacatcagtgttaaaatggccatagataagaagataattaactatctgtcctgagaatctatttgaaagagctgttctaagtttctgagagcaaaccattaaaaacagaaaagtgaaagcagagaatttgggcttattccattcactggcctcctgttttctattaaaagggttgatcgtaactcccttattttttgttctctgcatctttgaacacttgcttgaggggccaaaaaaaaaaaaaaaaaagaaaaaagaaaaaaaaaaaagcagggggcataaagtaggaggaggaagggtcatagttccaaaatatttccagaccatccccagacaaagagcagctcaggtttcgatgtcaccttcctccatgatttgtaagccatatccttagtttctctgttccttctccaatactactttgctttcaatcctgagcagttcttctctggactattgcaatgataggtcatttgatattcccaagctctagtctgattttcattttgattcacttccatattactcctggagtgatcctttcgatacaaaatttgctcctgaattccccctgcttgaaatcttctataattctactgctttcaggataaagtttagtctggaaaataaatcacttcaaattttgaacctatgtttccagagtcttctctagccacaaaaaattaaaacttgaaaaacacccttaactcatgaacaccatgaactcatttgtccctgttagatgagagacaagagctaggccctcaatacattcttggtgaagaatgaattattgaatactggagttcccaatttcctacttacattttatcatgaagcggcttatgcttaattctttttgatgactctttcatggaaaatcatttcagtggaagtttttatacattattttttgaattgagaagagatgattactttcccagattattgtttagatcaaatcgtttaagtgacttcatataccacatattttgtgagcaactgccaagtgccagacactgagaatacaatggtaaagaaatagatataatatatgtcctctggaatttatatcttagttggaaagagaattaattaaatgaataatttctgtacaggatgacgcatactttgatattgacctattgtgttatagccactgtgctatacatagttgagcttatgatcttgccaataagagatatatagataaaaatgccgaataatatttaatcacaaattacataaaggcaatgattttaagatgcaggataataagcaatcatgcaaaagaggtgaagttattttaggtagcaagggaagacttcactgaggaagtgacatctacactgatatttgatggatgagtaggaattagctgagctaaaactgtaagaagatcattccaattaaaagaatagcatgtgcaaatacggaggcagagaagagcttggcatattttaagaactcaaacaaattcagttcagctgataaaagatgtgaaagtgtggcagcacacagggctggaatacaattatcttcttaagaatattgactcttccggttcctgaatgtggtacatctttccctttaagtctttatttcttctcggtgacattgcttgccaaacttttcaacctttcaatccatattctttctctctctctttctctctctccttccctcccttcctccttctctccctccccttttgtcgcccaatttctctctggaaatttgaggtatcttttctttctctccagttttttgaagtgtgactaaaacgcagctcaatagttttcaaccatccaggaattaaaagggtaatttcaatcttgaaattcatgttcttcagttctgaggatttttcttaaaacatgattttaataatttattcaattcattttctctattcttttgcaagtttttcttattctaatgctgggaaatcccagagcagttctccagttttcttgtgttttctctcctctattctattcctttgcctttttgttttacatttttagatatttcctcgatttgtttcttcatacccttctattagatgttttatttgttacatatgctttcattttaagaccttattatattcctttgtggaatataataatgtaaatattatttataattacattatttataataatgtaaataatgtaaaatgcttcctttgtggaagcatttcctgccacttttaaggatgctgtatattttgttttgtgtttaaggatattattattagttctttaactttccacctccctgaagagtttctatatccttcagtattttaagtttactggttttgtgctctgtcttcagtgttagaagttttcctcagatgtactagtgatgtgaaatggtctcttcataattaatgttaggggatttcaaaaaaaaaaagactagagactgtgtctgtgagtgggacctgtctattgtagattttacatcaggaagtactactgactaggatgctctctggctgatcacccatgttgagctggtttcatgggtctcagggaaggagatactcccactttcctgcatagagagaaacttctggctacctgcattctaggatcccaactggagaagagaacttgggctatcaacatttagtttgtaaaagttttcttatttccacatttcagtatagtgccttgcctctcacctgatgttgggaccttcaatccagagatcctctttttcaccctgtactctggatacgtttcaactctttggctaactagataggattctggggatgcttattgcttaaacaaactttttattattcttgcttcttttggtcctacgatcattccatcttccagaagtaactgctatcacagatttccgagcttttggaaggttctatactgcatattggtttactccttggctgagaatttggctttctttgtaatttagttactacttgtccattttaaaatttgtgttgctatcatctcttcttgcattccttcggtctttgtaagatttaagggcaatgtttctttattctatttggaagcattaagaaaaaaaaaccctgaaattaaatgtcagtgttcaatctgctgtcagtattggaagttgttctgattggcttttgtggacttcacagaattttctggtggcgggggagaaggactgaggatattagcagtcttcgatgaacatacaaggaactaccagagctagattacatggaaagattcttttattccttggaatcgctatatgaattgctctcctccccaccatcctgtacacaagcactgtggcttatttagaaagctgtaaatcagtagcctccaactttactggcaccagggaccagtttcatggaagacaatttttccacaggacagtggggcggggcaggggggtggtttcagggcaaaactgttccacctcagattattaggcattacattctcataagtagtatgcaacctagatttcttgcatctagagttaataataggggttttacgctcctatgagaatctaatgctaccactgatctgacaggagtcacagttcaagtagaatgctcacttgcccactgctcacttcctgctgtgttgcctggttcctaacaggccacagacctgtactggcccttggcctggcggttggggacccctgctctaaataatttaccagtacctacatatggatatgtgtgtgtgtgtagacgggtatgcatatgtatatggcaaactgaggtttcttaactaccatcatcttttatgagtcatatttcatattgcatgttcattttcagagtaacatatactacatgcatagtcatatttataaatctaaacatgttttaattttagatatataacacagatgagttaatatttatgagctcatgtgaaaacttcactaagcacgaagtttgcaactaagtaccctgcacatttcttagtgccttggtctgccgtgttttcttttttttagtttttcatgtgcaagtctttatttttattacctatctgatggctatttaacttatgctaaggatcatctcagttatttcagttaacaggataaaatcaactacactggatcctgaacttttttttttttgagttaaggtttgttattttcttaagtactgctgaattttttctttgttgatgtatattgtttttgtgaacacccctcaaataagattgaaacagttttgctatttcatccatattatcagttgccttcagtttttcctctaggggtactatatttacattagcccaatctgctcagaaataccagagacagtctttactttccttacttgccactctaccatcttcattatattgagaaatgagttatgtcttaaatcagcaaatcaacattttctatgacttttatcaagatgagggaatagatatttgacatacagtgtgggtgtctcttgtaaaagaaattgacaacacaaatcacaagtgggatgcaactaatgctagagagctgctttatgttttaaatatgaataaatctctcaaaatatgaaagtggaaagacaagctggactcaaatgattacagcttttagaattaaaataaattagggcaaatactggctctaaccacaagagagattatcactgtttgcctatttctgaaggaaccctcaaggaaattaaggtggcttgggttttagtgcaaataacactacatgttttctttaatatttccatttctccttaattcatttcacctgttaacacaaggcatgcccaaacattactctaaacattaaccaaactccatgttctaagtaagaaataaaatgcattatatttttttggacagtcactgggttatgtaggaagaagtaattatttttatataaaagaaaatgatgaatctcactctaggtgttaagctggtgttaagaggtgttttcttctagaataatatccttaaaggtatatgaacaaatgcgggaggtcttgaatggtagttcgcagagaccattatgatgtcaaaataatgtaaggccaacagagtattgacagttcaattttcagttttagcaatttttaagcaaaacaaattaccataaattactgtcatctaatacaagaaagagtattttacttaccaaaataaaaaagatggtttcttcattgtacttaccaaaattaagtattaaatatttagtacatatttgctgtttttcttagaccctaagttctgtaggaattagtgatgaaaaataatttttaaaataaaggccattatcaactacaaatacacagacacacatgtatgtacaaataattatatatataattattttatttatttatttttcttttattttggacctttgaaaatttcattaaagccttccaagggccaatggaccagcatctggtagccactagtccaatgggtattaggtaactgatgtccgttttccaccatctggacatattgtcactggtgactgtcatatatgtactggacaagaaggattaaatggcataatgcccataaaaagcattttgtaatctttaaagcactaaataaatataaggaattagtactgttatggttatgatattgcctcagaatgcatggtaacaaattctaacctgaaaaaaaatccctttatctacttaaaaatcacaagactatgtagacttttaggaataaaattttcccataggagtggtaatcaccaactttttcaattgttttgctacataatccagcctgctatagaaacttcaaaaatggaaaagtggaagtgtcaggctataacaatctcttgagatgtcatattaaatgtaaatacatcttgaaagtttcttggcatatcattagagcaagattctactgtaggaagcaagaggtttatttgtaatggagtattttttttaaacagcaccgtcttctctggctaaataagcaatttgtacaaatgacaaatgtgtttattttgcttgagaaatgaggacatctgaacgccagttatttacaaacctctatgtaaataacttcaaatgcaagacctatgtaagtaatttaatcaatgtgctaagggcagtgccattcacctctcctgtaattgcatcaccctcacctactgacctcatctggcactactccacatcagcaatgttacattttcctcccttaatcttccagcacacttcatctttctggatgtctagtcacacatccttacatgcatactcatatttcacagagatttctagacctcatatttcatggagatttctagatcttttagtttttagttttctacaaatatgttatgctcttcttgctatgtaaactttgctttaggacaaatgaagagtcagctagttcccctgcttacgccattttcatttcaccctaacactctttgaacagctgactgtgcttattttgtaccagaacataaaactactcacttggttggttgtttgaatcctgctgcttcttccagacctgctattttgatctcagatgattccaggattctaaatgagaaactttaaaaaatcctatctgctaaaatatggattaaggtttcttcagcttatttatttcattaggtgcttattttgtaccaggtattctttatagtgacataggatagagcagtaaacaaaatccctttcctcatggagcttaccttctagcatagactagagagacaataaaccaaataaataagaaattttgtagcaaatgtgctacatgttataaggcaatacatattattgacaaaaataaagtgggtggggggtaaagactatcaatggtagggtatgtttcatgtttaaatgtgatggtcagagatgtttcagtgagaaggtaacatctgagtgaagattttacgtgacaaatctattgatgttgatatctgggggaaggttgtttcaggcaaagagaacagtaagtgcaaaagccctgaggtggaagtgagactaggaacagcaagaagaccactgtggctaaagtgaattgggacaggggaggagcaacaggacatggatgagaaaggcagaagaggtatgtgttaatctggtaacatagtgtaagactgtgggttttactgtaaataaatggcaagtaaattagatggattgttagaggagaaaaaagataaactcgtatactttagttaccatctaaaccagaatccagatataattgttttgtgttccttgagatataggtaattgtacattcacaacttaggatcctaattctcatccaatcttatttgttctaatttgggcatatatatatttttctttaaagtgtttacttggaactggagatatgaggacccaggatcatgacaggacaatataagaagaagaaaataagtaaattgataaagacaaaaatataaaatgttatttctaaatagtaaaataacaaaccaatcccataaaaagtaaagaaaaggatacttgttatcacaattattatacaccagtgattaaaaaattttagtgaatgtaataaatcaagaaaatagtatcattagtataaggattggagataaattgactcagatactttgtgttaataaaattattgtgcatgtttaaaatccaaaacttctggagaaaactacaaatattaaataagaattttgaattatacaaacattaagtggcttttctcattattagcaacaattagttggaaatcaaaaatatactaacgaaattacaaagggtggtaataattcaagaaaacacaaaatatttataaagcaatctgtctttatggcagaatgtaaaaataggaattaaatgtcttctcttttttattagaatatttaatatcattaaaatttcagccctctaaatattaatatttaaaaacttaattttataattagaaaaaaatcttaaaaaattcttaaagaccaacaatatttaagagaaaaacaaaattagtatacgaaaactaaaaataattagagtggcatgacttacaagtattaagtataatagaaaaacaatgtaatcaaaacactatgttggcatgcttggtggctcatgcctataattccaacgctttgggaggacaaggcaggcagatcatttgaggccaggagtctgagaccagcctggccaatgtggcaaaaccctgtctctactaaaaatacaaaatttggtgggtcgcggaagcacatgcctataatcccagctgctagggaggctgaggcgagagaattgcttgaatctgggaggtggaggtttcagtgagctgagattgtgctactgcactccaacctgggcaacagagtgagacttggtctcaaaaacaaacaaacaaacatccacctactatgctgctacaaaagaaagataaataaaacaatagtaccaaagagagtatctaaaatgatataatagtatacagaaaatatataatttaaaatatgtataattctaatgaaatatgaagaagtgttgttatttcaatgggaaagaattctttatttactaaatcatgcaggcacatctgatcatctatctcaaggacctcgcaatgcaccaattttaatttaaaaaattgtagttggattaaatgaataaagatacaaaacaagaaaacaaaactttgccagttttcagagaaattttttggatcaaaaagaggagtgaagaagctataaaataacttttaaatatgtatttgattatgtacaagcaaaaaacggcaaatttagcataatcaatatcctagaaccaaagtatatattgaggggaaatctgtatgtcaatgattataaagccaaagagaaatgtgaggaagagaatgtccatattcacattggttacctggggagaaagtaagaagagacaggaagaagggagaggagaaggtagacaaaaggaaaaacaaacaaacaaacaaaaccacaaaaaccaaaagagataatggaaagaagaaaacaaaacaaataatggaaaaataaaaaatatatatgcactagcataatgtctacttatattaatgctacatgttaaaaaggatgaatggacatattgcaaagcatcaaagaggaaaaggcaaatgaaaacaaagatttgatttggggattggattttggaaagtattcttctgacattctgttatagcaatatagtaaaaatatatttaaataaaatatatttaaaatatatttaaaataaaagtgagagagagaggcttcaaaatggctgactgaaggtatctggtacttgcctcctccgcaaaacaaaaacaaaagtaaaaaatctccaagcaaatggataatcacactttgaatgtattgccttagaaagaatgctgaaattcaacagagaagtaacagaaaacacctaaggcagaaaggaaagggaagtgaggcatccttctctgccaggagccaggagagacttcccaatgtggggaaagagtaagtgagtgacccctaatggtccatatccccaccacggattcctgcaatacttgccagagccgttctacccacactggctgtgagactaacagagagagctacgtgaagacagctctgacagcatggctcaagaaagggaggtcacgctgtgtattcgtctgtttttatgctgctgataaagacatacccaagactgggcaatttacaaaaggaagaggtttaattggattttgcagttccacgtgcctggggagacctcacaatcacgaaggtaggcaaggaagagcaagtcaggtctcacatggatggcagcaggcaaagaaagagcttgtgcaggaaagctccccattatagtaaccagatctcatgagacttagcatcatgagaacagcatgggaaagacctgacccccatgattcaattaccccccaccgaggccctcccacaacacatgggaattcaagatgagttctgagtggggacacagccaaaccatatcacgctggatcctgcacacatctcaagccctaaacaactacagtgaggtaccattttgagagcccagtcaccaccagtctgtatcctgaatctccttattcctggagtaaaactgacatcccctgatcacagatggatgctgctgtcagatgctatggccaatgccaagtacaagccattggcagcaaccccaactgccacaagtagcagggccatcatgcatttaaaagtgccatgaagaaaggctatctcacttgtagccaccacttggggctaaagattgaactcccagcctcctgcctatggcttttgccactgaaagcaactccaccattcccagaagcagggccacagtgcagccgctgcctccctaaccaagcattctgccaggaatctgggcatcattcagcccatgcctaccacagccagcatcagcatgtacctatttgggacctcatgacagtcacaccccattcaagtatccctcacccagtgcctgaacatgtcacttggcatctgggagtttggcaatcgctctgccccatccaccacctctcatggtgctgaggatgagcccacccaaattgccactaccaccacagctggcatctatccacacacaccaactgtgggccagcgattgcagccactgataacaccagcttggactgcttgggatccaaaggattgttctgccactgctactcccatcaccaacacaacacccactgctcagggacctgagtatctacctacctgcccaatgcaaagctgccactaccagcacctgagcaagctgtctggaggccaaagaatcagctagcctgagcccgttaacattggtgccagtgaatgctgtgcttggtgagacccaggcacatttagcctgccattgccaccactggggcctgaggactatctcagtggatgttcctgtctccagcaaaacatcactacagacttcactaccaattgtaccataagctactaaggaaatcacagacaatactgacactgcctatacccaaagaaatcatacaaaaactacactactgcacacactcagagccaaagtgccctatccaatcaataccacagatactaatttgtagatgacatgatcttacatatctagaagaatttaaagactataccaaaaaccttttagatctaataaatttagtaaagttgcaggatgcaaaattaaaactaaaataccagtagtatttctatacaccaataatgaactggctgaggagaaaataaagaaggcaatcccaattacaatggctattaaaaaaatctataagtatacttagccaaggaagcaaaagacctttacaaagaaaactacaaaattctgatgaaagaaatttaagagaacttaattgaatatgaagacatcccgtattcatagattgaaagaattaacattgttacaatgaccatactgctcaaagcaatctacagattccatgtaattcctttaaaaataccaataatattcttcacagaaaaagaaaaaaaaatcttaaaatttatatggaatcaaaaaagagcttgaaaaaccaaagcaatcctaagtaataacaacaaagctggagacatcacactacctgactttaaaatatattacaagaatatagtgaccaaaacaatatggtatgataggaaaaatggtacatagaccaacagaacagaatagagaacccagaaataaatccatgcgttttttatccaaatgatttttggaaaagttgtcaagaatattcaatgaggaaagaacatccttttcaataaatagtgctgggagtatttgatatccatatgcagaagacagaaacaggacccctaactctcatgatatataaaaacatcttaaatggattaaagactcaaagtaagaccccaaactataaaactactaaaagaaaacatagaggaaacacttgaggacattgggctaggcaaagattttatagctaagacctaaaaaacacagacaacaaaaacaaaaataaacaaatgggattgttttaaaccaaaaagcttctgtacagtgaagaacataatcaacagagtgaagagataacctgttgaatggaagaaaatatttgcacaatgtttcatctgacaagagagtaatatttagtatatacaaggaacttaacagcttaaaaaaaaaactaactcccgctgcccccccaaaatacaaataattgcatgaaaaattgggcaaaagacatgaacagacatttctcaaagacgtataaatggccgacaggtacatgaaggaatgctccacatcaataagcaccagggaaatgtaagtcaaaaccacagtgaggtatcatcaccccagttagaatggctattattaaaaagacaaaaaataaaagatgctggccagaatgcaaagaaaagggaaagacaatattggtaaaattatacagacactatggaaaacagtataaaggtttctcaaaaaagaaaaaataaaactatcgtatgatcagcaattctaatactaggtatgtatctgaagaaaaggaaatcagtaggtcaaagagacatttgcacctccatgtttattacagcactattcacaaaagcaagatatgaaataaatctaagtatccatcaatggattaattgttaagaaatgtggtatatgtaaacacaatgaaatactattagcgcataacaaataatgaaatcatgtcatttttagcaacatggatgaaactggtgttcattatgttaagttaaataagccaggcacagaaagacaaatattacatgttctcactcacatatgtgggaccaaaaaaaaggttttcgcatggaagtggataccagaggctgagaagggtgtgtacatgggtagggcgtaaataagagaggttggttaatgggtaaaaacaattgtacaattagatagaagaaaaacattctaatgtttgttagctgagtagactatcattaacaaaaatatattgtttgttctaaaatatctataagagagaacttgatatgttcccaacacatagaaatgataaatacgtgaggtgatggatactgtaaataccctaaccctaacatgatcattactcattctgactgtaaaaaaaaatcatgtgtaccccatacatatgtacaaatatgtatccatgacaaaagcaatttaaaaaattactttttgtaaaaaaattgccaaatatttttttaaagtaaaattaagtaagaaaacagattttggcatgtacaaaaaggtaaattgagagaatctctataaatcatcttgaagcataaagacttgtattcatgacttgctaagctattagaaaacaataaagctttaaaatattctgaactaatgactgaatgatatctaatcaatattcactttatcacctggcaagtctaataatatgaagtcagagtactgaagaaactacatctattttccctgcctttgaaaggaaataaaacctacgaaggcttcctttaaaacagcacgtgtccaagaatgtatctggtcttccttgtctcaccactttactaataatttgacttttcctaatccaagtgattgattagttgaatgcatgtttaagcctcatagaaagtgctcatttcttcagacgtgatttgcaaaggccagaaattcaccattcagtaagaaaagctatgaaatagacctgtcataaactcatggggagggtgtcctagggagtcacctctgttctccaccaggagacttttagctggcttacttgcagagaaacatatatttagtctactttttcgattttagggtgtgagaatcctgccttttacttaggctgactgagttgaagagaaccgtttttctgcctctctattactgccatttttccccccctgcagtttcagccactctaaaatatctacaatgtgttaggtatgaaaggtatgaagatttataaacctttacccacactttcaaggagcttatattctagtgtaagagggaaaagaagaaaacagaaaaataaaaatgaaaagttccagggatatttaaggggtctgtggaagtcttactggagttcaggatatcttccaaactgcctggaaatgtcttacgtgataaacctgatacataaacctgagtatataggtaaaagacagggaagtaattccagggacaaaacagtgtaggttacactgtaagctagatatgttcagagaattgtaatcattttgagatagaataggtgaagatacagcagtgggaaggtgcagaagtgtgtcaattctgatattcggctggtatgcatcagcataaattaacccattggttatgacttgcatctgttttgattggatccacatcttactagttgttacatattttaaatctcacctctgagtatcataggaagtgactggcagattttaggccatgtagtgtatgccaaattacggagtggaatatgatggcaaaggggagtcaactaagatcattttgcaaaaggatgacacaattacacttgttttacagaaaaaacaactctgaggaaactggggatgatgggatgaggaaaaaagaaaagaagcatttttaatccatgttattgatacaatttagcaaatgagaggtgtaaaaataactgtattaaaaagactaatatctatatccaaagagtacatttcttattaaacttagcacattcttttattttaggtaaaattaaatcactttgggttgaatgaggaggtagttcaaatgcattgcctgttgcaattgctttgaacattatgttccaggatgttgaagtcaaaaaaagctcctttgttctggttctcctctccactgagaatcacggcattcaagcctgtaccctcaactccaaccaacactcctaagactctccgatctcataacccatcagaagcccttaaacctcaagaaggattgaaaaaaaaagtggagtttatgtgcaaaccatgactacttttgagtaatattgaaaacttaatactgctatgtaagtaggcatattcatcttcacagatgaaaaaactctggatcaggaagcaaacctctcctgtaaagggtcagatagtaaatatttaaggatctatgggacatatgacttctattaaaactgttcaattctgctattatagccccaaagcagccatagacattatgtcaatgaatgcgactatgttccagtgaaactatcgtacaaaaatagaattcagctgatgggcctcagttaatcagtcactgtttttagtatgatttatcacaatgcctgtcaacaaatagaaatatacatatgtatatatgtgtgtatataaatctgtgtgtgtgtgtatatatatgtatgatagttcacatcttctgttaattccaccaaatcatgtcaatcttctagaaaacaggccaggcgcggtggcttatgcctgtaatctcagcactttgggaagatgaggtcactggaaatcaggagtttgagaccaacgtggccaagatggcaaaagcttgtctctaataaaaaatatacaaaaattagctgggcatggtggtgcatgtctgtaatcacagctacttgggaggctaaggatggagaatcgcttgaactcaggagacagagactgcagtgacttgacataccgccactgcactccagcttgggtgatagagtgagtgagattctgtctcaaaacaaaaaacaaaaaacaaaaacaaacaaaaacaaacaaacaaaaaaacaaatctagaaaacaataaagagcaaatgtttttgactggaattcagcacagaataatattcagtttgcctttgtttctctgtagatgtttacacacatttataaagcaacttcaaacttttctgtttactaaaaactaaagtttcatcaaaaagtttagtttcctgagaaaatggaagtgcagtttgaatagtccatctaattattaaattttcttgattacagaaagtgtaattgctcctggtttgttaatcttattttttttaaaaaagaaacattttcagaatcacctttaactctacattttcctttgtttaaattatctatcttgaaaatagagaaaaacatattatcttatactgtaaggacaaaatttattactgaaattgaggattatcaaagatccagagatggttttccagaatggtttaggatacaggttatcttctaatatcctcactgccatttactgcctgtgggaccttgagcaaattagttgtctctctgtgtctcagtttcttcagctataaaatgaagttaataataatagcttacaaatagaattgctataaaaagtcaataaattaatacatgaagatcaaccacttagaacagtgcttgttaaataaagatcactctataaaaagtgattattatcaaaatgttttaaatatttatctaaacaaatgttcgcagtgtaatcaatctcaaagccaccagcgcactttgagatgcagattactttaaagcacaagctctagtattagaagagggcttcaaagtcctgggttggtttcatcctggacataggaatacttcttcatccaataacatcaaaagcccctgttcattttcagttgtcagacctacagcacctcccacgtcaactggtattatttacatttcagcttatatctagcaagcagagttgcctttaaagacataagttacgtcggccgggcgcggtggctcacgcctgtaatcccagcactttgggaggcagaggcgggtggatcacgaggtcaggagatggagaccatcctggctaacacggtgaaaccccgtttctactaaaaatacaaaaaaattagccaggcgtggtggcgggtgcctgtagtcccagctacttgggaggctgaggcaggagaatgtcgtgaacccgggaggcggagcttgcagtgagaccagatcgcgccactgcactccagcctgggtgacagagcgagactccatctcaaaaaaaaaaaaaaaaaaaaaaaaagatataagtaacgtctctgagtttcagattcttcatctataaagttaggttaatattactcacttcagaagggacttgtgagaaataaaagaaatatctcattctttacattttaataggggtgtttgaggggaacttttatgctccaggagagaaaagcatggaaagaaaacacacagcttcattccactatcttcctactatcccttctggggatagtgactcatctgtctggtgaaactggagaaggggttaagtgtgtacgactccatctcttctttttatggagcagtctgttctctgaacctgagtttttctgttgtccttctgaaagctacctattaaagcaagcaagtcctgtgattgttcagtcctgtctgtgactgtggggatggagaagaatatttggtcacagatcaaagatttggttttcatttagctaatatatactaattccatgacttcttgctggtatttaatttgaggaaagggctattatttaatgaacctttaaatccctaacagtgagaaattaatataatactttatgtgactctacagttacaaatgttaaatttggccttactttaaaaatatcttgcattatagtttaacaaaatctttctctcctcattgtttataacagatggagtaatacctttcaaaaataataaatgaaaccacttattaacagtataggtttcctggtttccaatctccactgactgtttctcaacccactgccacaccccttatgctacacacacacacacacacacacacacacacacacacatacacacacaaacttccttctccacttgcctccaaatttaggaagaaaggccatcaagtgatttttctatttctaaacttttaagctatatctgccccaacacatttttaaatttctgttctagttctgtagtacatcttctcagttggtttcctccacctggactttaaatgccaccccttcccacatttttatgcattttatactattcgtaaccctcttttcattaattaaatcacctatcctacctggataccaaaattaaccaattaaataaacaactgacctttgcatgcaagatacagatactatatatcataaaattttaaaaatctaaaaattatgaagcttggcattgtctgaagatcataaagcccaaattaaatgacaagagtaaaaatattttcaacatattccaatgagctaccttccttaatttataaagtttttagaaatcaataaggaaaaataaacaaaaaatggttttagtacatggataggtagcttttaggaaatattgacataagataatatttactatcttactcataattttaaaactacaaattaaaacattgtgatgccattttcattcataatattatcaaagtgcaaatgatttaataatgccatgagttgacacagaaatacaagtgcttttcactatacattttgttcaccacttaaactatttttcatgattataaattacatctttggagagaaataaaatgttaatgttaaaaaatctctctttacctcattttcccttaaaatatacagttgacccttgaacaatgcaggagttagatgcaacatcatgttacacagtcaaatatctatatataacttttgactctcctaaatcttaactactaatggcctactgttgacccaaatccttacaaataacataatcagttgattaacacatatttttgtatgtggtatgcattatatactgtattcttataataaagtaagcaagaggaagaaatgttatcaagaaaatcatagggaagaaaaatatatatttactattcattaagtagatgtggatcatcataaaggttttcatcctaattgtcttcatactgtaggctgatggggaagaggaagggaaggggttggtcttgctgtttcaggggtggcagtggtggaagaggcagatgaggtggaaggggaagcaggagaggcaggcacacttagtttaacttaacacatttaaggaaatgcatttttgcctttttttttcatttctctaaaaatgtttctatacagtaccaatccttcttccactgttagctttaatttcagtccctgtatcatagaaaggatcatgtcataaaagaagtcaaaagcagtcttgaataactgaaaccctcctgccagattatctaatgtcaatttgctttctgttactacttcttcaacatcatcttcctcctcatctggcactggtccaaaagcactcatctccatcaaagtcatcttctgttaattcttgtagtgtgatgtctgttagctcttgaatttctccaagatccatattctgaaaccctttacccccacctttttttttcccatacccatgatctcatgatttccttgattggctctatcataaatattgtgaagtgatacacaagatctggaaacagttttcttcagcaggaatttattgtatcaggcttgagggctttcagggctttttccataacaacaattgtatcttcagtggtataatttttccagactttcatgatgttgtctctatttggatcctcttcaaccagttgatgatcctttccatagagtactgtgtgtaatgagcctttatggtccttatgacccctaatctagaggctgaattagagactttgtgtctggaggcaagtagatactttccatgttgaactcatgaggttctgggcggtaagaggcattgctcaatagcaaaggaactttataaggtagtccttcctagccaggtacttcatgaattcagggacaaagtgccgatggaaacaatcaaggaaaatagctctaaatgtccaggtcttcttcttgtacaaccaaaagactggtagctgatgtttatcttttcccttcaatgctagaagattagcaactgtgtagataagaaaagtcatgatcataataaacctgactgtattgtcaaaaaacaggagggttagcttactccttcctgccttaaatcctagagctcacttctattctttactaataaatgttctttgtggtatttttctgtacagaatagaggactttgacacacattaaaaacctgttacagcaaatattccttctcctcagtggttttcttaatggtgtcttggaacttgtctgctgcttcttgggcaacagaagctgtttttctcattatcttgacaatttttaagccaaatatctttgtaaaattatcaaaccatcctttgctaacactaaattctccagctttagatccttcaccttccttttgagtaagtcatcctttaatgactttgctttttcttgaataatattagactctaaatgtatgcctttcttatacccaatcatacacctacataaaagctgcattttcaaaattacagaaaaaggtatttccccagaagagcaaggttttcacatctgctggtgtagccacagggatggcttcatacgtttccttttctttcgttatgttggtctttccttatgctggatttgtttatcttgaaatgaagggcatctgcagctgcagaccggaatccacagtacatattaagcaactcaactttttcttgtgatatcatgacttttctcttcttcttgggagcagtttcagcatcactactgacacttttgttcccatggtgttatttaaggttcacagtattgcaaaagacatgataaaaaaatgtgcaataatcaggaacaatcacttttcactgtaatgcatgatttagtggtgaaatgcacagttcacagggagatgattagcctcatactgtgatttaagcagatactcataatacttgagatcattgcaatatcaataggaggtggctttgaaattacttcagtagtacaacatgtactgcagttaattttatgcagttatgatttaatagtaaatctttgttttctcttaatcaggaatggctcacaagtgtgcacaaaagttttgataaattttaacttcttataatagattggtgtagattttatggtagtaaatgataaaatagtatatgtaaatattacattcatttatcacacatattttcttatttttaaaaaaatattcctagtcaacatggtttgtgtgtgagtttgtccaaattattgcaaatctcaaaaataaatttcaacctatcaactgaaaaaaatatgtaaatggagacctgcacagttcaaactcatgttgttcaagggtgaactgtagatttcattcttcattccttattagttcaacttcccaaaatactggcttatatgtcatgggttcatttactcaccatctactcacttcttagctacttcattgttaatctgcttttattactctattcagccatgtcttgttaaattgccaattctctccacctcaataaatccaaatggccatttcagtgttattttcacttgatctcctaaattcagttgacactggtggtcttgcctgtaaatactctcttccattggcttggatgacacaacactcttggtttcccatcaacatctctggatttgcctgttcctgtctccaatttagagttcatctttttttttcaacctaaatgctgaggtccctcaaagataatttcttagaattcctctcttaattttaacaaacacgtccttgatttgctattatcctgatgagtctctcaattctatttacagcctatatatctcttctgagctctcaacttacatattctcctacctagtagactactttatctttgaaatgtacctgaactccacttatccaaaactgaactcatgatctgctctttacttcatatctgacatttcccaaagacctcagtaaaggtactatcattcctattgttaacttttatcccacattacaaattaatgacactgaatagcccagtagaagaaaattatggacatgcctttttattgcacttgattttattgtaactccacagatattgcattttttacaaattgaaggtttgtggcaactctgtcctacacatctgttggcactatttttccaatggcatggtctcattttgtgtaattttgttaattctcacaatatttcaaactttttcattattattatatctgttatggtgatctgtaatcagcgatctttttcgcttatattattatttcaatttacatgataattgtacacatttatggcatacagtgtgatatttccataaatgtatacaatatataaggatcaaatcagggtaataaacgtatccgtcacctcagacatttattatttctttgtgttaggaacatgctactgttgtaattggtttggggcatcacaaactgtgcctatataagaccgtaatgagggtggtatgttctgattgtcctacccactggctgtacttccgtctctctccctctcctcaggcctccctaaccctagagacacaacagtattgaaattaggctaattaatagccctacaatggctaaatgctcaagtgaaaggaagaattgtaagtctctaactttaaatcaaaagctagaaatgattatacttaatgaggaaggtaaggtggaagcaaatataggccaaaaattaggcctgttgcaaaaaacagccaagttgtgaatatagagaaatgataagaaagagaaacagccttattgctgatgtggagaaagttttcatggtcttgatagaagatcaagtcagccacaacattcttgtaaaccaaaattctaatcaagagcaagatcttaactctctttaatcctataaaggctgagagaggggaggaagttacagaagatgtgtaaagctagcagaggttatttcacgaggttgaagacaggaaactgtctctgtaacatcaaagtgctgggtgaagcagcaggtgcagactgatagagaagtttcaacaacatattttcaatgcagacaaaacagcctttttttggaagaagatgccatctaacactttctcagctagagaggagaagtcaaggccttgcttcagattgtcaaaggacagactaactcttctatgaggagataataaaactggtgacttgaagtggaagccaacaatcatttccattctgagaagactaggaaacttatgaattatgttacatgtattactgtgttccaaaaatgaaaaaaacaaagcctgggtgacaacacatctctttaaagcatggtttactgaatattttaagtctacttttcagaattactacacacacacacacacacacacacacacacacatatatatatatacaaaaatcctttcaaaatactactgctaataattgacaatgtgcccggccagccaggaggtctgatggagacatacatggagtttagtgttgtttacatgcctgctaacacaatatccattcttcagcctatgaatcaacaagtaattttgactttcatgtcttattatttctaaaatacatttcataaagccataactgtcatagatggtaatccctcagatggatatgggcaaagtaagttggaaaccttctggaaaggattcaccattctaggtgtcattaagaacattcatgagtcatgagagaaggtaaaaatatcagcaacaggagtttggaagaagtgattccaaccctcatggatgactttgagatgttccaatacttccagtcaaggaaataactgaagatgtagtgaaaagagcaggagaactagaattagaaagtgagttcaaagatgggactgaactcctacaatctcatgataaatcttaaatggatgaggaattgcttcttatagatcagcaaagaaagtggtttcttgaggcggaatatactctggtgaagttgctataagcattgttgaaatgacaacaaagaatttagaatattacctaaacttagtagataaagcagtgatagaatttgaaaggactgactccaattttaagagcagttctaacgcgggtaaaatgccatcaaacaacatttcatgctacagataaataccacttccttttgtgaaaggaagactcatttgatgtggcaaacttcattgttgtcttattttaagaaattgccacagccactgccaccttcagcaattgccaccctaatcagtcagcagccatcaacattgaggcaagaccctcaactagcaaaaagaatctaacccactgaaggctcagatgatcacttgctttttttttttagcaataaagtatatttgaattaagatttatatatttttagacataattctattgtgcacttattaggctacagtacagtataaacataacttttttttttttttttttttttttttttgagacagagtctcgctctgtcgcccaggctgcaggacagtggcgcaatctgagttcactgcaacctctgcctcccgggtttgcgccattctcctgcctcagcctccagagtagctgggactacaggcgcacgccgcgacacccggctacttttttgtatttttagtagagacggggtttcaccgtgttagccaggatggtcttgatctcctgacttcatgatccacccgcctctgcctcccaaagtgctgggattacaggcatgaaccaccgcgcccccccccactttttatatgaattgggaaaacaaaacatttgtgtgatttttattgtgatactgttttattgtggtggtctgaaatcaaacgcacattttctccaaggaatgcctgtatacttgtttgaaaatgactgaatttggaatagacattcttgctacatgtaaagataaagaataatatctacctctggggaatagccactatcatagtttgactagaaaaactgtaatttcattggcaaggatatttcttacagtaagttcttatcatttccattttgaaaaatattgatgtagattgacctctaagaaatgcttcttataatcctcaagtacttttgaaatttaagtacatttcctttttgtggctttgtaataatcatcgtagtaaagaatattctcaaattattcaaataaagttaattatagatcaaatgaaactatcttttcagttgttaatttgctaaaaactagttgtttccaagtcttatttaaatttctaacttttaaataatgtatttcaagtaattctttcccagatctagaacaagacagtgtattcattctagaaaataagccccttaagaaatgccattactgttcagattattgatctcagcctgctgtcagagccaaagtgtttagcaagactatttcagggacctgaacaggatatttttattggcaatgagacagcagattacccacagctcaaatggaaagacctagtggtgaggtgtgtatcattctaacattctattgatgtgcagcacagatggtgagatgtgctgatggatgaggttgtctcagcagcagagttgtcttagtcctgccaagcacttaagttgaacgacctattaaacatggttgacctaaggcagttggagatatttataagtaactacagctattaaatgtggaccttctagtaggctctaaatatagcctttttttttttccacatagctttgacttctagttcctaaagccattcattcaagttgaattggggaagagaaggagcaaaaagagagattttcagaatatctgtaaacaaaataacactagaatactgaaagaagttatagcgtgaactaaataaaaattttcaggaggtagcactgatataaaatactaattaaaattaaaaatttgaattatctaaaattttaaaaaaataaactcaggttctatgtagaacctagggtttgctatcaaataataacttcccctctgtttctactctacagaagacaagttagtagaaaagtacactggattataagttatggtagttgggtaattgtgtcatccaaattttggaggtatcagtttcctcatttgtaaaattagagttagtagatgtaaactttttcttacaaactattaacttttgcttttctgttccatttcacacatcaatatttattgagtcttacttagaactcctgtgtataaaatagaatagtacttaatatttaggttgttcttagatatgggttttttcataacacttatatgaccttctatctaacttatctgtaagtatcataagggcaataattattgtttttttgctcattgatttatttcaagcacttttacatatagtaaacactcaacatttgtcaaataatgattaaatgaaacaatacatgtaaagtgcttagcacagtaattggcacaaagtatttgataaatggtcctataaatggttctgataagtggttttattaacacccacagtgccatctcactaagatagttggaagaagttaggatatttcaaagagaagttggagagtactgaggaccacactgttgttcccaaatatttgaaagagcatcacgttacttttaaagaaaaaaaaacatgggccaagaggcagaaactgcagggagacagttttaaaatttggagtaaggaagacctaacaaaactgctcaaaaatgaaatgaactgatgttcaagtaaatgtcaaattactaaatagccagttaatgtggggataaaaaaaatctaactagaggctataaatttagtattccatgaattaaatgatatggaaagaactctatgtttatcatatacaaaatagattttaaaatacccaaaatataaaattttgcaatgcttctggaaataaaatcatacatggaaaatggcaaatattataaaagccaatctatttacttagtgtacatgggatcaaagaacatttgctttttggcaaatacaccatatgactgaaaacaaatgctgctgatttttcttattaatgctggcaaatggagcagataggaatcgtggaattctttattccctatcagaaaaacagaactacttaaagctagattttttttcttttctgttatttttactgcagtggtaacactgcacttcagaatacagtataagaatattggcagttggcatgtttgtgggttgtatgaaactaactggtacatcattcctgccaactagcgacgattttgacaaaatatatgacattgataaaaaaggaatctcactcaatatcatttttattgaaggatgtgtggcctcataccaaaatagccccatcaatctattgccatcagatcggacagaaaagaattgggtacataaaatggctgtcataaaatgtatcccagctggagctaagtctgatcacagacggtcagttaagcatttggaaaatgaaggaagtacatttcccttaataagccatcaaaagttaataacaagtgacttggctctctatttggggcagaaatcctgagaaagatgcagtggattctaaggtttttgctgttctttacactggctacgtgttaataaaaagatatatggtacataatgttttaaaggtatgcaatgaagaagcagcttccctaccacttataagttccagtgttaccatctcagaagtgcacctcattcacacattcaaaactacgatgttgtcttactaattatgatagttaattttatgtgtctagtgcctgggctatgagtgcccagacattttaacagacattaatctgcctgtgtctgtgagagtgttctggatgaaattaacatttgaagcagtagactgagtaaagcagattgccctctctaatatggatggacttcaaacaatcaactgaagacctgaatagtattaaaaggctaagaggtaatgttttttgcctgatagcatgagatggacatcggtctttttcagtcttcagacttggactgaaacattggctcatcttgaattgcaagcctaccaactttcagactgcaaattaatattatcaactttcatagttctaagacctttggacttggattgaaactacatattggctctcttgggtctttaatcacatgaaccaattccttgtagtaaatatcatatgtgtatatatatatatacacacacacatatgtatatacacacacacacaaatttatacatacacatatatatgtgtgcaggacacatatatgcatattttttattatatatgtatatacttttggttttatttctctggagaatttgactaatacactgattcagccacaacaacagggaatgtgctgagttgtgtcaatcaagtgaattatccagataattaaagtcaatctctgtagaagctggtattttggtatcttgtctagaaacaatgtaggtcaccaggcacctacatttttgtgatataaaataacaagccaattttctaatgctttaaaaatgtgctctgaaagcaatccctcattttcaaacccaaaattctatgattcaacattataaaccaagctcatgtagtcattctcaaaatcagctttaaaagcaactatgagtttgagtcatgtttactttccaagtgaattactcaagcatataaaaatccatttcattaccttacagtcatggtttttaggacttaaagatgcatcatcttcatttgttgattcctgttactattaatcagcacatggcggatctacttattttccatgattttctccaggcacaggtgcgttatgaaatttaagctctatttccactgcacagattaagctttgaaagaattttttatcatacactaaaagctacccttcagtgctgccaaattcctggtattaactccatgtaaattttcttattatcactcacctgcccagaagcagaaattctcccgctagacccaggcgcctcatggccatcagcagacctctcaccgtcatgccctcacagaagcaggccaccacccgggccttgggcaagtgacttgtgagcttcttcagcagcttatcaaagctctgctcccctgcattactgtagattttgtaagagtgggcgatgcaaatcccttccttcgctgacatatctttgaaggcttccatcccactttctccatagttgcctgtgtgaaaacatagataagcagagggatagtgaaatgagagtgttgcattaattgggtataatcagaatgcaggtgttaggagcatgaaagtcattggtatgggacttgcaacctgaagacctgaattttggtttttgctcttttgccgaattgcttattttgggcaaattacaattgaaccacattatatatgcattgatcatttatattttcactgtgatggagagaataatataaaaagtgtaagcaattcatcatccttttatgactcaaaatagctcttattctaaatatgagctgatggaaatatttatctgctatttttttgcattctatctcacttccctttacttctcattaatgacaatttcatcccactgagatttttgtatttaaagatatagtacatataagtaatacatgtagtttatatagtatagatgttgccatataaatattttataaagtattatattatatataatattcagtatattatatacttataatcatgagaatttatggtttggtcttaattgaaaaactgagatccttgcttaagatttagtcttgtcgcaggtgaatgtgtaaacttatgaaaaacatttacagttttatcctatacaaccatggggaagttattgataaggaaaaaaagttcaaagtcttttgcaaaatttggggactaaggacaaatgttagtctttaaaaattaatgaaaaggggattaatattgacagtcagctatatgccaggacacaaggacctttatatatgtgatctaatttagcactcacaataaaatattgatgtagctattatgggctccattcaatacatagatcagaaaacagagcagttaggtccatatttaccttgagttacactagcagtaagtggagggctgaactcattcacagatctaatagcataggttctgctccctctacttgtctaaggctgactcttgggagtctcagaattctaattacatccgcatttctctttcccatttcagagtgacaattctccaattttagatatttttggaacattttaaggctctatattttatacagggctcatattctgaattttcaaaatattagatatataagggggattgctttgaagaatacaagaggctattacaagataaccaagctgtagaacatataaggatgtgactgacttaaaaatcaacttgacctaggaactggaatctcatcaggaggagtagatatcaaattaataaggagcactgtgggcattcagttgcatagggttcactacatgtctataactgcaataaatacaactccacaacaatttgattttgggaaagtcagtttatatatgttagctcactgctccttacaacaactctgtgataaaggttaatgttctcttcccttggctgataaaactgaagttcaaatacagatagtaggtgtcaggatcttagtttgaacacaaatctctgattcctgtcctgatgtgggtgctaccataccacaggtaccttgctgcaaatgaaatctgttaactttgagggtggattttggtgaagttttatctccatgaacaaactgcaaagggcagagcagagcaggtcagcttgaatctcagccaaaaatactggtgggccagctgcatcttttccctccttctccagaattaaaagcaacaagaagcctctgtcatgatggcaggtgggcaatctagttattttgcaattaacaaagtttaaagggcactttctgaaaaatgtgccaaagggcctaaattaccagttttacactaatgtgagtaatctattattctttcatttatttttagctaactctgtttttcaacagactgtcttgcatttcatgttttgatttaaggcagaggcatttgcataaataatttgaaattaggtaagtgattgtgatgtgaatttatcgagaatttcacatcatttatttacttttattctcaatacattcactgttaaacaagaaaagacatctaaaaaattcagattatttagcattttgttcctaacagctttaacactgtttatgtttatataatatgttgtagagaagcagcttgaaatagtggagagaactttgttattagagaaacctgagttcaacttcaatttatatagtctttttaatctcagctttctgaagtaacactgcttaatatccagatattttaatattatatttaatgtatgtaaactatctggtaggtcacctgaacccaattaattgaacctactgaaattataaagaatattctagacagagtttagctactctttactggagcatccaaaacaaaacagtggagaaaatggcactattactgtacactagactaaaaaattaagcttacactagcagaataaagtattattttcccagagcaaatcccaagctgtactctttaaaattaaaaaaggcagggggtatatgaaaaattttcactcaattttgcagtgaatcaaaaactgctctaagaaagaaagtttacttgaaacatttaaataagaaacagttttaacacatgtgtgacataaaaattttacagaatataattttgatttaacaaaagaaatcctttgtaagctgggagacaaagagaatatgtcttccaataaaatggaaaagactgaagtgttgagactttctggtagttgatagaaacactgtattctataattatacattttaaaataatgaaaaaatgcagcaaaaaaaagtctacaggcttctcaaataaaaatagaacacatttcaagtaatatgtagaatgaggaaaaagctaaggaagtaactattactttttccaatagagggaaacaagtaactgagaaagaaagctgtggtataaaatatgaaactaacatgtgacttcattttaaataaatagaagtaagacagaatccatagaacgttcttctttaggtagcagagggtttacaacttggaattatgtggagaaaatgtaatcatagcccaatgtcttcactcgtagctcacgctacttacaggtataacgatgcaaatgtcaatcattgattttcaaccttaagaatccacctatagacaaatggaaaaactcattatgcaataaaatatatttgttatcaacttttacaatgacaattaaagagaaagatgatgaagtctgagaggtagatgcagggaaagttgttgggaagaggaaggccattaaagtcactcactcccaatttggaagtcaagatatacagaaaataaaatgtatgtgattaagggaattatttgatgctaaaataatcaggaggcagctaatgtagtgagataattatattaaaagaaggaataagaagatgtacaaggtaagagataatgtctatagtcatttaaaagtagttactttttaaaaagacatattcatattagagatatggaggtgaaaataaaaggatgaaaaactaaaacactttttttcactttaagctctgctgtactatttgacttttgaaaatatgaaaatatacatttaataaaaaaataaactagcatacttaaaagtcattgaaaggagagagttgatgcagataatttttaaagtaattgtcttctctctgctttatcattttatcctgttttagggataaaattcacagaagttctttatatgctactcttggtggaaatgtaaattagtacacccattaatagaaaacttcacggaagttcctcaacaaaactaaaaacagaattatcatatgataatcacccctacccctggctacctttccagctaattttaactgcactctcatgttcatggcagcattatttacaaaagccaagttatatccatcaacagataaatgaattaaaaaatgtggtgtatatatatatatatatatacacaatgaaatactagtcagcctaaaaaccctaaaaaatgggtttaaaaagaaaaatttctgccatttgcaacatcagcatattattcatttttgtaccgctaatgggacctgttagataactaacacatgttgaataaagaaataaattattgaatgagcagtacaaaataatcaatgtctatttccagattaaaataattgcccaactatgtgaccagcaatcaggattgccatattgtgtctagggggcgtcactctaataagctattataaaatatttcacttaaaacatgaacagagttgcacaataatcaaaatatttaccctgaggaccccagttttttcctcagatcgtaacagattttaataattcaacctcaaatactgtttaaagctagtgctttcactaatactatttgacctgaatttcatcagctgggatctggaagtatctgcctacattgaccctataaagcacacattggaaacaggatttgttaaagagtaactataaaactttcttctgtaacagagactggggaccccaaaagggaagaggtcaggaagggagtaagggttgaaaaattatttattgggtacaatgttcacatctggctgatgggtacactacaagcctcaaatccaacaaagggcaatatacccatgtaacaaacctgcacatgaacaccctggatataaaataaaattaaattaaattaaattataaaataaaaaactttctgctaacctaggaaaaatgttttatttgaactgtatattaaaaggcaccaaatcatactttagtaagtaatttgtaatcataggtaaatgctatttcagatggtacaaattcaatatcattaacaactgtgttacattggccactttaagataaagataataaagtataacagcatagacaaggtgtacctagtgagattttcatttttctggcaaaatagccattaaatatattgtttcaatttatcaatctcgtgtggtagggaaaactatcattagaatcaaaaccaaactattataataatagtaaagatacaagtaattttgttttctttgatacttttctttttttcatagtatctttacttctctttccataaatcagaccctgattcactgcatagaagcttgtatactattttatctatcatctcttatttttcattttcccaaaccctaccaaccactattttttgtttggtactttttactattctctttcatatgtatcacagacaccccacatattctcatttatttatttttactaatgctgttctttctacatggaatacatttttccatgttgtacaaattcaattccctagattcctttaggctggagactacatcttctccatagttccattatttaattacggtatttgtataatctctgtaatttgtaattgctaaaaaagtttataattgtggatccttcacctttataacaaggctgattatactcatgatttatttgatgctgaaaacttggttaaaaatataaacaacgatgctgaattttttcttaggaaacatagctcactttaaataatgtgttttatcatgggatttctaaaatgcctcagagtcaggaaatgagttaaggtactaagtattataataaattaaaatagatttctgtattatatatgttgcctattgcatatattcattatattttggatgtatttacatatccttcttttcaaaactgtgagcccatagagggtagttaatgctttatttaactacatatcatcacatggtaggtacttacgtatttcttgtacagaaaagtagtacagaaaaataggcaaaaaaaattttggaagagtaaatacatttttctaagcagaacaccaagcagatgctaaaagaatgtggaaaatactttttcagaaagtattcacttcaggaaatactaaatctttgcaaagaaaaggaataagtgtaaccttctacaatagaactttattttccatcttagttggtccaaattatcttttcctcacaaggaaattaagattcccaatataaacaattattttaaagtatatttcaagtggctttaactactaatatcctgttgctactgtaaacacagttcattttactgacaactactagtgaagtaaaattttctttccttatgtccttattctatgagctttttactatttaatgttgttgtttttgtttttcttactttttaaacttttttcttaaaagtaaagacacaaacaaacatattaacctaggcctacacaggccaggattgtcaatatcactgcctttcacgtccacttccacatattgcccactggaaggcctttaggggcaataacatgcatgaagctgtcatcccctatgataacaatgccttcttctggaatacctcctgaaagatctgcctgaagctaatttatggtgaattttttaaatgtatataagtagaaaaagtacactctaaaataatgataaaaatatagtatagttaatacataaatcagtaacatggtcatttatcattgttatcaagtatgatgtcctgtatataattgtatgtgcggtatctttgtacaacggacatcacagtaggtttgtttacatttgcatcaccacaaacacatgtgtaatacattctgctatgacatgatgatagctatgacatcactagatgagaggaagtttttagatccatatataatcttatgggaccactgtggcatatgcagtctgtcattaactaaaacatcattatatggcatgtaacttttaatttgttaaaatttgcaagtagggaatgagctaacaacaaagactgattgtgtaacacgcatactgatctttttcactccaatggtctttttcatatctgtatgtgtatagatgatacttaagttgtgcatagtttttcatgattttgaacactgttacaagaaacaaatttcctccatttttgattgttttcatttccataaagtaaaatcctgaaataaaaatgaaatttcttggtcaaaatttgaaatattggtcaaacagtgtaactatttagtattttagcaaacttgctctccaacaagttcccaccaatttatactttgattagaagcatatgagaatgcctgtttctccataccttcaccattactggttattgtcatgttattaaatttttgtcaccatattgcttgaataaatgagagttgttttaattttcaaaaaaataaaaaataaaactcagtcatctctcatgtgagttgtgacattagtctggcatgatatcatcccctaaatatacatataagcagtgtccagtctccacttcgtgtcctttaatgtgaattagaagtgttcatcaagagatcttagcccaaactgcccatattgacagggttgtggcttaaactagtgattaaccaaaatggccaggagtgggaaaagcttgacagtgaagcacctcttcttattttattaacagtttcataaagatgttcttttgtttgatgccatttttcccactacagccatatgtgcaatggatgtggcattctaaactctgtattacactcatttgtttatatttatctcctgttactagacagtgtcctttaatgcagatatttctttcacaacaaaacattgtatatacttatttttatgcaaataaagaaggaagttaaatgatgcaagaaatgtgtatacatatttttatggaaagaaagaaggaagttaaatgatccaagaaatattcctaaaaattcctatataattgagatttaggtgtttaggaacctggacatatgattaatgtgaaagttttaaagccaaaggactggaataaaaagttatcattatcatgcaccttcatcaaggtacctgaattataaatgtcatggatacgaaaactttgttaacaaacagttttccaagttttgaacaatggcccaattatttctcatcctgccctggagtctttctataacacgacccatataccacagcattaagcataaggcatggcattattgaatctcatccaaggtgtttattattggaagtaccagaaggatctcatttagaaaatttgctttagttattactctaggaatggattatgtcgtaacatttgatgaactcttcaacagtaaattaagcagaaaacaaattgctagtataattatgtaacaaatgtagataagttataagtttataactatgcatcgccccactcgtggattttaaactatatgtataaaacattatttaaaggaatactaaccagggctactgaatattgccataaaagtacatgccaagtggtttgctgagtggtatgctgagttggtgaattttcttctggctatcaagtatggagttagagaaagaagtttgatcttaagagcaaaggtacatgttgaccaaataaatttagatatggtagaaaacaggaaatcagattatttaaagaagaatacgtgacagttttaactgccatacatgttgaggacaacaagtttgagtgtcatatttggtttggtagattcctgagccctggaatcgaaagttgattctcaacatgtatctactccctccagcaactctagttcatataactgggttgaatgaactgatacaaacataattgaaagaaaaccaaatttggaaagaaatttttaaatttctgtgaaatagccaagtagaaatgccaagtaggaaattaaataagaacattctggctaagagaatagaagtctgaattggaactatttgggagtcctcagtatatggatagcaacaataatagataaaagtgtaggaagtgaaggaaagagagctctgagttataccctaaagaattcaaatatgtgtgcattaactgagaaggaatagctcacaaagacaatgaagaagaagagaaaccaagataatatattcttatggaaatcaggaaaagaaactgtttttacactcttttttttaaaacactctgttgaaaactaaagtaagatgtgtagtgaaaaaaatccactaattctggcaacatagtagaagatatataggagtaggcttgtgtgaatgggagtaaaaaaagtgaagacaatatatttatacaacttttttgagacacttggcactgaacaagagctaagagtatggtggtgattagaagagaatctggaaactcaagaagttttctttgctcatattaagaaggggttattttaggtaaagtacttagcccagagcatggaacagagtaagcactgaatacaggatttttttataatcatcatcatcaccatcctcaacatttatctagatcctgtaaaattatttggtaaaaggttaataataatatgaacaaattattgcactattcactccaaatgtgttattattaaaaccaaccaacctaatgaagttgctattatttcccacatttctaaagaaggtgttgatgctgaaacaatttgccaaataattgacagctagtaaatagaagagctgaaatttcaaccctcattctgtcaaatttcaaagcccatgctctttgccctccatatattgttactcttaagacactgggtaaaaattgttcaatttagtcctgtggttcttccaaaggcctgctactaaatgtttcatttgaaactaattccaaatactactgaattgaatttgtctcagcaaacataatatttaatatataagtattttgcttaatttccaaaagattacagatgtatgtgatttagcactaaatgattcagtccccatgttgctgatagttggtgtttaaatctcagagcctttctacaaaatacacaacgcttaatcatagcttttctatggacaaagtcctgtaaaataagagggggctcttgaaaatagacataccatattatcttgtattagttacttaactacatcattgctgaagagggagaaacttcagagagaccatagaaaatgacaaaaacagtgattttggtgttaaattttttggaatattccaagcttttattattttttaaaatggtttgagatttccataatgaaaaaatcacttttttaatcttcttaaaaatattggagtcttcctcatttttttcctctggctattcttcctagaggaaaataaaaacttgagacagaagctatgacccagattcccactctaagcttccagaattcaacttctttctgctttctttgtaagctgtcaaattcacagctgaagacttcggtgcatgtctcattaaaagtaattccatttccacagaaaggagaaaactctatacggagctgtgtgtcaatgggtcgggtggatcggtgagttatttattttgcctgttttagctcactagccaccaatgatccttgattctaactggatctaatgacaatgcagaaattctcccatcaccagctgaaggcagaaaatcctctacagcgcagccaaaactcttcatgcttgacagcttttgctgaaaaaaagtcgcttctttgacagcagctccctggcctgccgctaccttctccagtttagatctgtgctgtctgggttctgttgtagccagattccctttggaaggacttggtgtctaaacaaagtactgagaggaggaactcaatttggattcagaaatgagaaggaagaattaaaatgtagtataatggctgcactgtcattgttgccaaattttgagcctcatttaagagtgggtaactatgctgtgttcaggcattagagccttggtgactttcctctataatttagacttgtgctgtccagttaatagccacttgccacattgagatgttcagtgtaaaccacaaaatacatttcaaagacttaatacaaaagaaagaatgcaaaatatcccattaatatgtggattacatgttaaaatgatagaagtttagatatattgggttaaataaaatgtattattaaatttaatatcatttatttttactttttcttaaaattataaatatagctagcattacatttctattagacagtaccactttaggcatgcaaagaaatttagatcctatacatttcagggtagaattcaaacttcttaggatatttaatggcatccaaacttttcatgatctgctgcttgactcttctctccagtctcactgcctgccttttcctgaggcacagcacatgctccagccataacaaaggatatgtagatcaaatacactaggcttttttacatctctaaatttcacacaatctctcttattcctggaatacccttctatttagctaattcctacccatccttcaagagttggctgaaagtgacagaattctctaaattaagtttttattgttgttgttgttgctttttctgagacaaggtttcacccctgtcaccaaggctggagtgcagtggtacaatcacggctcactgcagcctcaactttccaggctcaagtgatcctcccacctcagcctcccggttagctgggactacaggcacacactaccacacccagataatttttgtatttttttgtagagactaaatttctccatgttgcccaggctggtcttgaactcctgggctcaagcaatcccaggaggctttgggaagcctcagcctcccagagtgagtgctgggattacaggcatgagctaccacacctggcccacagttctaaacagatatcttccactgtgctgtcattgctcaactcccctccaatgtcataggatattgtttatgttttattgtaattacatatttgtcttactccataaaagactgtgagacagttaaacaaaggggttaattaccctctttatctcaagggcctaggcaacctaagtatttgttgaataaataaattttagaaaatgagcagcaatttttcataagtaaattactgagcatccactatgaatcattgtgtatagcagcttctgttactgaagctactctgcattcattgtgatataaaagcactaaactgggctaagataagatatattatcaaggacagcacagcttagtcacaagtgccctcgacagagtgaggagacagtgattgaaaatctatttgtttgatttatcacttacatggtttttgggaaatggcttaccttttttatgtaaatttgtctcctcaattacaaaattatatgtattctaagaaaccttagagagtggatttttagacctgcttcctacattgttttgttatatatatattttttctttttgtgactagtttatttcacttagcaaactttattgttttttggggaaatatagtcattttcataaaaacattatttatgttaacatgcagagtaaatgaataacaaacacttaaaaatcctcagttttaaattcaaatagaataaatgtcaatagatatatccactgcatatttctatggtgccaatagttgcattactctaattataaaatttaatgtttgtctttttactatatggtgactagtgtgacaaggactgtgtagtattgatattgtatctacagggaagattttattttttcattttttttaagttctgggacacatgtgcaggatgtgcaggtttgttacataggtaaacctgtgccatgggtatttgctgcacctatcaactcatcacctaggtattaagcccagcatgcattagctatttttcctgatgctcttcctaattatcatcagagcaaacagaccatctacagaatagggaaaaatgtttacaatctatccatctgacaatggtctaatatccagagtctacatgaaacttaaataaatttacaagaaaaaaacaaccctattaaaaagtgggcaaaggccatgaacaaacacttctcaaaagaagatatttatgcagccaacaaagatatgaaaaaaagctcaacatcactgatcattagagaaatgcaaatcaaaaccacaatgagacaccaattcatgccagtcagatggtgatttttaaaaagtaaagaaataacagatgctggtgaggttgtggagaaatgggaacacgtttacactcttggtgggaatgtaaattatttcaaccattgtagaagatagtatggcaattcctcaaaggtctagagtcgaaatgtcatttgacccagcaatcccattactgagtatatacccaaaggaatataaatcattctattataaatatacaagcatgtgtatgttcattgcagcactattcacaatagtaaagacatggaatcaacccaaatgtccatcaatgatagaccagatttaaaaaaaaatgatacatatacaccatggaatattatgcagctataaaaatgaatgagatcatgtcctttgcagggacatggactaagctggaagccattatccttagcaaatgaattgggaaacagaaaaccaaacaccacatgttctcacttataagtgggagctgaatgatgagaacacatgaacacagggaggggaacaacacactcatatatattatgttgaccacatagacagtagagctgaaaatagcctaaagagcataaaaaactgtaaaatatgttaaaaggaattatgtttaattagaattgtctgatatttaacttttatttttttatagcttaattattgtttatagaatttaatttttaataatggctgtgtttaacaagagacacttaaaaatttaacatttctcttacaattgcctagatgagctggttccagcacaacactggactatgccaataaaatatcctaaaattcttctagtcaatgatctctgtcatattttcagttactccatgactttgaagggaccactgacttaactggctataatagagactccctttttataaagatccagtacaataaaggtgaacgtttaatgatgtagaatggaaaatactgtcatttctgttttgctgtactaggaaaaggtctgttcataaagtataatttaaatgtgaccctgcagaaggagttgactttggcattctagatggagtaaacagagcataggcaggttaaagtgggtagtatgtggtcaaaatccagtctgcctacagttgaggctatatgatgggagggcaagtaggctaagattacaagggggaggcccaaacttgatacataaagaggtgcaatagaagaggtttctgaaggcaggtaacatgaattaaactgcaagtaagactacactggcaataataggttaagagagtacagtggcgctccagaaggatacaatagagtattacaatgacagagtttaaaatgaacaaaggtgtattcttaggtattttattccctttgtagcaattgtgaatgggagttcactcatgatttggctctctgtttgtctattattgttgtgtaggaatgcttgtgatttttgcacattgattttgtatcttgagactttgctgaagttgcttattagcataaggagattttgggctgagatgatagggtttactaaaaatacaatcatgtcaactgcaaagagacaatttgacttcctttcttcttatgtgaatgccctttctttctttctcttggctgattaccctggccagaacttccaatactatgttaaatatggtgagagagggcatccttgtcttgtgcaggatttcaaatggaatgttgccagtttttgaccattaagtatgatattggctgtgggtttctcataaatagctctcattattttgagatactttccatcaatacctagtttattgagagtttttagcgtaaaggggtgttgaatttcatcgaaggccttttctgcatctattgagatagtcatgtggtttttgtcattggttttatttatgtgatggattacatttattgatttgcatatgttgaaccagccttacaagggatgtgagggaactcttcaaggagaactacaaaccactgctcaaacaaataagagaggacacaaataggaaaacattccatgctcatgaataagaagaatcaatactgtgaaaatggccatactgcccaaagtaatttgtagattcaatgctatccccatcaagctatagtaaccaaaacagcatggtactcatatcaaaacaaatatatatagaccaatggaacagaacagaggcctcagaaataacaccacaaatctgcaaccacctgatgtttgacaaacctgacaaaaacaagcaatggggaaaggatcccctatttaataaatggtgttgggaaaactggctagccttatgcagaaaacgaaaactggatcctttccttacaccttttacaaaaattaattcaagatggattaaagacttaaaagtaatacctaaaaccataaaaactctagaagaaaacctaggcaataccattcaggacataggcatgggcaaagacttcatgactaaaacaccaaaagcaatggcaacaaaagacaaaattgacaaatgggatctaatcaaactaaagaccttctgcacagcaaaagaaattagcatcagagtgaaaaggcaacctacagaatgggagaaaagttttgcaatctatccatctgacaaaggactaatatcgagaatctacaaggaacttaaacaaattacaagaaaaaaaaacaaccccatgaaaaagtgggtgaaggatatgaacagacatttcgcaaaagaagacatttatgcagccaacaaacatatgaaaaaaactcatcgtcactggtcgttagggtaatgcaaatcaaaaccacaatgagatgccatctcaggccagttagaatggtgatcattaaaaagtcaggaaacaacagaagctggagaggatgtggagaaataggaacacttttacactgttggtggaagtgtaaattagttcaaccattgtggaagacagtgtggcgattcctcaaggatctagaaccagaaataccatttaatccagcaatcccattactgagtatatacccaaaagattataaatcatcctactataaagacacattcacacatatgttgcagcactattcacaatatcaaagacttggaaccaatccaaatgtccatcagtgatagactggataaagaaaatgtggcacttatataccatggaatactatgcagccataaaaaaggatgagttcatgtcctttgcaggcacatggatgaagctggaaaccatcattctcagcaaactaacataggaacagaaaaccaaacactgcatgttctcgctcataaatgggagttgaacaatgagaacacatagacacagggaggggatcaccacacactggggcctgtcaggggattggggtctagggatggatagcattaggagaaatacctaatgtagatgacaggttgatggttgcagcagactaccatggcatgtgtatacctatgtaacaaacctgcacattctgcacatgtatcccagaatttagagtataataaaaaataaatacataaaaataaaagcacataaaatgaacaaaggcctgattttggatgtttaccatgaaatgaagcattgacaatatgcaaggccactttttaacataatttgttagagtttgacattctcctggaatacaaagtaaataatgatctttggaattatgctatacaatcttggcttttgttgcctttgctgttggtgctttagtcatgaagtctttgcccatgcctatgtcctgaatggtattgcctaggttttcgtctagagtttttatggttttaggtattagtttaagtctttaatccatcatgaattaatttctgtaaaaggtgtaaggaagggatccagttttagttttctgcataaggctagccagttttcccaatgccatttattaaatagggaatcctctccccattgcttgtttttgtcaggtttgtcaaagatcaggtggttgtaggtttgtggtgttatttctgaggcctctattctgttccactggtctatatatttgttttgatatgagtaccacgctgttttggttactgtagccttgtcgtatagcttaaagtcaggtggcgtgatgcctccagcgttgttctttttgcttaggattgtcttggccctacaggctcttttttggttccatatgaaatttaaagtagttttttttctaattctatgaataaagtcaatggtagcttgatggggatagcattaaatctacaaattactggcaaactgttacttcatttggggttgaatatgagaaaattcaagaagcttagtttagaggctaatgtagtaaggagtccagatgagaaacaacagtaacttgaaagaaagtgatgaaagcaaagactataccatacataggctgttcagttttaggatgttttattgcgtcttttttcataagaagtttatattaacttcttagtgtcatgtcagagcactgctggcttttgttataggccaaactgtgtcttatagaaaattcctatgttgtaatcctaaccccaagtacctcagaatgtgactgtgtttgtatacaaggtctttaaaaaggaaactaaggcaaaaaaatcatatgggtggtccctaatctagctgaatggggtccttataggaagagattaagaaatagacatgcacattatcgtgtgaagatgcaaggagaagatggcatctacaagccaaggagacagatcctcagaaggaacacagcctattgagaccttgttcttggacttccagcctctaaactataaggaaatacatttctgttgtttacgaaccactgagtctattggtttgttgttatagtatctcaagctaactaatatagtcctctgcagctgaccaaaactttcagtcacaaaaagtacccaaatccttaggctacatgaaattaattttattgtcatagagatcataatacttggaaagggcattggcctttgccatatatagactgagtttgattcctgtatccacaatttcctagatacatgaccttagacaagttatttaaatgtctctgagcttcagtttctttaatcatatcagatatagtaggccaatcaccagaccaaagtctggcacaggatagacactcaacaaaatttagtttctgtcttagctctcataatttcttcttctcagtaggcaatcataaagagctcttatgagaatggctctgaaattagatgaaatttgaacttcacttgaattaatcaaagctgatttcaaatcccggctctgacatctactagtttggatgtttgagcaagttattaatctttctaagtcttttttttctcatctataacattttcataaggtggttatgaggattaaatgcgattttgcatggaaagtgcttatatcagagcctgacatataaataaggctagagtagtattttttaatattaattacacacatttttatgagttcttattttgctactaacttcttagttgttggtgtttgtcacaactatgacacattcctgaatgaaaaccatctattctccatgtttcactaatacctatggctcctaacttatattctcagttagatacctggcaaatgttaattcaactattgccaagcattctttctagaaatttaaaactaaaactgctcattagatatgcactgagtattcagtagtttttccaaagtaacagcgtcttagtacttcttaaaaacatggtccttgtctctattgcctatgtgggcacctcacaaagcaaattggaacagatataacccctgtaatcagggatcttaatagctaaagcaccttgattggattcccctagtgttttaacaaaatcacttatggtctaattctcctgtcctcattttgctgctgatgaaatcccacgatagtaccaaagtattggcttttttcaactctgctgcactaatgtctgctgttttccttccacactaatcctttaatcatacctttgagataccagaatgtaaaaaccacttgggattacctaacacacaggaatagcaagttttgctctgaagcagatggaagcagccaatgtggctcctttttttcctttaatctcaagatatctgtaattctgcccaagcctccaggggacacttctggctaagaaaaatcctggaaatggaagtcctatctattcctatttcactgaaagggtgaatcacttttagaaacatttcaaggactcaggattacactgggtcatgagtttatgaaattgtgtaggtagctatggaaaaaaggaaataatcatggatatgctttaattttaattaaaaactcattattattgatacaaaaaatggtacctgtccagtttccaagaactccagcaatgcaatgactgttcataatcccttttcctggaaatagatccctgtttctctgtttatttgatgtgtgtacatgatccactttacttaataaattgtaaggcataaatttttaaaagtgttataataatttatattaataaagtataattttattttagatttataactcttcaacccccaacctcagttattggcttaaaggactgagatgttacctaaactgctcatcgggccttttgcttatgtttttcaaactcaagctaatagagaatcactttattccttgaaaaatatttttattctcttcaaaaatgtgagccaacagcagtcattagtcatggttccaacctcatgaagaaatgaaaagagagaacaatgcctctataaaaaagaggggaaattaataggtgtaaggaggtaaatctgtcagtataaaatccctggttatatttttttagtggcccctactatatccctgttttttcacaattacataaacaagtagattctttttgcttgattttaatttccataacttacagtgatagcatcctgtctttctaatagaagtaagaaaaaatataagggaagaaataattctagggagaggttagaactttagttaggccacaaagaacgggtagaaaagaagaaatacttcactatatgagaggatattctagatatgggacagagctttatagggagtggagtgacagatatggacataaagtatgtttttggttgtcattagatttttctgaatcatagggcccatatgggtgaacaatgggagaaagcactaaaataaagagaagtccccaagacagacagagttgcaacctagtaatacactaggcaatgcagatagtttatgtctcaagcatgaaagttatagaatgaaaataatatttaaaaatatttttctggcaaaggttcataagggtgactggaggcaaaaatggtgtgtgagagagatccattgagaagctactgaaaaaaatccaattgtgacatgacaagaactttaataggtcacagacaacagaaagcaaagaaagagttaatcataaagccacttctacaaagaaatcatggtgtttggtaccatattttgtctagggctaagtaatgcataaaaagaaagaattaagaatgatttcatagtttgtagtctgatagaccaactaacagataggatagccaggcagtagaagctgatgtttgaaagggaatcttgtgttccattgtggacacatggattaccacaaggaatctacaaaacgacattttggactcaaaaattaacctaataatggagctctcatgagaggtctgggcagtgggggatatgggtgtacgtgtaaaaatgagaggtaaagccaagaaactgagtgaagagaaagaacagagagcttacgccagagcttttgctcagaattaaataaacgattaaagggaagaaaggttgtttgaaaataataataataatagattgaatactcccactcaatacaaagaaatgctaaatgtttggatggtggatatgctaaattagtgtgatgtgaccactgtacattatatgtatgaaaacaccactatgtactccatgaatacgtacaattattattgtcagttaaaaataaaatttaaaaatgttgaaaaaatgtatcaatgacatctaacattattgagagttagagttgggtaagcttttatgcacataatctcaatgaatgttcaaaacaacccagtgagactggaatgaaatattatcctcatttcccagatgaagaaactacagcagagagattaaacaacttactcaaggtcaaataactattaaagggacacagaataagaacttaaaatcagttctaatatcaaagcttaggtatttatacacaagcctgttcaacctactgcaggaaagaaaagaggtcactggaaatagaggagacctacatgcatctaagaaagatgatgattccagaatggaaaggtgccctatagtgttaaatgccataatgcaaataaagataactaggactgaaagaaggcagcaagacatggtggttagtaacctgtagcagcactgtcttagtgaagcagtagagcataaatcagacttgagtgcaaagtttggatgaagaataggaggtaaaaagagtatttatggaatgcaaattctagtatatggaaatgaaagaaaggagagaatccatctaagccaggtaaatccacattagcaaggaagaccctagcatattaaggaagtttttattcatgtaatattttcattcttcagagttatttaaaatactgtgtgtactgaaaaggaatttataggtgttgaacaaattgctgtaatttcaaactacataacttattaaagttatttactagactcttaaatatcttgtaatcccataacaaaaaggagataataggttagaaataattataccctataaacagatgaaaaaaaaagttcaatagaattcattaacatactgaaggtcacaaaattaataaatgttaggaaaaaaaacaggctgctgaattttatcaagtactgtttccattatatcacacagaaacctgtaaatctaattatcattcaactaacagaaaaacctacatttttagtgagaaacaaaatgagatggacagagaggaacaaattaacattattaagcattgttaaggtattcctggaaatttttgtgagactaatgaaagctacatgtttcagaagatatcatattatcataaatgcacagagtaatgaaatataaaattaatcaccaaggaagaagcatattaagatgcaggaaacaaggcactaacacagtgtaataagataaattcaatcatctaaaaattataatacaaagaagtgatgcaaattagtaatcatttaaattttacattttattaaagtgagccttctaaaagataaattcattataacttaaggtgaggctgcaattatttctccttcaagacctttatatttttatatattagctattattattaagagataggcaatatttaaaaatatataaattgtgagggaggcagaagaagatggcaaatagaaagctacaaagatcttccctctcccactgcaaggaagggatgaaaaatatatttcacacaaatagaaactagaataagagattttaataaacagacctgaatcactgacaccaccccttcctcaccctggcagtgacagagagcatctctgggaatttagagagggaaaacacagcaattgtgaggtattgaataaaaaacaaggaatcaaagcatattactagaaaaaatcacttaatcacaaagaacaaatgtaaaagaagaaatgaaaaaaggatcaacaaatcaactggaaaacaagtaacaaaatgacagtagtaaccccttacctatcatttaccttatatgtaaatgaaattcttcaatcaaaataaaacagaaaggctgaatgaattaaaaaaaaaaagacccaactatatgctcatacaagaaactcatttcatctataaagatacacgaagactgaaagtgaagtaaggaatgaaaaagatattccacacaaatggaaactaaaataaagcaggagtagctatacttacattaggcaaaatagagcttaagccaaaaactgtagaaagataaagacactcacaatgataaaagagtcaatagagcaacaggatataacaaatataaatatacatgcactcaacataggagtgcctaaatatataaagaaaacattaatagacttaaagaaagagattgcactgcagtacaataatagcggtgggtttcaacaccccacttttagcaatagacagatcatccagatatagtgaaatatagtttatttacatagttaagccacactgtagaccaaataaacctaataaatgtttacagaaatattcacgtaacagcctcagaatatgtatttttctcagcagcacatggaacattctccaggatagaccatatgtgaagtaaaaaaaatactcttatcacatttaaaaatgttaaaattatatcagataacttttctaaccaaaatataataaaactaggaatcaataacatgaagaaccttgggaaatgtacaaataaatgaaaattaaacaacatgctcctgggcaactaatgagtaatgaagaaattgtgaagaaacatttttgaagaatattgatacaaatgaaaatggaaacccaacataccaaatcctatgggatgttgaaaaagaagttacaataggaaagtttatagcaaaaacacttatatcagaaatgtagaaagattccaaagaaataagcaaaagttgcatttctaaaacctagaaaaatgagaacaaaataaaccccaaactagtaacagagtgaagaaataataaagatcagagcataaacagaacatagactaaaaataaacataccacagaaatacaaaggatcattacagactcttataaacaactatacccctaacaaattagaaaacctagaataaatggataaatttatggatatgtacaacctaccaagattgaataatgaagacacagaaaaactgaacacctgaacagaccagtaatgagcaatgatattgattcagaaaggaaagttcaacactggatatattcactgccaaataattctatcaagcttttaaagaaagaaataataccaatctttctgagatgatttaaaaaaaaaggaagtacaaggaatccttgtaaattcatgcttgcatggtatttgcataaaaaacagacatatagatcaatggaacagaatagagaacccagaaataaatccatgcatttccagccaattgctttttgacaaagtatcagaacacacattagggaagggacagtctccttaataaagggtgatgataaaactggatactcatatgttgaagaatgacactataaccgtatctcttatcacttacaaaaatcaactcaaattggattaaagacttaaatgtaagacctgaaactatgagatactagaagaaaacacaggaaaaaaatgctttatgacgtggatctgaacaaaggtttttgcaataaaacctgaaaagcagaggcaacaaaataaaaagtaaacaaataagagaattatatcaaactaaaaagcttctgcacagcaaaggaaaaaatcaagagtgaagagacaacctgcagaatgggagaatatatttgcaaactatgcacctgaaaaggggttaatattaagaatatataggtatacaagggaaatattgctgttttgatttcagaccattacaataaagcaaatatcacagtaaagtgagtcacaaaattttttgcttttccagtgcatataaaagttataataccacactgtagtttatgaagtgtgctataacattaggtttaaaaaatggacatactttaattttaaaatatgctgaaacatgctaatgaatatctgtgccttcagcaaggcataatgtttttgctgatagaggatcttgtcttgatactgatggctactgattgatcagggcggtggctgctgaatgtttgggtggctgtggcaatttcttaaaataacaatgaagtctgccacatgaattgactgttttttttttttcatgaaagatttcttggtagcatataatgctgttggataacattgtgcccacagtagaactgcttttaaaattggagtcaatacactaaaaccctgctgctgctttattaactagatttaggtaattttctaaatcattctcatttcatcaaggctcacagcatctttgctgtagcagattccatctcaaaaaagcacattctttgcttatctattagaagcaacttctcatccactcaagttttaccataagattgtataaattcacattgtgaggctcaccttctaactctggttctcttactcttctaccacatctgtagttaattcttctacttgaagtcttgaacccctcaaaatcatccatgagggttggaatcaactttttccaaattcctgttaatattgatattctgacccactcccatgaatcactaatgttattaatggtaattaaaatgttgaatcctttcccagagattttcaatttactttgcatagattaatctgaagaatcacaatctgtggcagctatagcattatgaaatatatttctgaagtaataagaattgaaatccaaaatttctccctgatccatgagcttcaggatagatgttgtcttagcaggcatgaaaacaacattaatctccttataatttttcatcagagctcttgggtgcattgtcataaagcagtaatattttgaaaggaagcttttcttcttaagagtagttcttaactgtgggcttaaaatattcagcagagcattctataaacagatatgctgtcatccaggctttgctgttccatttttagagcacaggcagagtagatttagcatagctcttaagggccttggggtttttggaacaataaaagaacactggcttcaacttaaggtcaccagccgcattatctctaacaagagagtcagccgtcctttgaagccttgaagcaggcactcacctctcctctctaggatggaagtcttagatagcatcttcttccaatacaagtctgctttgtctacattgaaactgtattgtttcgtgtaaccacctttatcaattatcttatatctggatgacttgctgcaacctctacaatagtatttgctactttaccttgcacttttaggttatagagatggctactttccttacactccattaaccaaactctgctagctgcaatctttccttctgaagcttcctcaccattctcagccttgagccagttgaaaagattcaaggccttgctattaattagactttggcttaagtgaatgtggtggctggtttgatccaggccactaaaactttctctgtatctgcaataaggctatatcagattcttataatttgtgtgttcactggagtagcatttttaaatttttcttcaaaaattttttatttgcattcacaacttgactaagtggcacaaaaggcctagactggttagtgtatcggggcttttgacacaccttcctcattaagcttaatcatttctagctttcatttaaagtgagaggcatgtgactctttcttccagttgaaaatttagaggccattgtagatgattaattggcctaacttcaatattgttctgtctctgacaacagggaagccccaaggagcaggacacaaaagggagagtggcccattggtggagcagtcagaacacaaacgtttattgattaagttcaccaacatagataggcatgatttgggattccctaaacacagataaaaaatgtggtatataaacacaatggagtactactcagccataaaaaaagaatgaaatggtgttatttgtgacagcatggatgaaactggaagacattatgttaagttaaagaagtcacgcacctaaggcctaataatgcatgataccaatcataattggaatcttaacaagttgagctcattgaagtagagagtaggatagtggttaccagatgctggaaagagtagcagggaagaggggaggggagaagtcagtcaaatggaacaaaattacagttagataggaggaatgagttctggtgttttattgcacagtagtgtgactatagccaagaataaggtattatatacttcaaagtagcaagaagagatgattttgacaagtatttgaggtgaataatatgctaattaccctggtaaattagcacatgaaaatatttccatcattagacattagaagaatgcaaattagaaacaattagataatttcacacaagtattagaaagactacagtgaaaaaaagaaactaaatgctggcaaagatgtgaagcaagggcgactcatacattattggtgagaatatgaaatggtatagatatttggggaagagaaatatttatctttttcattaagcagtttattattattattattaaggcagtttatcattaagaaatataacatatcaacctggcccagtggctcatgactgtaatcccagcactttgggaggccaaagcagatgtatggatgtatggcttgggcacaggaatttgagaccagcctgggcaacatggcaaaaccctgtttctacaaaaaaaatatgaaaattagctgggcatggtggcacatgcctgtagtctcagctacttggaacttgggaggctgaggtaggaggatcacttgagccctggaagcagagattgcaatgagccaatatgctgctgctgcactttagcctaggcaacagagagactctgtggaagaaaaaaaaaaaagcagaaagaaagaaagaaagaagtaaagagggagggacagcattgggagagatatctaatgctagatgacgagttagtgggtgcagcgcaccagcatggcacatgtatacatatgtaactaacctgcacattgtgctcatgtaccctaaaacttaaagtataataataaaaaaagaaggaaagaaagagaaggaaagtaaaatataccatatgactcagcaatcttattgtaatcatccaagagaaatagcaatttatgttcacagaaaatctacacaaggtttatttatttactccaggtatataaaattgccaaatttggaaaaagcaaaaaagcacagatgttcttcgataggtgaattattaagcagaacaccatgcaccagttgccaatccctggagaagactccaaatatttctgcccattgcattttggtattgcagttatcatgggaatcacaacacagtcaagcactggatggaacaactctttattcacatagagaggaaacagagaaaaattcattctgagagtatttttcaataccccatggccagggggtctctcccagcaatgaatgcagggtaattgtccatgcacactccttgagtaccacagaaggtccctattccctccccacagtggagctggccaagtgccaagggatacacttgcttaaacagaacaaagggacatatactaggctggcaacggagaaagatattctcacacaaggcaataggccctgcacaggtggtgtgcactctttttatcttggtaagaaagtattccaggcccaaaatccattaggtggctaagtaggagaaagactgtactcatgagactgtcttttccaacatgaatgaattaacgaagtgtagttcatccatacaatggaatactcatcatcaataaagagaaacaaactagtagttcatgcaatggcttggaaaaattccaaatgtattatgctaagagaaagaaattagactcaaaaggtttcatactgtatcattccatttagggctttctggaaaagacaaaactataggaataaaaatcagatcagcaattgcagaagataaaagagactggcacaaattacgtttaggcaatttggcggaggggttgatgaaaattttctgtacctagttctggtgataaaaatgtgtatatttgtcaaaagcaataaagagagaattttttcaaaaagtggattttgttgtatataaatttagatgtcagttataggataagaaatactatggaaattgtaaataaaatataaaatgtgaggaaaaattttgtataaatatttaactgagaaggactctaaatataaatgtaataaaaggggttatgagtgcaaattgaatagattaaatagattaaaatgtaacattttcctctcttaaaaataacaaactgggaggaagtatctggtaatcacagatctgacttgtatccagaatatagaaagtaatcttagtactcaacaacaagaaaataaacaattcaattttttacattgggaaaattttaaatagagataccataaaagagcttaagtctttaagttagatattaatattatattaataattaataaaaaatggcaatgctagtagaaaaatgaataatggacaatagcaaatttcaaaagagaaatttagagtaataaataaatgtaagaaaaatacacacattaaaaaagctggtgagaaatctacctgtaaccagtctccttccctttctttattttataatgtcagccatatgtttccaagattttcatcacctttctgtatttatatgagcatatttttccttgattaatatgaaataattcctgagtaaatattttttacctgtttattttatctaactttcatctaccttggtagatgaaatgatcagtatggcaagcattatcagataatctgcttttagtactatgaggctctcagcagattgcctatagagctgaaatcacagctctttctttgcagcaaattttcagtctttattaaatattacttaatatttccattaggatggaaggtggggtgggaggaaacaaaactaaacactagccttattatagagaaatagatgcatgtatttaatgaataaaatgaataagcctttaatgaagtggtttgggtacacagggaatttctggagaaatgcttgagatttcaatatgaaagactggagaggagatggtatgagaattttgacatgagccagccaagtcttagacaagaatagaagcatcttttgctaggcatgaaatagacagcatgcaatttttggctgtttgattgccaacaaagaacgctatgaggcagggaagagagagaaaaggagcatgaaataaaggaaaaagaaggtcttaacagaaacaaaaatgtgaagagcaagcaatgcgtaaatattaggtagagcacatgaataaataaaatggaattgcaaatatgcattgaagagattatggcaataggaaaaaagtgagtaaaaactgtacattttgtatatttctctaactcatattattcattcattctaccaatatgtattagtcagctcttttgtgaataggaccccaaattggcatagttctatataagaataacatacactgaattaaccttataaaaagccttccttatatttacatttaaacaacaaccctggaatacaattctttcctcattttaaatttgaaatttctgaattactttaaagttatttctgagcaagaacttggtaggaggtctcctgaccctggtccattgtgtttcccacaaaaccatttgacttatatcatgacaagacatgtggcttcaaaaatttgttatcctatcgggaaatcttaagcaaatagaatgttttaaaggaagcaagatttactgacaaaggagaggtacgaacaattaagtgtgttgggaagtgtctagactttaaagtcttattggattgggttcaattctatttctgcacatactatttgtgtaactttacacaaattactttaacactcagtgtactgtctggggaaaaaattgcaatacctatcttatagaattgttgtgaaattaaatagttaatataggtcaagaaggacacaacactgaccctaaataaatgacaggaattatggtaaaaggtaataacattgtatattacagaagtccaggaaagcctaaatgaaggtggtgttttctttgatcccttagtaggatttatatagtcaggggaaggacattaagtgacatgtatttttcagtgtaagcttcaaatttaaaaaaaaaatattattaaaaataagactgtgttaactccatctcattttcttttaaaggaatcctcttaaaaactttaatttttaatggatttgagactttaaaagtttgagactgtcataatgattttaaacaatttctttaaaaatgttaccatgctcaaccataataggcctaaaaaaaaaaaaactgtcaccttgatttcttcaactatgatgatcaacaagagatgaacttgatggatttaataactgtagaaagttacttggcagagggcaaaagataaacatcttctgcgataaaataatgatattaaactataagatatcaaaagaatctgaaaacttaaaaagcaagttagtttggtttcagttatatggaatagcaagcaagcacgtatttattttctcttcactagaagaaaagcagtaactcttcaaaaagatgaaaccgagttcaagtataaatggagactgtagtaacaaaggatgaaaaccatgtgaactcagttctcttagacttttctagttctcatttaaatagtggccatttgttttgctcttgctaacttcagcttcaatactccaatttcctatgggagactttcaggttttgtgaaacacaaaacagaaaaaaaaatccttattgttctgtgaaaattacaaactaattatttaaaaattttgaatacaaatcatatcctacttaagaaagaatccaatggcataataagtacttatataaaactgaggctttggagttcttagaaatttttcattttctatacaaaatacaaatcagaattgatggaatgctgggcacgttggctcacacctgtaattccagcaccttgggatgccaaggtgggcagatcacttgagctcaggactttgagaccagcctggtcaacacagggaaaccccatctctactaaatatacacaattagctgggtggggtagcatctgtaatcccagctatgcaggaggctgaggaaagagaatcgcttgaacccaggaggtggaggttgccatgagctaagattctgccactgcactccagcctgaacaacagagtgacactctgaatcaaaataagtaagtaaataaataaataaataaataataaaaagaaaaatatcatgcctgtaatcccagcactttgggaggccaaggcgggtagatcacgaggtcaggagatcgagaccatcctggctaacacggtgaaaccccatctctactaaaaatacaaaaaaaaaaaaaaaattagctgggcgtggtggcatgtacctgtagtcccagctactcgggaggctggggcaggagaatggcatgaacccaggaggtggagctcgcagtgagccgagatagtgccactgcagtccggtctgggcaaaagagcgagactctgtctcaaaaaaaaaaaaaagaattgatagaatgaaattcacctctcattcagccccttgtaaaattgtgtggagactacaatttatttattatattaataaatatgtcaggctatcaatagctaataatttcaataatttcattgaattcaagatcaaacagctgatgttatgtttattattattattaattatttgtatttccatatgacaaggtttggctgtgttcccacccaaatctcaaattgtagcccaaataattcccacgtgtcatgggaaggacccagtgggaggtaactgaatcatgagggtgggtctttcccatgcttctcatgaccgtgaataagtctcacaagatctgatggttttgtaaaggggagtttccctgcctatgctctctctcctgcctgccaacacgtaagacatgactttgctcctcttatgccttctgctatgatttttgaggcctccccagccacatgcaactgtgaatccattaaacctctttcctttatagattaaccagtcttgggtatgtctttaatagcagtgtgagaacagactaatacagtaaactggtactggttgagtgaggtacttctgtaaagataccccaaaatgtggaagcaactttggaagtgactaactgggagacaatggaacagtttggatggctcagaagaggacagaaagatgtgggaaagtttggaacttcctaaagacttgttgaatggctttgaccaaaatgctgatcatgatatggacaatgaagtcccattcaggtgatctcagatgtagatgaggaacttgttgggaactaggtcactctttctatgcaaaaagactgtgggcattttgtccctgctttagagatctgtggaactttcaacttgagagagataatttggggtatctggtggaagaaatttctaagcagcaaagaattcaagaggtgacagggcataaaagtttggaaaattttcagcctgatgatgcagtaggaaagaaaaaccaattttctggggagaaattcaaaccagctgaagaaatttgcataagtaacaagaagtcaaatactaatcaccaagacagtggggaaaatgtctccagggcatatcagagaccatcatggcagtccctcccatcacaggcctggaggcttaggaggaaaaaaatggtttaatgggcagaccccagggcccacttgctgtaggcggcctcaggacatggtgccttgcatcccagctgtttcatctgcagccccaagccttggcaacttacacatggtgttgggactgtgggtgcacagaagtcaagaattgaggtttggaaacttccatatacattttaaaggatgtatggaaatgcctgagtgtccaggcagaagtttgctatggggtcagggccctcatggagaacctctgctacagcactatggaagggaaatgtgggactggaggccccacacagagtccccactagggcactgcctagtggaattgtgagaagaaggccactgtcctccagaaacccagaatggtagatacacctatagcttgcactgtatgcctggaaaagccacagatactcaatgccagctcatgacaagagctggagccctacactgcaaagtcacaggggcagagttgccccaagacataggaacccacctcttgcatcagcatgacttggatgtgagacatggagtcaagggagatcattttcgaactttaatgactgttctattggattttggacttgcatggagcctgaagcccctttgttttggccaatttcttccattttgaatgtgtatatatacccaatgcctgtaccccactgtgtctaggaagtaagtaacttgcttttgattttacaggctcataggaggaaggaacatgccttgtctcagatgagactttggactgtgggctttttagttaatgctgaaatgagttaaaccttttggggactgttgggaaagtatgattgtgttttgaaatgtgaaagggacatgagacttgggaggggtaagaggtagaatgacacagtttggctgtgtctctacccaaatcttgaatgatagctcccataattcccatgtgtcatgagagggacccagtgggaggtaactgaatgatgagggtgggtcttccctatgctattcttgcggtagtgaataaatcttatgagagctgatggttttataaaggggagttcccctgcacatgctctctctcttgcctgctgccacataagacatgactttgctcctcctctgctttccgccatgattctgaggcctccccagccatgtggatttgtgagttcattaaacctttttccttataaattacccagtcttggatatgtctttattaccagcatgagatcagactaatataccatatttgtccttaaaattgaataatatttccacatttcaaaatttccacattactgccttaactgaattactcattcctaagatctgaaaagaagccattttttaaaataatattttatttatatatgtttataaatgtttctgaatttatatatattataaaatgaggtacatcccattcttgttttatcctattttttaggctctagtttaaatcagtttaaatatataattgttatgttttagatcttccatctactgaaccacaactcaatgtgcagaaaggaaaaaaatacaaaccaagattaaatcctctgaagcatatgttttataaagacacaagtggcaactcaataaaagtattatgattattccacttaaatttcattataattagaaatccttctatagaaaaatccattgagaactttgatttttaaattacagtcatcattagtaaaatttctgaattctatagtaggtaccatgttttttttttttttttttttttttttttttttttttggtaaaccagctgtgtttgaagctgggagttaggggactttagaaaggtatttaaatagtacagtatccctccttaaaaagtttttcagctccagtaagagaaacaaattaatatataaataaggtttccacagataacctgcctttaaaacaaaccaaaccaaagaggcaatatgcagttctcataaaaaaaaatctccagtctctttgatatagaagttaaaaagaaatcacttagggagatagcaagggtttgggaatcctcagtcacactttttacctcatgaaaagcagccccaaatcatttactaacaaagagcagcctggaaagttgagctgcagaggtagacaagtgagctgagagcttgcacaggtgaatgttggcaggaactgaggactagacattttcaagatggcagctccattcttcccttctctgccagccatgtatactgtaaagagcagacgagatggtgccgatcaactggaaagcctatttgcataataagattaaggtggggtgaccagccttctctgcactctatgtaaacatcatacctgatcaaaccaatctatgagccctgtataaatcagacactgcctcctcaaactggactatatattttggtgcatttgcagccagccagtcctttccactcagagacctgtatctctatagagaaagctgtttctctttctcttctcttcggcctattaaacctttgctcgtaaacttctcatatgtgtctgtgtcctaaattttcctggtgcgtgatgacaaaccctgggtttacaccccagacatagctgctttataatgggggctcgtccgggataacaacatacaacattcatcgagatggtgagtagaggagcagactccaactctgtccttttattctgaggcccttggcttccattttagaaccagatcaaaccaaatacggggcccctttcagccatttaaaaataattagcatggctgccagccttacaagacttgggggacaggattgctagggagaacatggagcatcccccagtacccatgggtcactgggcatactggccctgtttgaaccagcttcctttcactgaggacttagctgtcatgtggggctggaagaagtcctggtgtacctgaggatttccggccagggttaccaccattgttatccaaaggtatttggacggaccccagcctctgactaccctgatgagatgtcggcaacagaatctccaactttttatcataatttcctcctttcctgtctgcgatcatcatatctatttcatcctctctgtgtatgcaatgtatgggaaattttatagttcagggaggtaatcttgtttggcaagatcagggaatgtcatagtaaccagcgatatagctcaagggaaggcatctttgtgattttcgaggaacagagggtcaccctcaccacagggagcatctctctctgcccttggtctgaaaagcacatgacatttcaaggccaacagccccacctagtggaatagggatcttttccatgaggcacatcgttggtcctttacccaaacactctagctaaccaattctctccctttttgcatccctctactagacaccatgctttatgctgcttctgttaacaggaaaactctagcttcaacaattaggattaaaatgtcttctggaaccaaatgttagttcttgatactgtcccatcagcaggaaaattgccatttagtccatacatttttaagacacctattctgcctccaattagaatggtacttaattagtaaggggattttaagtctggaagttaaccagaaccattctctaagggaaaacgctttagtacagcccataatatcaggtatagatttcagtctagcccctccattaaagagggcttgcccaactattatgtagttttttttttgagatctatttttcagggagccagacaggtcacacaagtctaggaagtcaaagggaaatcacaggcagaggacagaggactagagccacttgggtgagtgtgacaaaccccaatctctaagtgcctctgtttccatagctggcagtcatgcctgcaactatgggtggcatgttcaacaaggtgccgggacccaggaaccatggaaggaatatagcaaggggaatgcccccactgtcttcctctccactctgtcacacgaaaaggaaggagactaaagggatacttttttgtcatttctctttctagatgggtaccatattcagcctgcactcccctggagtgcattctgaagcacagggactcctcttaaccagagactttaaagaaaaagcagctcattttcttttgcacaagggcatggcctttttactagatccttgcaagcactgcaaaatgaatccagctcttttagcaatcatatcaggcaggccaaaagagaataattccccaaaatgagaaaagcaacttccaggggaaccacccgaggcagctattgtgtgtaccagcccttccagtctgccttaaccggggccacctccaaccatgccaccagttcttctacctccaccatctctaaaattttccattccatcaccttctcacttacccctacagaaaatacataattgaggtgatgccaccaggattcaagtacccttctcattgcaggacctcaggcaattaaagggagacttaggccaattttctaatgaccctgataggcatatagaagttttccagaatttaactcaggtatttgacctctcatggagggatgttatgttgctcctaagccaaaccctaactgcagctaaaacagacagctctgcaagcagcagagaatttctgaggtgagcaataggtctcctatagtaggccaaatgggaaaagagaagatagagaaagtgaagaaacaggggaaacaccattcccagcaggaagagaggcaatacctcttgaaaccctaatgggaagccccagactcttctatggtgtttttccttttttcactgttttcaatggcccttttatgatgttcattcaacctgggagaagttaatttacccaaaccttaaaatgcttggcttacagttgagctgggggagaaagaaaacccagaagcatgacatgccggcaaaaaggtaaaagtttttttttactagttgggtttttggcttctctatccctgtgcaaaccggtaaaagaaataataaggatcactatttatattttctgaaaagttttaattaatgagaaaggatttgtgaggttggccttaagttgtagacaatctggtgtgctttgtgtgtctttctgtatggttctgtccaaagaaaagttactttaggttaggatgcagacccaggaccccctaagcctgctgttcaagccagcccaacaaaatgatcagtaacaaacttggctaaaggcctccatcttgcttcttgtccttgggaacatgacctgtaaccatgtggcgaataatttgttttagtctccaccattttacaatgtttgctgacttcttatgctaagtcagtttctgggtaatggccacaaaatcagataagccagtttgtcaataagggagctgccagctgattgatcaagggcagggtttacaaaatatcttaagcactaatcttgagggctaagttaagagatggtcaaaatcttgtagcctccagctgtgtgactcctaagccatggattttaatcttgtggctagtttcttggtctagtacccaggcaagaggaaagtatattttaagaaagggctgatatcatctttgttttagagtctaaactgtaaaccaggtgcctcccaaagttggttcagcctacacccagggatggacaaggacagctcgcaggcttgaaaaaaaatagagttctttgggtcagatctctttcactgtctcagtcacaattttgcaatgacagtttcaaaagctgcttatcacccctttaaaaacaccttgtacactcactgttacatcgtaacataattaaggcttgttggtttcacctgtgaggttactttttgtaaagttcagaagctgaaaatcttaactgcttggcatagctaaagttgagtaacagtggatttaaagggattttgttaaagagtgctcagcttaattaaaactgggtattcaagtaataaatatatttaaaaggcctttatatttttctcttcttggatcttgttttctggaaaaaaatttttatttttctcagttgactaaatcatctttctccattttatttcttgacactcttaatgcatgtgtgagaggccctaagataacttctggtagtccttgggaaaaacagaggaggtgccacagaccccattgtggggaaaaaagcaaacaaacaaacaaaaaaaaccctttcttttcctcatgaaaccccaggaattaagagcagatagtgccctctctaaattaaaggttctgttcagttttgctttgtgtgttctgaccattttgagttttgggtgtatcaaaatacttcacattaggagagagctttgatgtgtaataagtaggcaggaaatacactttaagggatggcaaatagtagttataaatcagagaagcatgctcttggccacctgaaagatatggaaacatccccacatccccacatccccacccccgactgagagatgatactcccatgggggataaagctgattagctttgggttgccttacaatgaaatacatggtagaagcaatgcactgttttctcccatagtatctccctcctttaggggaccaaaaatctagtataaaatggcacacttaattttagggatctgcctttgccttcagctgtgcctacttattaggccctaaaaatgcatgctacctggcccagttccaccaaaggctccaccctgaagccagtaatccaattaagaaactgacaaatgaaaactcttacaagtgctgaatattctgtttgtgttgctatatatgtgttgtgtgtaatgtctacaataagagctctaattaattggcttaaaaaatagtgcttaaatcaaatatgttttagttcatgtgactttaatttttaagaaataaaaataatcttaaggattattggtaaaatgcaagggtcatcaaaatccaaataggtggtctaaatcgtaaaacagatactaggtttgctaaatgttcaaaggttgtatactgcctgattttcagataagtaaggcctgggacacatggagttagatgctagaaagagtcagatcttatatgcatttctgcctgggtcctaggctccacgcctggtacataattaaaattgcttactaaccaggtttctcaacaaatgtaaaacttgctaagagttaacagtgcagcatgtatttgagatcactgaacagttttaaaggcaaggtgtataaaaacagtaaaatgtgttttttagtaaaggattataagaaaccatagaaatataaatattgcccagggatgaggaattatcttaaatttgataagataaagctacaggtttaagcatgttgtggaaagatggtcttttcataaactgagcattgaaataaaagcactgtaaggctgtcttaagccactaatctgccctttagcaaaatgggttataaaaaaggtttgtaaggatttcatctcatggtcaaattggttaagattagatggaattgtctttagggtggcatttaatcaaattggggttaacattaataaattaacgcaaaggtaaaatttggctttgagcaggatttttatgtaatagtaaaggcttatgaaaggtttttgccttttgagtcatcattttggcaaaataagtaatttatgactatctggaattctatttcataacatcaactgttttaaacctctaacatttaacagacataccaaaatcaaacttcaagtttcgaaattgtctttcctgatgcgtggctttctagattgttcagggggcccctgaaacattcagaaaataggtgaacaggattatttgacatgtttaatcacattgggattgccaaaatgatgtccagtcttaacttatatttttgtgaataataccaatatatgttccaaaattgtatgggatttctaaaattctaatgtctcataattaattttaaaattattgtaaaccacggagataactaaacttctttgtcagtcatgtttttaactgtaactaccctgaaaattttgtcacttacagacaattgttatcttgctatgttccttctcaaaagatgggatataatcaagctataagactttaacagctgttctcaaatgcagatttccaatagctttgaagattgtaacattggaaaaaatgtacaggactcatgaagaactgaaatgtttatgaatatcaagtgaaacaagagttgtcttaaatggattgtgctcagaaagctaaagcaatctttttgacttttgcttagaatattgctgatccttattttgtttttcagagtcaaggaaacttattttgaactatgtgcagcctttaataattaagtaagttatactcttgtgaacaaaattcggagcaggtttgtttctctgtacctggttcctctagaatttggaaaccatctgtgagtaaccttaacttacggcaatatagttgtttgcatcagtgccacaagaagtcttttttttttttttttttcaataagacacaattagaaaaactggttattttatcaaagctttgacaggaagtgtatgcttccccctttaaagagtcaatctcagcttgcagagctgataaaagcaccttggggaagactggcctcataccttgtctacacagtccctggacaggtttcttaatctgtagtcagtaaagaatgtcactttttaacatgtccaggacctccaagtttatcttgggaccttaagtgtaaagtatttggggataaaaacccattgctgaacttggcttgaagaggtattatctgagattccttatggaacagagttccatcaaagccaacccaaaaggcctatgtagggataattattcttgctgcactttatgcaaatattcacgccaagtataaggctaaagtttattctacaaagaacacagtcctatcataatttgtttttaccaaaaatgagcaatggagagagaaattgtgctccaaagcttatcatacatttgtcattaaatcctagtcacaataattgtttttaagctttttacctacattttagactaaccctgcttatttctgtgaatcaagtggtgatctcctgcagcttggaagaaacaaagagagatgggtaatgtgaaaatctggataaatatgctagttctgggcaattattctgcaaattctgccaggtaatgaaagtgagtagggtgcccataacccagaggtttatttgtttgggaaaataaagccaagaaacttcatagactccccaaagggaaattctgtatcttggcaggtaaaactttagatgaaaattatctactacaccacacttgcagaaattgctatactccctctactattcacagtagggctatacacagtagcaccttctaactggaatatcagacagagagtttccactgctgtagtattttgcttaattattatccttacaggagggataatagtcaccaaaaaaaaaaaaagaaaagaaaaaagaagtatgaaagttttactatcactgaatctgctagaacttcttattgggtttggtaatgtcacaccctggctatatacaaaggatataaaggaaaaaatattttacataagaaaggatcttgtatgataaatacttctcctaaagagaacagttggttgtttaaaagagggatgtttaggagaagtcagaagatttgagcatgttatagatggttgtggaagtcatgaaaagattacaaggatggtaaatacctgtcctaaaaagaatagttggtcgtttaaaaagaaggatgttaggacaagtttaagcacgtcttagatggtctgttgaagtaatgagggaattaatacttacaggaaagatttagccaaggttaacactaaagttactctagctacccaaatccaataccacttattcaaaaaagaatgttacttgtatattaatatttcagcagcacctggtggaggaaaaccagtatcacaacccattggaatgactgacagcaattaaactccaaatggagctttagactgaacaacacatggatgcatctttcttccaggaacccttagatcgaaccaagaggagccctagctgctgttccccacatgacgtcccttttcagcaggaagtagccagaaagagtcatcatccaacaccccttaacagcagttagggttaccactccagagaggggaatgatagaggagttaagaagaaatcacttaggcagatagcaagggtgtaacagtctttggtaatgcttttctttttaatgaaacacagccccaaatcatttactaacaaagagtagcctgtaaagttgacctgcagacatagacaagcaagctgggagtttgcatcggtgaatgctggcagaaactaagcactagacattttcaagatggtggctccatcttctcttctctgttagctatgtgtactctaaggagcagacaagatggtgctgatcaactggacagcccatttgcataataacattagggtggggagaccagacttccctgtgcattatgtaaacatcatacatgatcgaaccaatctataagccctgtgtaaatcagacaccgccacctcaaactggactacaaaatttggtgcatttgctgtcagccagtcccttctgctcagaaacccctttctctataaagaaagctgtttatctttctcttctcttctgcctattaaacctcagctcctgtactgcttgtgtttgtccgtgtcctaaattttcctggcgattgacaacaaaccctgggtttataccacagacaatgtagctgcttcatcttgaggtctgcctatggcactaaggtactttctctttggtcccaccactgcaattttctaacctgtgttctagtgcctcccaggcactaatcttcagaatttcagaacttttttctggctgtgtgcttgaacttggaacttaatggcagaatcggttttatcttcactgcttgtttgttcctattcctgtttgtgttctcctcaaaaaatcatatgttaaaatcctatccccaaagtgagagtattaagaaacggggatttggggacaatattaggtaatgaagacagaatccttatgaatgaattagtaccctcataaaaacagaaatgaaagaacacattttttgtctctctgctctccccaacatgagaatacaatgtgaagattgtcatcaacaaaccaggaagtgaagcctttccaaacaacagatttgctgccaccttgatcttggacttcccagcctccagcctgtgagaaaaaataatatctgtttttgaagccacctggtgctatttttgttatagtagcctgaactgactaagagagtagacaacagtggtaactctggattaaaatatacatattactggaattaagttagtgtaaatttgaagcagactgataaattgagatatatattgtaagccctattgaaacaattaagaaaataactaaaaaagtaaactaattaaaaaaagactgagctgatttttcattgtagaattcaattgttttggatgggggaaagtgatttgtaacacataattaaataattacaatctttttgaaatagtttcctcatcagtaaagtggaggtaaccctacatcctagttaggctataaagaatgatgaatataagtttggcagtagacaagttggaatttttaacctcaacttgtagctttgtgacttcaagtgcatcactaaaccttaggctgtctctttaactgtaaagagggaacaataaccatgatcatatcttaaaccattataattgaataatatagtaaaaattttgcacaatcaacgatgagtattaactatcataattggattgtgaaaatatttataaactctgaagaatttattactattggtattcattatttttccccacaagctaatctgattatttgtaaaggcaaaaatggaaaaaaacaagtccaccatataattatcacttggtttcttaacatctatgctacttttaaacaataatgtcaatatgtgaactattttaaattggtttttctatgaaaacatttgctgcttattgacatacactgtgcaataatatgcctctcacatctattatagaattaaggtctgtgtgatcaaatgtaattcaacaaatgtttattgcaccttctaagtgttagtcactatgttatgtgcttgtgatgtagaagtttaaaaacgtatgtttactagtaaaaaacattagtttttataatattttagaagaaacagcactagaattgagaaaagtaacattaggatgaaattagaattttgaaggaggttctccaggcaaagaaatggacaaggcatttcaaattgtattattaactgcctattagagagaaggtaatatgtattgaaagttttgcaacaaacatatcacttacacaataactactccatttcatagatgaatttaatgaatttgatgaggtaactacatctagtagagggtaggccaaggctcaaatctaagtttgcctgtttccaacacttgtgcatctaatcactgacatacataaataaggcaattgtcagagaagcatttcaaactttcctgaacattccaaaagggaaaggcatcgtatcataaataagaagataacaacaaagatttccaaaggaagatatgtagaaagggatacgaaaaaaaggaggaaataaaacaatagcaagtatcaaaaacaagagttgagatggggcagagtgggaaatgagagtattttagggttcaacagagaatcagaagcaataggagaatctattatctatctatctgtctatctattaatatagagaggtttatttattgtaaggcatttgcttacacaattatggaagcaaaaaaatcccataatctgcaagcttgagactgaagaagaccagtggtgcagttctgaggaccagagggccaatgatgtgagtcctagtctgagaaaatagaaagaatggtgtcccaaatcaaacagagagagtgaatcctcccttcctatcttttgttctattggacatcataaaagattagatgatggccacatacattgggaaagtcagtctgcttttcttagactactgattcaactgtttctggagattagcctgattcttagactaatctccagaaacaacctcagagatataaccaaaaacaatattcagccaaatgtctgagcaccctgcaatccagtcaagttgacacataaaattaaccatcataaagtgcaaaatttgttaaatgtctgagcttgcagatccttttagggcaacatcacagaccctgaactccaggacaaaataccctaatcaaacgaactgcccaactagtgttctgaaacacaggatgaatcatcagttcaatcatggatggctaaacctaaaaaattattccttaataataaccgtatgtctggaagaaatcaaccttctaaaaaagacaaagttgaggaactgcaaaaggaaattcaaactcctctgaaactcttaacaggcaagaaaaaatatgcagttggataaactgacattcaccaaacttaaaattttgatataaatattcatagggttcatcccttttcttctgtctagcactactagctagaagtcagaatttataaaggacagcccaatatttcccctcctgggcccacagcagacacaaaaaattcataatgaaacgttttttctttaatctgcaaaaagtctattattccttcttaataccatgttttgggcaactactcttaatcaggtaagatgcatgaaataaatttgcttgcaatactgttgctgggtgaacatcagcaagttactgatggtagtcgttctctgcaggatcatttttgcctcctgagggacatttggtaattggggacattttttactgtcttagctgaaagaggtgctgctgacatctagtaggttgaggtcagagatgatgtcaaacattctacaatgcataggaaagaccacctgaaaatatatgtatattcagttcaaactgtcaatactgctaaggttgagggcctttagagttagcctgaactcacaaaattttccgataaaaggcactttcctttcccttccaccttataagctttaattcatccttaaaaggttttggtgaagataattttctttgtaaaggagaaaacatgtaagctttggaaccaggaaaggatgattgtgcatcactacttactagccccatgtttgaccaactttgtttccttgggcgctataacaaaatacaataaaacaggtgccttagaacaacagaaatactgtctcacagttctggaggctagaagaacaaattgcaggaccatgctccctctaaaacttgtagggaaattcttccttgcctctttccagcttctgagggtttgacagcaatctttggtgttccttggcctatggatgcatcactccaatcctccatcttcacatgaccttctctctgtgtatgtctgtctctgtatccaaatttccctcttttgtaaggaaaccagttatattgaataagggcccacactagtaatgtttaactcgattaataataataattaataataatgtttaactcagaatatgtttaacttgattgactctgtaaaggccctattaaaaataaggtcacattctgtagtaatgggcatttggactttcacatcccttttttggaggcgggaacataattcaaccaaaacaccagtttgcttaatttcccaaaacttcagtttccttatatgaaaaatgcaaataatactgactgtctgtagcattaattgaaagattaaaataaatggactaagaaataaactatggaaaaccaactagtatagcagctgctgtatcacaggtgctcaaatatatatacggtcaccctgttatccagtcatatgtgtcatatatacacacacacacacacataaacacacagatttgtgtatgtgtatgtataaaactttcccttttctcccaggtatttatgtctctttggtgttcacacaaaacatgatgtatttttctttccattcgttacattatatttgaactatatatctatttatctatctggcttgctactactttgatattagaaactgttgcagtaatttttagattgatacctaactttgtttactaattaataatttacttatcaagtaaaggactaaatggaaaaatggatggatgaacatgactacagcttaccaaaaatgccctttatacctgaatttctcttagtgggtcagagtttaggtggtattcgaacgaatcaaagggatatacgtattttgcttttggtatgtgtttgtgtacattctcattattgttacttgtcagtttcctaggtttccgattgtgatctttagatttttttgactagcctacaaacttagatttttaaaatcctaatgacatctacagcagtttcccaggagctttctttcagaatatctgccaaaataatttattgctgtcttaggttatttcatcttgagcaacatgaacattccatcaagcagagggtatagggagaagtctcatcagtaaataagctggctaaaatttagacgtccatcaatctctgttaaattttatctcatataccctgagataggagagtaatataaccattttaaaataaaacttatttcttgcccatttactgtatttggaagaaaaaaatagtggataattaggaagtggataattctggaagaaaataattagtagacttactaattatttatgagggaaagaactgagaacagtaattttaaaatatatccatgttcttgaatatttccacccttaagtaactacagaggaaatggactgatttaccaccaaagattactttataataataacctacagtttgaaatttaagctccatttaggagccagaaccaattatttataatactagaatggcctgaaataatcttgtattatcctgaaaaaaaaatctgaagtgggaataagcccacacctcatttatgtgtgtaaaacaatctcagctttacatcttttaagaaaagtctgaataactgccttatttccacatttctttgcataaataaggcagtgcaaaagctttgtcagctgattaaatttatatgcaattttggtaagacattgttttctagttccacaatatatttttgtccagtccaccgaaatttgagtttgattcactcacaaagctgatcctcccaacttcatttaataaaatgtaagaagactttaaaagatatattaggaataactagttagatatggagaccgtctcatattaattatttattttatgagtgtctgctaaatatataaacaactctgctggtaattatttatgggtacccaggtggcataaaaaatgaagcagagacagaaaattagatgtagcttctaccgtagattgataaaaaccataaatgcagaactacacagactagagtggatagtattaaaaactatatgtatagtgatgtactggtaaatgtataacaacctggtttctgaggaagaaaaaatctctgctttctaacattagttgatttccatggcacaagcactcctatcatgaccagtttcaagccacaaatgtgaaatcactgaacacagatttgggaagagatggacacaactcttgaaagtcagtgtgacaaactgaaacacagcactgcttacatatagatatataaagtggatgactattttaacagatacaaaagcaaagaatctatgtgaatttttaactaaaactgaaaatattatatacctaaaagcatgttggttaaaatgatcattttgaatatctaaatctacacagtcataattatactgatgctattaaaacatggtataatggccttctgtatggaactcatattaattgtaataaatattcaattatataaaattttagagatcatctactgtatattagacattgtgctatgaacaggagttacacagatggctaggacttagtttctatttttaaattataaaaagggccaccaaatggataattccagtagataaaataataaatactaagatagaggtaagcatctgtcccgcagtacagagaagagccatttagcccagtcttgtttgggatggttttctgggaaaatgatgttgtcaaaaccaccttatgaaatgcaggctctgtcactttacagttattcctagtattgccaactacaacttcgatcccatatttgaagtgatctctgtaaattttgttaaaggtaaagcaggtccatgattttgtggggatagtaaacagaggcttaaaataagacagaacttttaggccagttatcagatctttaatggaacttaaacatattacctgacgtggacaggtagggagagccctagaggaatgctgatggattgggtaacttgtgagatccgtgtgtgagcttagtcaagtcattttctggtatgtcggtttccttatcaatggaaaaataatggtttggggtggataataataataaaatcatagctaatatctattgattgactttgatgttgttatatcccttgacatatattaattcacttagttctcacaacaatcctataaagttgatatccttctttctctttttatattagataaatctgagataattgtaagctatatacaatttcaatgttaggaaagacctgaggtagaattccaacctagttctttctgactctaatctcttagacattccctgaagtcgtttccagccttcatgttctttgaccccagaagtatcttggaatgtttccctaattgctgtgatggcaacacagcagagctagggaaatcaaagacctaggctatgccccttcatgtttgtgcattatggtgaatgagctctgaaagtgccagggaattttgccaccaagtcttcacattaacttttcagcaatattcctcagtttaggagggaggcctatccactccttgtcctttgaaaagtgatcatttgcttgattgctctcaacagaagtcttcccatagcctctgatattttcttttcatttcttctgagttgtttatttttaattacttaacatttttgacgataccttttccgaatgcatctcaaacttagggctaaaaagccaaatgcttcaactttgttttcccatctcttaggcaaacagccaaaataagttccatagttgagcgaggtttttccataactctggaattatacaagtagttcccatttcagggcgtggttgccatccttttctacatttcttagcatggctaaattctctttattctttatggtttagacgatcccctgagaaggtcccaaaatgccgtgtgttaactttatatgctgcttttctctttctggcttaggctgcagactgcctaagggcagagaaaagtttttttgttttttttttgtttgtttgtttttttaatgagtttatcttttgaacctgatgcaatgccagtataacttagggtggaagaacttgggatctgtagttaggatgtctaggtttaaatcttacctttgctacttaatagtcatgtggacttgggaacatttaaaaatttcccccagactcacattctatctgggaagagaagatccaacaacttacttcaaaaggcttttgtgaggattaagtggtccatgtaaagcacttggcatggtatctagcacatactgagtattcaaaaaccattatattgttattaggtactcaaatgttaaatgaagagtaagaaaatgaatgtacttattcattcagaaaatatttattggtgctagacccatttctaagacctggaagggtagcagagagcacatccaagttgctccctggtttttctagagcttacattctctcaaagggagaaagacaccaaacagaaaaataaatatgtgtgaaaataaagcagagaggccgggtgcagtagttcacgcctgtaatctcagcactttgggaggccgaagcaggcggatcatgaggtctggatttccaggccagcctggccaatgtgaaaccctgtctctactaaaaatacaaaaattagccaggcatggtggtatgcgcctgtggtaccagctactagggaggttgaggcagaagaatcgcttgaatccaggaggcggaggttgcagttagccgagatcgtgccactgcactccagcctgggcgacagaccaagactccatctcaaaaaaaaaaaaaaaaaaaaaaaaaaaaagcaaagaaaaggaaagaaaagaaagcagagtaagaggacaagcaacagcaggggaaatgttactttagataaggtagccagagatagactcctgtttatgataatatttatttgtgcacctgagtgaaaagagggatagatctgtaattctgtgggttggggcaggggcgaagcaaatgcgaaggccctgaggctagagggtttctgtcatcatcaaagaaaagcaagagaaaggactgatttggtagaagaggagatatgagaggatgtttaagagggagaatgttaggagaagagggtgagcatcaaagtgtgacacatttttaaactagtacaactgctatggaaaacagtatggagatttctcaaagaactaaaaatagaattaccatttgattcagcaatcccactactggctatctgcccaagggaaaagaattcattataccacaaagatgcctgctcgcatatgtttatcacagcattattcacaatagaaacaatatggaatcaacctaagtgtctatcaagagatgattggataaagaaaatgtggcatatatacacaatggaatactattcagccattaaaaagaacaaatcatgtcttttgcagcaatgaggatggaacaggaggccattatcttaagtaaaacaaatcagacacagaaatacaaattcaacattctcacttacaagtaggaactaaaataacatgtttgcatgaatgtagaatgtgtaatgatggataatagagattaggaagattgagtagtggagaggagcacagattatgagcaattacttaataggtacaacgtacattatttgggtgatgaacaccctaaaagatctgactttaccgctgtgcaatttagggatataacaaaattatacttgcattccatatatttattaaaaaagatgtgacagatttttagggattgttggccaagtaaaaactatagatttcatgctgagtgagatggaaggaatttcagggtttggaatagcattatgaaacgaattgaagatgctctcattgagaatgaaataaatgattaaagggtctcgagatagattcagataagtaagggtatagtagccaactgatgaagaggatgcattaaaaagataacattcggggaagggcagagagttgacaaatgaggtgttaagaagtaaaactagactgacctcacaaaagagaaaattaagacaaaggcattgtgatttatgcataattgtcaatttgtatgtgtacatatatgggtccacttgtcaagctttcattgcctacagctcttttgactatttattttccttcaggagcccatactttaaaaacattttctcaaccaaagataatttatttataattaattcatgccatcatattttttcaaagccataagtaacctcaatctcaacttccaatgggtgacagcaaaccaatgtcatcctctcctggagtcaccattctagccaagagcaaatgaacctatgatttccatcaacctgtactgccttattgcaattaatatattctatcccttagtttcttttaaacactggaaatagctttagcttgtatactcccttttctttttcggtggaatcccaggagtctctgaaccataagtgtggtattcaaattactcatgtaaacctacagatacaatgtgtatcttacataaccattatatacatattccatcctatatgtgcatgtattacacacaatgcattttatctctagaatatatgtatatattgtgtatatagtgctttcaaataaggtcatattcacaggtttacacagttagaatgtgtacttatcattgtagggaataccattcaattcaccgcagaggtatttattggaaaaatgtgtattggaaaggagaactatcaggctgcattatttgttaaccatctaagattattatgttaatataaaagatctcataaacagaagctcttattacctagtcaatagttgttttatttcttattgatatatgattatgctgccgaattgtgaatttaatttggggcatgaatgtgtcatacatcttcatccaatcagaagattcagttcagatgtgtctatataatatatgtgtttatctttcagaaactttgtaagtaaagaatattacccttacagataagtcactctcactggagagaagatcgtgaggtagggaagaatgtggaaattaacatctctgagtacatgttcccaacgatagggccatattgatgaggggtcggaaagcaggagcctgccaaagagcaaaagataggcccgtgtggacaagaggttactttattatttatttattcattaattcattcatttattcatttacttattttgagacggagtcttgctctgtcacccagactggagtgcagtggtgcaatttcagctcactgcagcctctgcctcccgggttcaagtgattctcgtgtcagcctcccgagtagctggaattatgggtgcccatcattacacctggctaatttttgtatttttagtagagacggggtttcgccaggtttgtcaggctggtctggaattcctgacctcaagtaatctgtctgcctcggcctcccaaagtgttgggattacatgcatgagccaccatgcctggacaaggttactttattaaacggggtaggacctcttattagattggttcacctggaggatggtcttagtgatacctgactttgagtctctttcagtctctctgcaaagctcattttgaaagacatttctgagtctcctactaaatgccagacactgagatgagcaaatgaacaaaataaaagtctctgactctagagaacatcaaccccggagtgtggcaaggcaggaggcagtggtgggggacaaggaagagaaacatatgcattctctacattcaaatcttattatactttaatattttagagaataaaacaggaggggaagtcagaacaaataaaggacaagatctgaaaactgttaaggactttaaaattatattcaaatttatttaagtacccttaaatttacttagtgtataacagaagagaaagctgagttatattggttaccttctgttttgtaaacgcaaattaattttacagtgtctctcttagccagataaaaccattgatatttattgacaagtaaatcaaaagcatttatggttactggcttcttaatttcatctactcttgtttctgtcactggggagttttcagcacttatattggtctattttgatgaaagactcacaacagagggcaactaaaacaagagtgttcctcaagtgatttttctaggatgtaagacatagattattactttattagccctccccaaattttgaggacattcgtacataaatctgagagttattttcatgagattatctcaccagatggcttacttaaatatttgtaccattgtagaagtaattacttcatctgggagaaaaaaaaaagttcaaaagccctggattatttttgtctgttttcatttgtttcatttctattttactttctagacaggagtaaacttacatttctatgataaatagatgttggtaaggttttggaaaatacatatatgtcaaaatataggaaattctctgtgtcagaaataaccacaattatggtgtaatgaatgcaatactcaacagagagttggaaaataaggcataaattttgagttttagtaaatatgagctatgtaaccttgtgcaagtcacttaatcttactaacatcatattcatctgctaaaaattgagtaaataatggaaactccattgagccattatatgaattaaaacataatgccacatttgaaagtgctaaggaatccacgccagaaaaggctaattaaggagttaatcaattaccattatcaattttttaaatactaaataattactagtttgaacatctagtactgctagtaacaggttatattttgcctagctatttgaagcagttaaaaagagttcctttgaggatttgaggcagtttggctaacagggaaagaatcctggcctggaagcagatacccaagttcaatttctcggtgttctatttgcctgaagtgacaccttgggtagattatttgacttttcagggccacatgtcctcatctatataatgaggatggttatgaaaaataaattactacttgtaaagtacttagaggcttgtctggaatgttatgtcagccctgtggatgttagctagtagcgatcatcactgagttttcctgaaagccttccaacagctgggaggccacagctggccacactctagtgtcccacagagggaccacaggagtctcctcctcttgccttccatgcccccactctgtccaaaactgctagtagtgccacacaaggacatagaaactgagagcaagactgagagaataagactaagagagagagaattctgaaaatagaacaaaatgctattttatcaaaacagagcagagtttggaaggcttctagtgctctatcttctcactaaatatttgtatgactttaaaatgtcacaatttctctgcagcagtatttactcatgcgaatattagaaattattataattacatggaacatttgtttagggttttaccatttacaaggtgggagagcagaataacttaatcgtgaacaccagagctttggaatcaagcaggattagatcccaggtttgttgtttactagctggtcaagtcatttaacttctctatgcctcagtgttttaatttgaaaactagtaattcagaaatgttcctcagaattattaaagatttaaataaaattgtttattctcatatatatatttatagaatctcatagcagaaaatttggcagtggtgatgcacataaatggtagctttaaaaacaattttttctgtctgttgtatgtaatttatataatttgcgtgtaatcccaccatgattagaaaaaatattatctgaggagactaaatgcagcataagtcaattttggagaaagtggttataaaacaattccacagaaaacatgggaatatgccctaaaatattgactatggttattaaaatgagggaaaatatgaggcaatatttcttatctatacttatccatattttagcattccatacaaacatcatgttttccatatttgagaaaattatatgtgccatgaaaatacttgtcaactttgtccatcttgcaaacctactctcccctgtcttctacctaggaactgtaataggaggtattgctcctaaaaatctatgatcgcatgatatattttgaaaataatggtcataattcaccatattttcttacatgatggaaaaaatttgttagtctcttttctagtaatatgaataaaaatgatcatcttgggtttggtaagtagtgactgcatgcttactaccatccctgctaggagtttctttcctctgcaccacctctttcacatatagcccccagaatatatctttctaaacccagattcggtaactatctttccacaagcttaaaaatgactgctcaaagcataaaaataagaggctattttttgcctgttttaaaaagtagtatggccttaagttctattttcagcttcttatcctattataccttattttaacaaagtatctcattttctaggtatattggaatacagtcttcaagtttggggtcattttctctctctgactgacatgaattatgatttcctcattattcgactgtgaaaatccttttaatatctcagttcaacctaaaacttcaccaaaagcagatattaaactgtttgttcagatttcagaatgcccagtgaatgagtcacatttacaaagtgtgagtttacctatatgcatatggtggtcccttctctccatactgcaaggaaacctgttattctagcattcttagttgccttatattagtactctgatggtcagaaaccctaatcactttgaacttggcagcctgttagtggtaagacttggactttgaggccgaagtcctttcttggagacgttgagtccaaatttatatattgtacttgaatccagatttttcaaaacgtttaattggcagttacaggcaatgccccaactaaaattaaagtggaacttacatttctcatttgtccttgttccttgagtatattattgccttggaaaccttgtgggaaatagatgatttataaagcatggttctattaatcttgggtttctctagccaaacaacatttaacagcaatctaaaacttatcgtacatgtagtatattagcaaaattgccatcctgttcttactcatatacttcctcgctcaaagtggctggtgtctaaggtaaaaagtgtctccagactcgttcatattattcttttctactttccactgccaaggtaaatcaatggccagactacactgccatcccttttttttctgaatttttgtctacttttttttttttcactctgaatctcatgcttctttttaataaagcaggatgttcccaaactcttcatcctcaccagtacacacacacacacacacacacacacattttctattttcatctctagcttgtttccgtgatggcacttataacttaaatttgcttatttctatgtttgcttgttgtttcttggccatcctcactggtatctccaagatgcagagggtgtgcctttcttactcatctctataaccccagttaccatagcagtgtctagcacaaatgagaaacacaataataacaaattcattctcatctaatattaatgcccaaagctctggaacatgaagcccacctactgcaataatagtcattttggggacaaatacgatttttcctgctacttgtgtttttcctctagagattatgagtatatacttttttaaattatggtaaaatacatataatcaacttttccatctgaaccattttaagggtaaaattcagtggcatcatacatattcacagtgctaagtaactatcagcactatttccaaaatcacttcacctcagatggaaactccatccccactaagcaatcactccccagttcccacttccccagtccctggtagtctttactctactttctacctccatcaacgtatctattccagatatttcatataattgaaatcatacaatatttgtcttcttgtatctagtttattttttcagtctagtgttttcagggtttatccgtgttgtggcatgtatcagacttcattccttcttaaggctaaatatgccattgtatgaatatacaggacaacattttgttcatctatttatctactgatgaacaccaagtttatttggctatcataagtaatgtttttatgaacattgatatgcaaatatttgtttgagtttctgttctcaatacttctttgagaacctaggagttctcaaatacctaggagtggaatttttgtttcatatgtaaactctacatttaactgtttgtggaaccaccaaatggtttccacagcagttacatcattttacattgtgatgggtatagttttgattggctttctttctttagctgaggctgtgaagagggagtgaattagacaaaaacctgaacaattctcaaacatatatgtttagactatatatgtctaagattgtcaaatggttagacaaagaggaatatcctatatggtttgaatcagcagcacttttaagcaagaacatgataaaccatacatttaaaatgtatttcaagcaagaatccagtaggtgaaatgtctattcacgtcaatatatagccatagaaatgggctcaatacttaaaaacacacaatgtagaacgtattttttttttgtttcagataaagtcctaaaatatgcaacccaaaatccaagaaatattttaaaattgctggtctctatcccttttcagtagctagagaatgggaacaaaaacaaatccaaagttctcctgaattttaaggtttaaatcttttattgaaatgctctaaaataacaagcgaatgcgtccagtcatgtttggaaaaaaaatgttgctttgtaaataagaatatattttttcctagtcacttcttgatttttccatgcaagtcacgtgttcccaaaagatgaaaaagattaaatatttaccatagaacatctaaaaacaataaaaaaagggactagtccccactgtatataaagctctgctccaggcagaaggataactagttggagtctctgggcactcataagagaacagattcatttttaacaagtccttcgcctacacagaactgtaattgcatagcttgtgtggtgtctgtatctttatcattttctatttattcatctatcctgtgtttcctgttcatttcctgtgaaaaatgaataattaaataagctaacaaattaaacaaatttaacaaattaaaacaaacaaatgagaaagcatatagattttttgtactcaacagtgacactttccctcactgttggaatactctaaacacctttctatccatatgatgggtagtatatttaattcgtgtaccacccaggtagcatagtgtatagaaaacagcattagggttcacagactttgtttttatcctggctctacttctaataagctgtttgactttgaatatgtcactaaacctctttaggctatgtttccttattcgtaaattgagcaagttgaaccagatcactggtttacacattgtgttgcctcagaagctaaaattggagatgagggggaagtaaattagtagggctctgtgctcactgtgcttactttaaatacagtggttttactttcatttgccttatgcatttggcatctgtgcacagttttatttgggaagaagaaaaagtccctcttttggaaatggtggtggggaacctagaaatatgaactagtcagtaacaattctttgctacccaagtacgaaattttttattgtcttaatatacaaccagtaaaaataacagcatctaaccagttggggtgttgatgagaagtcacaaataagtattgtacaatactgtaagtattggcgaagttcagaggaacgtgtatctgtataacttcctaaaatgaccaaatgaagagtattagagcattcaaaaattgagattgtgaagcaggagtattgcttcaaaaataacattgttatttttcaataggtattccgcatcaagataatacatttttaaaaatgtacatactttggtataactaaaataatgataatgcaacatttttcaatttactgccatcaaacaaattgatgtttgttactttcttaaaggggctgacttatcctaaggaactttattctctcatatttcatggaaataacattagactagaaaacaaggctctcatctggtcttggcttcctaaagtgcacaggtaaaggcttgcatttgccctctatgcatttgatttgctctctctttctctgcattgtcacacttttgccatggagatcattatatactgtgtatgtatatgcatgcatgtgtatgtgttggtgggaggggggagggctcaggctaacctgtccataatgaagaataatatctcagttcataagtttttaaaaaatgtcagatttctccatcttcagagttgaaagcatccataatagtcattttgtccaacatccttgttaatgttcaatctttctatagtatctcttaaagattttccagtaatagaaactatattccattatgaaacagctgaacttattttaaaacaaacaaacaaaagcacttgataaaattccattccttggatgtgagttttactctcttaagacacagactattctttacctattgacctgttgtcctcatgccagtcccttaaatgcctgatggaggctgacatgttcccaggtctacatacatgagcatggaacttgggattgcaaatttgagtagcaatatgcttgattcaatcctccctgttgctattttaatattcttaataacttttgaacaaatgctccctgatttttattttgcagtgggccttgcaaattatgtagccagttatgcataatccttaaatcatctatcctcaagcttaataaccccagttcctacagtatctgttcatgatcattggtattaaataggtttgtttgtcaatgaccatgttagaaggtaatggccagaattgagcacagtgctctaggtgtggtctgatcagtgagaaaatcagaggcatgattatatcccatggtgatatctcctgtgcctctctattctcacccgctcaagatccagtctctcgacaattctctgccctgctctgagcccaagaaggcaaactcatgcagagggtagcagttgagatcccttcctgtctggcatccagctgggttaatggaaggcaataggggatggcaatgtagaagagagaattcagggtatttccttcccctcccctgtctcagagctgcatccctctctgtggtaaaaactgcatccctctctgatgagaattcctactggttggtccctcttttacagttccatatcttctttttttttccttctctctctctcttttttttttttttttttaggtggagtcgtgctttgtcacccaggctggagtgcagtggcacagtctcggctcactccaacctctgcctcccaggttcaagcaatcctcctgcctcagcttcccaaatacatgagattaccagcatgtgctcccatgccaggctaatttttgtatttttagtagatatgggatatcaccatgttggccaggctggtctcgaactcctgacttcaagtgttttacatacctcggcctcccaaagtgctagaattacaggtgtgagccatgtggcctacagttccatatctcactggtcacacaatactgttttctctccttgttccttcagccctagtgggtattaatggtttcctgctgcttctgctcctttaatcctgatcacataccatatgcattcctttcgtagaaccatcttcatttgaatcatatggggtaaattctgtaccttgccaatgctctgataaatcactcagcatgttggtgtcatatgtctcttaatgtctccagttagcatacattttggacatttctctagaaggatgaagttgacattctttgcttcactgagtcactgatctagggtctccttccacacttccaatcaccttctgaagagtgacagagggtgctcaaatttctatctttgagacatcatgcttccagaatataattaattcaaaaatatgaagaaatagttcctacacatcaagcattctctctcccaagaactggagatatagtagtgaccaatcacatcaagttctctatcctaatggagtttagtgagattcttgtgagagatcaaagatataaaccagaggcctctaagaagctaaataacatgactggcctaatttagaagttttactctggttgctgtattcagaatacactgccagaatccaggagaggcagcaagaacagttagaataatacaagtgaggagacatggcagcttggactaaggcagtggcagcaggtggtaaggttattctgtgactcagcacacatccttgctgccctgtttctctgttccattgaatcccaaggtaggatccatatcttatcctgtactttaccagcttactacaaacaatttgtgaataactgcatagtgaattaaaggtcaacaatatccactttactttcaaggaaaataattttcctttttcttagcaatcataataggtatttttcttcttttctcaaacgtaaagaaaaatgttgtaatattcctggggactatgaaagaaattaaaagtcaaatgaaagtgctcattgaattattcatagaaaattatctaaaatgaaatgaaaaaggggattatcatcttcaatttgcctcaatattcaggtatgggtaagaaaatactcagaaaattaaggtttccttaacaagatttttaatggttttgttagtaacttttacaaaaacaaaaaggtcacattttccagaagatggaataatcaataactatactattttgagcactaggtttgactacttctgcctactctttgtagaataaaaaaaaatctaatttttagttatactgagagcaagagaaattcagtgaaggaggaggacagagaggaggaggaggagaaaagaaaacatcaataaatatactatgaagtagtaccccagaaataaagctgcccgatagagctttcctaatgtaacaagattggtggtttataaaacaaaatgcaaccatcttttgttgttgaattgtaagactttttttaatgtgcggcataagtttgattcaaaaaccagtgatatcgaggtcatattagaataaattagtggagagctgaaatgtaattaattgaaaataaggggaaggggataagttcttgctcccttgccccattatggagagtatctgtttctattacagctgttgtagctatccaagactaaattcaattttcttgcaaaggtcatatattctctcattatctaatcaaaaatatattattaatatataatgcattaattaatttaaaattccattaatacttatgtgacaggcttttggacctggatcttcaacagttatttgacaatccatttcttcagttcttaggaaataatctgacaatatgtatgggctgcaaacaggtttctttggaggatcttcaaagcaccactaccaacatcttctaacttcatatctgccagtcaggaagaggcttgataactagaggttttgttgtgcagacattatgttccttaagaacagttttttagtctcatggttgtctacaaaactgaaggccgaatagtcttttatcttctgaagaaaatgaagtttttacttaagtaaagaaaacaaaaactaccacagaatagtcaaacaatcctgaaaggctatggtcacaataaatttcttataagataagataataataagataaatttgagaattaggtaaataatggctgtgccatttattcttcttaattattcatttggtaggaggagaaacaagatggctgaagagaagcatccagcaattgttccccttgcaggaacaccaaattgaacaactgtctacataagaaagcatcttcataaccaaaaatcaagctagcaattacagtgtatgcctttaacctcatatcaaggaaatagatatgaaagaaggtaggaaagacagtctttacttgcgtacaccacccctcccccatcccccagttcatcacaaggcagtaggacagagaatctgtatgcttggtagaaggagagtgcattgattttgagacttcacattataactcagttctgacttgtcacaggggaaagtaatgcaaggcagaattcagccagcctccaaggaggaaggatttagaccagctctagtcaaagggaaatagcacatctgaggagtaagaacctgagccatggctagcaccaccaccatgagttaaattgccctgagatcctaaataaactagaaaggctgcctagaccacaaggactgtaattcctgggcagtcttggtgctttgctgggcttggagccagtggacttggggtgcatgtaactcagtaagaaaccagctggagcagcaaagggagtgtcatccctcccccaactctggcaacacagctcacaattctgggagaattcctccagcttgaggaaaagagagagaaaagagaactttgtcttgcaacttcggtaacagctcagccgtagtacaataaagcacaaatctaatccataaagaccccaatactaggacatagctcccagatgacatttctagactcaccctgggccagaagggaacctgcagccctgaaatgaaagacctaggcgtggcaggattcagcacctctgactaaagagcccttgagcattgaatatacagcagccatagccagacactagtcaccataggccttgggcaagacccagtactgtgctagcctcagctgtgaccaagaagagtcccagcaatggtagtcacaggagggcttgtgacaccccttctccaacttcaggcagctcagtacgaagagacatagagacactgcttgggagaaagtaagtaaagagaacaagactttacctgctaatactgggaattctcttgtatcttactgaagatcaccaaggtggcacctgtatgagtcagcaagacttaaagtgttactgggcttggggtgccccctaatgcacacagtgaccaaagatttagaacaacattcaattccctttaaatacctggaaagccctatcaagaattataggtataaataagctcagactgcaatgattagaataaactagtttttcaatgtccagacattgacaaacatccaaaagtattaagaccatctaggaaaacatgactttgccaaactaaataaggcaccaatgagcaatcccagagtgacagagatatgtgacctttcagataactcaaaatagctgttttgaagaaacgcaatgaaattcaggacattacagagaagaaattcagaattccatcagataattttaacaaagagattaaaataatcttaaaaactcaagcagaaattctggaacagccctattaactgacaaacagaaaaatgcatcagagtctctcaagagcagaatggatgaaggagaagaaaggatttgtgtgcttgaacaggctatttgaaaacacacagacagaggaaagcaataacaaaaaaaatgaagcatgcctacaagatttataaaatagcatgaaaagggaaaatctaagagttattggccttaaataggagacagaaagagagattggggtagaaagcatattgaaaaaaataacagagaactttccaaacctatagaaatatatcaatatttaagtacaacaaggttatagaacacaagcagacttaacccaaataagactaactcaggagatttaataagcaaactcccaaacatcaaaaataaagaaaggatcataaaggcagcaagaaaaaaagaaacaacatacaaaggagcaccaatacatctggcagcagacttaaagtcttgaccttacacaccaggagagagtggcatgacctatctaaaatgctgaaggaaaaaaaaaaaacaaaaacaaaccaaacaaacaaacaaaaaaatcttttatccaagaatagtatatccagtgaaaatatcctgcagacatgaaggagaaataaaaaaattcccctggcaaagaaatatacctaatgctagatgacaagttagtgggtgcagcgcaccagcatggcacatgtatacatatgtaactaacctgcacattgtgcacatgtaccctaaaacttaaagtataataataataaataaattaatttaaaaaaaaacctgagggatttcatccataccagatctttcctaaagaaagtttttaatctgaaagaaaaggacattaaggagcaataagaaatcatttgaaagtacaaaactgactggaaataagtacacagacaaatataaaatactgtaactgtaattgtggtgtgtaaactactcatatcttgagtaggaagactaaaagacaaatttatctgaaataataactccaacaacttttaaagacatacatagtataagaagatataaatagaaacaacaaaaagttaaagagcaagaagtatgaagttaaatgtagagtttttattagtttttctttgtttttgcaatcagagttaagtagtcatcaatttaaagtaatgagttatgttatttgcaagcctcatggtaacctcaaatcaaaaaacctaaaaaatataaaaacacacacacacaaaataaaaatcaaaaaattaaaacataccaccagagaaaaacactttcacaaaaagtaagacaggaaggacagaaggaagagaagactccaagacaaccagagaacaaataacaaagtggtagtagtaagtccttatttatcaataataacattaaatataataggctaaacactccaataaaaaaaatagagtggctgaatgcattaaaactaaactcaacaatatgctgccttcaagaaacacacctcacctataaagacatacactgaaaaaaaaaaagatggaaaaagatatcccacaccaatggcattcgaagaacagcaggagtagctatatatatatatatatatcggataaaatagattttaagacaataactacaaaaagaggcaaagaaagtcattatatattgataaaggggtcaattcagcaagtggatataacaattttaaatatatatgcgcctaacactagagaacacagatatataaaacaaacgttataagagctaaagagagtgatagatcccaatataataatagttggaggcttcaccatcccacttgcaggattggacagattatccagacaggaaatcaataaagaaatatcagacttaataggcactatagatcaaatggatctaatagatatttacagaatattttatttaacaactgcagaatatacattcttttcctcagcacatacatcatgctcaaggatagactatatgttaggccacaaaacaagactcacaaaattaaaagaaaatgagatcatatcaagtgttttctcagagaacaacagaataatattaaatagcaataacaagaggtactttggaaactataaaaacacgtggaaattaaacaaaatgttcctgaatgaccagtgggcccatgaataaattaaaacaaaagttttaaaaattcatgaagccaatgaaaatgaaaatgcaaaatcccaaaatctatgggatacagagaaagcaatgttaagaggaaagtttataccaataagtgcctacattaaaaaggcatataaattttagataaaaaacctaataacacatcttaaataactagaaaaataagggcaaggcacactcaaacttggtagaaaaaaagaaataatccacatcagagcagaagtaaatgaaattgaaacaggggaaaatacaaaacatcaatgaaatgaaaagatggttttctgaaaggataaaaaaatcaacaaacctttagccagactaaaaacaaaagagagaagatcaaaattttaaaatcagatgaaaaaggtgatattacaactgataccacagaaatccaaaggatcattgtagactactatgagcaactatatgccaataaattggaaaacctagaggaaacaggtaaattcctagacacatacaaattaccagtatcaaatgatgaagaaatctaaaacctaaatagaccaataacaagtaagaagattaaagtcataagaaaaattctcccagccaaaaaaaaaaaaaaaccaaaaaaaaaaaaacctcagggcccactggatttattgctaaattctaccaaacacttatgaggaactaatacaaatactactcaaagtgttccaatatatagaggaggagggaatatttccaaactcattggaagtactactaattctatgaggccagtaatatcctgataccaaaacaggacgaagacacatcaaaaaaacaaaaatgcaggacaatatctctgataaacatagaggcaaaaatcctcaacaaaatactagcaaaccaaattcaccaatgcattaaaaacatcattcattttactttaagttctgggatacatgtgccatgccagtttgttacacagatatacatgtgccatggtggtttgctgcacctatcaacccttgttctctgagagcccagtgacaatacctgcctcacctcacattacccaatggaaaataggaacaaatctactttgacaggaaaagtgctacataagtgtatggcattcttattttttaaaaacatatatgtgcaggttataatggctttcaaagctggcctccttataagtgaatgagatatcagcaaattaatagaatctattgtaccctcagtcctgaaaatatcttaatattccacacttaaaagaccactgcgtttttttttaataaagtgaaatctcactgtgttaaaaatagtgtgattaaaaacaatattgttaaaaaaaatcattcaccatgaccaagtggaatttatcccagggatacaaggatggttcaacatacacaaatcaatcaatgtgatacatcatatcaacagaatgaaggataaaacaatatgatcatcttaatcaatgctgaaaaggcatttgataaaattcagcattcttttatggtaaaaatcttcaaaatactgggcttaggccaggcgcagtggctcatgcctgtaatcctagcactttgggaggccgaggcggacagatcacaaggttaggagattgagaccatcctggctaacacggtgaaaccccgtctctagtaaaaaacaacaacaaaaaaaattagctgggcatggtggcgggcacctgtagtcccagctactctggaggctatggcaggagaatggtgggaacccgggaggctgagcttgcagtgagctgagatcatgccactgcactccagcctgggagacagagtgagactccatttaaaaaaaaaaatactgggcttagaaggaacataacaacaactgaaagccttggatctaagatttggaacaagataaggatgcctactgtccctactgttattcagcataattctggaagtcctagtaagagccatcaatagaaagaagtaaatggcttctaaattgtaaaagaaaaaatcaaattatctgcatttgtagatgataacttatatttagaaactcctaatgatgccatcaaaaaccttttagaataaattcagtaaagtttcagaataccaaataaaaatacaaaaaaaaccgtatttctatatgccaacagtgaaaaatatgaaaaagaaatcaagaaagtaatcccatttacattagctacaaataaaataaaatcccaaggaaaaaaccaaaaaagtgaaagatctctacaatgaaaactaaaaagcattgatgcaagatattgaagatgatacaaaaaaggtgaaaatattttatatttatggattggaagatttaacattgttaaaatgcccataacacccaaagcaatctgcgattcaaagaaatttctatcaaaataccatttaccttctcacataagtagaaaaagtattctaaaatttatgtggaaccacaaaagactcagaacagccaacgctatcctgagcaaaaggaacaaaactggaggaatgacattacctccagttatactacagagctataataaacaaaacagcatggtgatggcacaaaaacagacacatagaccaatgtaacaaaatagataacacagaaataaatccatatatcaacagtgaactcatttttgactaaagagtcaagaaaatacattagggaaaggacagtctctacaattaatggtgtttggaaaactgggtatccatatgcagaagaataaaactatactcttttcttgccgtatacaaaaatcaaatcaaaatggattcaagactgaaatctgagaccttaagctacaaaactactaaaagaaaacatctgggaaaggctctaaggcatgagtttgggcaaatatttattgagtaacacccaacaactacaagcaaccaaagcaaacatggacaaaggggatcatatcaagttaaaaatctccttcacagcaaaggaaatgatcaacaaagtgaagagacaacccatagaatgggaaaaatgttagcaaactctacatctgacaagggattaataaccagaatatataagaagctcaagcaactcaatggtaaaaaatctgataatccagtttaaaatgggcaaaatatctgaatacacattcctcaaaagaagttatacaaatggcaaatgagtaaatgaaaggtttctcaatatcattgatcatcagagaaatgtgaatcaaaactacaatatgatttcatctcacccatttaaaatggctcttatccaaaagacaggaaataacaaatgctggcaagtatataaaagactgggaatataaattactaccaccactatggagaacagtgtggagggtcctcagaaaactacaagtaaaaccaccatatgattcagaaattttactggtatgtacccaaaaggaaggaaaacagtacattgaagagatacctagactcccatgtttactgcaacattattgaaaataaccaagatttgtaagcaaaccgaagtgttcatcagtagatgaatggataaggcaaatgtagcgcatatacacaagatagcactattcaggcataaaaaaatgagaccctgtcatgttcaacagcgtggatggaactggaagacattatgttaagtgaaataagccaagcacagaaagacaaactcatgttctcactcatttgcaggggcaaaaaattgaaataattgaattcatagagtagacagtagaatgatggttaccagaagctgggaagtgtagtggggagtagaggaaaaggggggtggttaataagtccaaaaatatagttagatagaatgaataatatctagtatttgatagcatagcagggtgactacactcaacaatttattgtacatttttaaataacaaaaagagtatagttggaatgcccataacaccaagaaaggataaatgcctgaggtgatgaatatctcatttactctgatttgattattatgcattgtatccatgtatcaaaatatctcatgtaccccatgaatatatatattcgtatacctgaatatatatattcatatatattcgtatttatgtgagtatacatatgaatatatattcacatacatattaatatatatacctactatatacccataaaaattaaaataaaaaaattaaagggaaaaataaataaatactaaaaatgggcaaaaggtctgaatagacgtttttctaaggaagacatacaaattgtcaacagacacatgacaagatgtttaatgtcactaatcatcagggaaatgaaaatcaaagccacagtgagatatcacctcacacctgttagtatagctataatcaaaaaaaaaaaataagaaataatcattgttagccagggtgtggagaataggtaactcatgtacactgtttctgagaatgtaaattggtacaaccattttggaaaatagtttggagcttccttaaaattttaaaatataactactataaaaccagcaatacctctgctaggtatctatgtaaaggaaatgaagtcagcaccttgtagaaagatctacattcccatgtttattgcagcatcatgcacagtaacaaaggtatgaaaacaactcaagtgtccatcagtggataaataaattgttattttatatatacatacaaatgaatactattcagccttgaaaaagaaggcaatcctgccatttgcaacaatataatgaatctgaaagacattatactaagtcaaataagccagacacaggaaaatagatactgcatgatctcacttacatgtcgattgtaagaaatagtcaaatatatggaaacagaaagtagaacactagttaccagggacacagaggaagagaaaatggggagatgtaagtcaaaaatgtacaaacttgcagctacgtaaaatgaataagtttagatatctaatattataatgtacagcattataatattattaactacagttaataatattgtattatataattaaatttgctaagaaagtagattttaggaactctcaccacacataagtcacctatggaaagtgatgggtatactaatttgcttatctatagtaagcatttcactatgtatatgtttatcaaaatatcattttgtatatattaactatacacaataaaaataaatttaaaaaaatcattttgggggagggaagctgtaaatatctcacagatgttttacttcagctaggaaaaaacctgaagagttataaggatcatgtgtttttattaaaattatgtagttatatataactacacgtgttgttgaaacatagatagataccaaagcaaagaaatgatcgattggcctcaagatagacaggaaggatttaattagctcaacagtgtcatgatttaaataaaaataataatgataaaataactgacacttataaaatggccactgtgtctctatgtgattttagtgcccaagaaaagagctattactctttcagagttgaggaaaagatcagagatactgactactttttgctgctttatttttttccttttccttagaaactagcttcatctcccaaagtcccacctcatcctctgcctttactttgtactatgcttggccccattagcaacttaattgctgacccgtcatgtatttctctctgatatttgacatatcacatccttacaacataaccttattcaccatcaggggttcctaatccaaatttcaaggcatagataatagtttactgagtcaattgtaatgtattacacgggtttaaacacttacctaaaaatcaaaaagcacctcaagagtgttctaagatgtggcactggccgggtgctggggtggctcatgcccataatcccagcaatttggaaggctgaagcaagcagatcacttgaggccaagagttgaagaccagcctggccaagatgacaaaaccacaactctactaaaaatacaaaaattacctgggtgtggtacatgcctgtaatcctagctcctctggaggctgaggcatgagaatagcttgaacctgaaaggcagaggttacagtgagccgagattgtgccactgcacgctagactgggtgacagagcaacactcagtctcaaaaaaaataaaaaagtgaggcacatttcttcttttcctgcccattaaaactttcccttttactatatctggaggcagctaggtacactcttaaaggagccaggattaaatcaagcacatgaaatccaaattctggtcctgtaaatacaaatgtccagccactgattgaccagctattatatgcacaacactatgttaggtgcctcctgcaccttttcccatttgattccctaaactctcaatgaatacattacttctgtgtcttacagataaggtcacaagcagcagtctgcagagcccatattcaaaaccaaatccttctaaaatcaaaaaccaggctgactcccctggatgctattctaaagtcaaatttcaaattatactttgttttctacagtgtgagttgtgaaaagtagtacaaattcactgtgattaccactagcatgttgaaagataacattttatgggtaaaataagtacttattgctttaaaatgatagccacagatatcatccaggcattaagtttatatctacagagagtgttcatacaaaacttacgtatatatctactgatggtgttcatataaaacttgacctttccatccattcagtctttatctcttcacatatacctttgtatttgcttaaagactactttgtctatttagcaactcaacttttggttcattggagctagaattttcacctgtatctctacaaatctatattaattttatttcaaaatgactgtttttgatttgttttcccagatcttacagtatgctccattggaactagacttctaaatcatagagaaatctatttcttaaatgacatcaatctaagatccaccaaaatgttaaccctatgagggcagttctgtgttctgttcattgtttatcgcacacctagaatggctctttacatctatgggagctactcagcaaatacttgttcaatgattgagtgaatctagtccatctattttgactacataaattaattatttgataattatatttcaactatttaactaacagttaaatatttacatttcaactatttacatgtttgaactattcacaggaaaatgctatgaccaatttcttttcttgtagcctttcttttcaggagactaaaacttcaatgcatgcaatgctaatttgttgtcagcctcatgacatcttaaataaagaaaaccctctttatcctggggtggtttggatgaacttagcggaatgctcaaaaactaaaggtgaaccaaaaagaaggaagtcaatatagttcaggaagctccctcctcctgttggccttatttcgattcttctagggctatttacacgtagccaaataccccagaatttaaaattaaagcctttggaatgtctggcagaaagaatatattctagaagtaaaacctcagacttagattcttttgactgtttggcatcattattttgaatttgcaatgtgaatgagaaacaaacaaatgaaaaagataaagtaaaagaaaaccctcaatttcaaagttgcacatatttgtcattatttaaaaagaagagtacatgttaaaggcctaaatattttaaataaacattttctaccacaaaagatagcattttatcataaaattggcaatttttagaccattgaacttaatttgaatggactaaactttgtctcttggcaaccagaatccacacaaattggtaggcactttctctggaggaagatcatgcttctcaatacttatgaactccaagctaaaggctggctttactactgaaaacatcacaaagttaagccaccagtatagacaggaaggattttaagtttctattttctcttgtttgtgtgtgtgttcaattaattttaaagaaataacagtgagattcagatttcttaaaaatattttttaggacattattaatagctcaaataaagccattaatacatgcacgttatgatgatcaagtgatcctggttaaaattaagggaaaggtacactttaaaaatatgatttaaaaagcccccccagtcacttaacttcagaagcagggcccggtagcccaccctgtccttggtttttaacatagaaattaaggtggtagcttcggcaggtgttattaccaggggctcatgagtagaccctaaaaggtttgtgaaccctcttaggattatgtgcagcgtttcacatggatgggcacatatgcatttccctggggtaaaaggcatctgattctcaaaggagatatcaacaaaattgatgagaaattttggtgtagggaaaagtacgtaagaccaacatttaggaattctgggttttaattgtaataaggtgcttaccagttatataattgtaggcgaatcatttctctgggccccagttacttcatctgtggttactgtgggccccagttacttcactgtggttccacacttgtgggttgcgataactgcaactccaaagagtagttgtgggtctgtgaatccataagtgtaccaagtttcatctatggattgacaatctatcatatgtgtgtgtgtgtgtgtgtatatatatatatatatatgtatatatgtatatatatatatgtactattaattcataatgagtggtgatgttactgtgatttacaagaacacaaaagcattttaaaatatccttaaatttattgtagtttttggtcactacatgttttctgaatcaatcactgataaaatgacaattataagttttgccaaaacacattggaaggactagttcaaacaattctaagctgtgtccagctcaataagtgtaatgtttagatattttattaaatattccaaacgtgggtctgtgattttatgttttaatttataagtttctgtgtaacatataccaacatatttttaaaatgtacactgtttgttatcagtgcagtaaatggatagtaagaaatatggatgaaatttttttcccttattggtttgtacctatgtgtatgtgtatatacacacacacacacacacacacacacacacacacacactcaagagtttatttctttggtactttggctgctgaatatgagatttagttttagacaattttaagttgataacattgctctttctctcaccaaaaaagtggtcaagtaaattgacatatctaaattcaaattcatcatgtgaaattggaataataataaccaaatcatggcactactgttgctcaaaaattagagcctacaatctacctctgataggtccttggttctggcttattggtcagcctgcactcccatggataggtgtacccaactaagactaaagaaagttcttcaattatcatttaaagaaaattatttattaaactattaaactagttaaatattaataagcccaataataaaaatatgctttgtaaagcaagatttaaacaattaacaacatacaatttacttttcatctttattattaaacatgaatgaaatacataaattaaaaatacatttaatatgtttaattgggaaatttagtttttcatatttaaactatcctatatatatccaaaagcaagataaaaactctaaggcaattctaatttatcatgaaaagcttttgttcagtctaatggcctatttaatactaacgaaaagtccggcaacagaatttgggtttcttaatgttcctttacatgactaagcattttgtgttattattcaaaggtattttattatcttgtaaacttaagtttatgtttgtcaatgagacccccaaattcttcatttttaaaataggtaacaatatgaaattaaatgcatttattacttattagtgaagctctatatgtggcttctaattacatatgaatagtttggtcaagagaggcctcaaaaaaatgagaacaagttttcccagttcatctggactgaatcactatatgcataagtgatacatgttttattctcaaacacttgggttttgtttaagcacaccaaggattctagtttggctgtttcccaagtttgctttaaagtaagattattggatcagactggtgtttcaaagaaataaatcaaaatgtacacagtcaaatttgttaggcagaaaaaaactgtcatctctccaaacgttttttggtgcctatgtttctcaagctcaaagaaaataagacatgccaaaaaaggagcatctgtcttaatgtaagtaaagaaaagtgataaaaaataatttgtgctgggtgcagtgacctgtaataccaatgacttgggaggcggaagagaaaggattgcttgaggacaggagattgagaccaacctgagcagcatagtgagacccagtgttcaccaaaattaaaaaaaaaaaattagtttggcatagtgaagaatgcctgtagtcccagctactcaggaggctgaggcaggacaattgcttgagctcaggagctggaggctgcaatgagctgtgtttgtaccactgtattccagcccgggcaacagaagtaacatcccatctctaataaatacataaataagtaagtaaattatctgatgcattattcaaggaaaaaaggaaagcaacttttatcatgtggccctcaaatacaactttacctcatattgccaacttctttgtttttttgagatgggagtttcgctcttgttgcctaggctggagtgcaatggtgagatcactgcaacctcactgcaacctctggttgctcactgcaacctctgcctcctgggttcaagcaattctcctgcctcagcttcctgagtagctgggattacaggcatccgccaccacgcccagctaattttttgtatttttagtagagatggggtttcactatgttggccaggctggtctcaaattcctgacctcaggcaatccacccaccttggcctccaacagtgctgggattacaggcatgaatgagtcaccacactcggcctcatattgccaactccttaatggtagagaacaaaagtaaatagatttatgaaccatttcaattctagatgaagggaagtgtagtaggtctttctttaaaaaaaaatgggagattgtagttgctgattttattatttctagaggtggaaagtatacaaagcatgctttatacaattatattttatatacaggtatataaaaatggaggacattcttttaatgagagtttttttaaatgctattatatgtgctataggtaaatacatgactattttcaaatgaaaagcttaaaacttctcctgaaaataattcagtgtcatttttagtgattctccaatgagtttcaaatactatatgctatctgaaaagcattacaaataaaacacttcatcttacttattcaacaaatattttatgtactttgccagtcactgtaatattgagttctgattatgctacataattgagtaaaatatataccactttaaggaatatgcataaaaatgagagaaatgactttattaacacctaaccatgcaaaattaaaatgaacacaaagatagagaaagcatattgaaagaaccaaagtaaaaaaaaaaaatcatcctaattagagagattaaggaaggtgcaaacagacactagcctttgatctgggtcccattgataagtacaatgtaaacaggcaaagaagaaaccaaaagcagggctggaaaaccatgttgaggaactagcatgagcaaagacagagacttgtgaatttctagccccacacagggctctaaaagagataaaatacagttgttattgttgttgtttttcctttgtaccggctctatatcataaactgagaattattttattgtggatgatgtcacatctcaccttatttcttatttatattgccatttgttatttctgtatatgaagaaagtgggctgaaatatttttgaggctttttcatggttcacctttgaactaaaatgatagtattatttatatcttcgctactgtctctgatatataaacacattatatatgtcatgaaaacacactgcatggttcatcaattaagatatcctaatatttgatctcatctattaggagaaagagtagcaattgagtgcatccataaataaaataaacctgactgtttttaagattgacccgtctcatcaaagactaaaacacataaaaccagagtcagcaaggatgtagggaaggaagtctcacaaagttttattgggtgtatagaccagcatgggattactgagtttatagttcaacaatccatttcaaaaacctccctgttttctattttttatcttttgatacaacagctaaataatgaaatttcaaaggaacatgtaaatgttttggtttgagtattatacttctgacaatttatcctgacataataaatttggatgcacaaattaaaaagaatcttatgttagtatatataaacacaaatatttggaaattacataaatgcctaacaacagtttattggctaaaaaagttataatcatataataacacactatgcagctatcaaaacttacagtgtatatgcacatagttagctagtgatatggaaattttcataatatgtgtaagtgatgcttagcctagttcctcatatatagtgagcacttaatccagtttagttattatatctgctgttgtgtctgttattaataagatgttatataaatatataaaaaataagcaggttttatatctgtaaatacagaatggtcacagagagataaatagctatatatgtaacaacttattaagagttgtcatatttaggacatgatattttggtaatttaaaaatcattttttatgaataagaaggggttctgtagacattttccaaggttaccaatatttctatatcacattggctcacttcaaattaaaattcactctagacaaaacagtgtaacatggaagcttcagttccctgttgattcattaaataaagtctctaatgtttgatgttgccgaaatgcctggtaggatttcattaaagaccgcctaaactgtaaacattttatttgaaattagttatcttctctccttgacccacatatctctaaatcatgtgtatgaccttttaaaaaatcaattttatttggaaaacacactatctgagattcttttaaatcatctcagagacaagtcttccaaatgggcaattcagaaaggtcactcataagtaatttacatttaaactttatattactttctatcttttaataaactccaaaaaattgagaggttttcagaaaatacctcaggtctgcaattcaaatatttggggcattttttttttttttttttttgctaagcatatgtttgatttgccagtggaacagaattgtgttatccttctcctcaagtaacatctaactaagtgcagagttcataattaaaaaataataataacagcaatgaaggtgtaagtgaaagtacataagctggagttcctctattggtgaaaggtctttgctgcatcagctgggactctcctgacttactgttcattgctaaacttcaaactgatgtattgagaccaaattaaaagcaatctcaactgctcatatattctatcttatctctcaaaatctatgaatgtgctactctttggacagatttcttcaatttttaaaagtttaaatactttcagtagtgttctcaatttatcactccatgtcacatattcaatttagtcttacttgtaagacctatttcgtttgagtcgtaaatcaatctaacaccacacaattgcataagtcaacttttactatcttaattctatccattacttactgctgctctagattcaaatcaatgaaaccaagaaatcacacatgtttgagaatgttacttaattcattcatttgctttcacataggctacctaaatcactccaaggggtaaaaataaagtatcttttaaaatattctgcagataataaaattactcctttcttcagtaaagggcttggaacatctcttacatatgtttgacactgaaggaaatataaaagtgaaccagacctgggcctattaaaattaaaacttaccctaagaaactagcaaaaagaaaagtacttttaaggacagataataagatctgtctttatcttgctgataattttctttctttgtaaaagggattcaacatcataaaagtaaaaagaaaaaaaaagcaaacaaaaaatcttcatttcacactgccacacaactcacttctctaatttttactattttgataagtcacaatcatcaaaacaattactagaggccttcttcttgattcctgtattggtcttttaatacagaaagattttcaagctgtgatctctattttttgataatagagttcacaatgagctctaagaatgtgtcaaactgtcaattgatttcaaagataacctaacaaggttaataactcttatcttccggatgataacctaataactaagtattgcacatctttagtgcccaaagctgctctatttgtcatgttatttttcaggaaaatacaaatggctattcaaaatttacatgatgcatttgcaccaggtgagggttaaatcataccaggacccaatgctgaaataaaaaatttgaataatttaagtgaaaagagactcaagtcaccacataacatggtgaggtagaagcacgatgaatgcaaaagtatatccagtactacattcagttgtacatcgtgatttaatttcagaaagataacatcctcaatcacattaacttaatgattttatttgaattttattttattttaattgtattcaaaccttatttgaaaatttgctctggtcttataattgaatatacattataaatattagggtctaattcataatgcaatggttttatattttaaatattattataataaaaatgcataagttagtggcaggatttcaggcaaatgtttttcttttaaaaggagttgaaagttaagtctgaaaaacactggactatagaaacaggccgtcaatagacaataaggtttgccaaattctatgatctaaagctttcgtgaagcaacaggaaagggcaaattaatacctgtcaattgcctactgtgggcctattatatctcaagcactgtgctaggtactgttgtgattagcaatttcatttaattctcacatgaacactataaatctgctatcaaactgttaatgtccccataccatgggagaaaaattaggacatataaggatttggtgacttcaccaagctttcaacttcactaacaacaaagctgagatttttagaccctgattttagttttctccacaaccccatgttctcttccaaagcaattgtgttggctgtcaattttcaggttagaaagtgacaaaaataaaaggaatgtataaggtgacaagaatgtttagaatagtgaagaaagatcacatagatgaagacaaaaaaatagtgtgtgtatgtgtgtgtgtgtataatttatatataaataaaaatcatcactcttccaattactgacttcctattttgcatataaggaaatgaggctgagcaagttacattgctaaaaaggggcagagaaggaatgatcaatcttgcttgcttaggcccaaaggtagtgccctagttaatatgagcaactgtgattctaaatagagatttctttaggaaaatccatgagcaaggtgtaaacttcccccattaggaagagtgtgatggtcaaaagtccctcactacaacaaaaggcagcttggcacaggataagactcgtgttccagcctcactccttcaacggatgaatgaaaagggaaatactctttttgaagaccttcaaaggaatacatattttacaggatggatatccttcatttataaaccacacattttaggttgttcatatattatttcccgttaattatattttttgttaaaagatttttaaaaagatacagtcaaacatttctgaaaagagaatattgcctcattagtacagaatttatttggggtaacactaattaaaaattaaactaaatacaatcccaactaatcctagtccctttgacaacatttagatgacatcaagaataaatctattttaatgcttttgtcacatattattctacaaagtaaatcccacagttcatttttctaattattaatagagagccaagaggagaagctgatgattaatggagtcaggtacaagactacaggcaggtgtgaaaagtgtgtcagaaagacttgcgctcagatcttgtctcagccaacagcagctatgtgacttgatcaagataattaaattccctaagatttaggttgctaatctgactagcatcttccttgcaggatggttgtaagagatttaaaataacaacataaatatttaaataaaggcctagaattggcaagaagtcaatgtatggtgagtattattattagccagatgaccatattgttttaagcctaagtgaaaacttaacaaataaaaacatttattaaaggaaaaaagaggtttgactattaggccaataccagtaagatttatctgggtcatcaagctttttctcattataatctctcatactttcttctgtttactagtatgtttactactatgtcaaataaagaaaagctgtgaaaacatggaaaacaatgtgaaataaagtatcttttaacataaaccaaggaaagctgataaaactaaacaagacacatggtaagaacaaatacttgatatgaaggatggaaatattaattggataaaaagctaagtttaaaatacctacctgtaatatttttaaactgataactttaaacagtcattatgaacgttaataaaaatatcattaacccatttattcataaacaaacaccaagatataagggcattgaaaaagcccaatcactttaccctttcagttagttttgtttggaccaattgaaatattaaaattgaacagcccaacattgagaaaggagcaaagcctggacatagtttatgaaatagtaatcactttgaatgctaatggtattttaggcttagctgttttagtttttgaagtataggaagtggaggatggaaagattagaagctggaagattcccaaagagaagttccaatattggctatggtataatttacaatttattatagaacaaataagtagcattgttgagagtaatttaaaaaaactcactacaactcaaagtgatctataacaagttcatttgagtctggaatctttaagaaaggtgagtattgagcttaatttgagctcagagggaccaactgggtttgaccttaacatgtggaaatgttctcatcatttcttggataaaacatgctaccacatatactggcgtttatggtacttaaagtcaaataaatagtaaatgatattagtaatgatattctctgtatagagtatgaaaaacttatagtttgagaagtagataaagtaatacagtatttatatttgctttacttgtcttctttcaacatttataatgactttgaaatctgacagatttctcattttctaaacaatgacaacacagccttcatcctttctgctaacaatttgcatagcttcatttatcagtagtattataacatattaaccaaataagaacaattatagtaaagtttctcttacccagcattcacatggctggatatttacacaaaatacagtcttttaactagaaggaaacaaaatgtttccaaacaaattctgtaacacaagtttgttggactctgcatgtctttttcaagagagtccaccaggccctcaaatacagtagaggatcttttattttatagacaaattttaaagcaaattcagtcctccagtttccaagatgactgcagaatagaagcagaaaattagaagaggtgtttgttatattcacatactaatacctgtgagcaaagccagtggatatgtgggcaaacaggagaagtaatgcatgaaattgtatctcacactatcactgtcattttctaaagaggcaaacagttgtaatgattcaataactttagatagcacagttgaattaaaataaaatgtgattacaaatattcataatgagcatgatgcctagagctgaaaataatgtattatatacttgaaaattgctataagattagatcttaaatattctcacgaccaacaaggaaaatgattatgtgaggtgatggatatgtcaattaacttgatttattcatttcacaatgtgtacatatatcaatatatcaaaacatcatgttatacactaaatacataaaattttatttgtcagttgtatgtcaagaaagctgggaggaaccaaatatttataatgagaagtgtgctggataagaagctcttagccttatcacattttactcctcttaggaagagaagaaagtatttagtatgactttgatttttgtgttttaaagcaatacattgttattttaaatgggagagacatcttttatatttttcatacacgaaggactatatatccattatttagaaaatttacttaagaaacagagcctgacattcaacaagaaaaagaaaaagataattattgggtctgtatttagtgttaaacattgtactaattctttttatatacttttaattcgcacaatatttttatgaggtattacttcattttttttttttaaagaagaaggtacaccccagagaagtcaagtaatttgtataaagttacatattcagcaagcagtagaaccaaatccagtcattctcattcactgggtcctctgcacaaacactgtttatctactcactgtcttctcatctcacctccacataacagggttcaagtaaaagtaggtcattcatttgaatgtctttttttaacgaatattaaaattggattatgtttttacatctatatatcagcaccaaatttagaaaagcttacatatatttttgatttcctaagttatataaggtttgcatctttcaagatggtatcaaacaaactgtctccattaacatgttccaggatggattctagtccatattctcttttctctccataactgtgaatttgtactgttttctgcactactgatatttgcctaaaatgttcttgattgcagtatattttaaattcacaattgctctattttttatcttctgcaataattttcctttttctttgcatattctatatttttagtttatgactaattcatctgtggatgactcaagaattctgttttattctggcacatctgaaataatttctcttctcttgagatcaccaaatatatattcaaattttattctctaaatttcaccactgaaggcctaattgtttactcaattttgttttgtttttaactaccagaactttggtacccggtgtgcttactttaaaataatacttttataatgcaaaataatttttaatcaagtgatacaagggtgcccacattaatcatattttcatgaaacccaaacataccagatgcaccaacattatcctatcatggctcctgaagataacagtagagaaaaataggccaaatgaagcaaaaaacttttaaaagttgtaatgtgtgtattttagctgcatatgtgggcaacaaaggaagaaatcatgatcatttttctttagtaattctcacttggccttttaacgatatttaccggataactccatgtacagcattatcctaaaccaagtagctcacattttaaaaacagataagcgaacacaacactagattagaataataattccaatatgattagaataataatattctaatacgtatgtgtgcgcgtgtttggcgaaacaatatgagcacacctgacatttagtacataatgaataaacaaatgttgagaaatagaaaagggaaagaagtacctgatgtctaaaaaaaacttctattaagaagtagtagcttcctagttgaaaaaataagtcagaggagcattgcaaacaatggctaaaagtacagaagtgagaagcagcagaccatgtgcaaataactgtacataggctggggtggcagtagttgaaagatcaaagtatataacatgaagagtgaagaattcagtaataaaaggaatcagattgtagaatgtcttttatattatgtgttatcttgctcaaatatcattcaatgaagcttactgatttctctcacaccttagtggcctagttttaaacgtcagggttcttaacacaaaattaaatacgcctgcccaaatgaatcagattcagtcttctattagtgcccaggccttaggtgatatattccataactctgaagaagaaaccaattttaattttctttgtgttctagcatctatttgcaacattatttaagtggcccatttttttcctgatttgaaatcatctcacatagtgtgatctcatcccaggttcatggttttttttttttttggaagaccttttaaaagcaattcagcctccagggacaattttttttttctttttttctttttttcttttttttgtcatttgcttggggaaaagaagactttttaatgggaatggtgatgggagaaagcgctcccattatacagttttatcttttgaacaataatgtcttactactcaaaattaatataaaaaataaaactgaaatttaataaaaataaatacagataatcctaatatgatgcaaaatagtaacatatggaaaatttaatggaacattaaattccataaacatatggaaaaaataattcaagtaactctgaaatacatcatgttgactataaacctatggaaagtatagcataaaaataaaaactgaaaaaatattgaactttgattagttgatttcccgataatagtcttggtgatgcaattctgaagctactctgagtatattgaaaaaaagtgactaaacgtacatattttgataaataagaatattcactatagaaacagagaaatacaaatatcaaatggcagaagatgagaaacaaaaccttgtaatgctgaatttcatttgaggcaatcagtatgaacacacttacatgtgcactcatatgtgacaatgtgttaagtgcatacgcacagttttccccctaactctatcatcaaaagggccaaagcacaatgaaacaaccaagaggcaataaacactccaaacttagatctttgtttctaaacaaagatcttttatactaattttaattagtataagtcattttatactaataagaagcaaagtttttctgaaaattgcttatttcatactgaggcaaataaaagtacaaggtgagcctgaagcaccttaatgtgccagaaaataaagaaatgctcaaagtctaatggggacatgtgaaaaagacacagaggtcagtttaaaggcgaccccattaacaaaactggaacactctgaatatcaaaaataatcatgaaactaatggaacataacacatttgaacttaaagaaataagccatatatatacataataatgagagagagaaagagaagaggagaagagaagaggggagaagaggagaagagacgagaataggggagaagaggggagaagagaagagaagagaagaggggaggggagaggaggggagaggaggggagaggaggggagaggagagaggaggggagaggaggaggaggagagaggaggaggaggagaggaggagaggaggagagggaaggggaggggaggggagggaaagcgggaaaaagcttccttacaaaaaagaatgccaactgtaaatgtagaacaactatagtcaattatttggcctaacaaatgttagggaacataatataaattttaattttacaaagtttaaaaattcctttacaatggagatatttgatggtcagaatcttaaccaaataatggcacatatatacctactgatgcgatgatgtgggagacatacaacatcaccaatagcatattcttgcttgaaatcttaggtgtaagtttatctcattagaagataggcctttctatactataagatattctgcaggacaacggaccaggacttttcaaataattcaatgttacacaaaaaaattcacatgaggaagacagttgcttcatgaagggtgactaggaagaaataatgcaaatatatacaccttaattggattttagacataaaaacaaaaacaaaacacagaaatgcaaagacaaagcataaaacacagccataaaggacatcttttagataactggggaaatttgtatggcctgtgtataatgatagtaaattaatgttgacttgtgctgtaagtattctcaggctgtgtcagaaaattttatcattctgaaaatatacacattttaatatttattgatgaaatgtcatgacatttatagtgtattttcaaatgatttggcaagagggaagtgtgtggtaagatgttaacaaatggtgagcttggtgagggatatatgagtatatattgtaccattctttcaacttttctagtgtaatttgtctgtttcaaactaaaaacaaatagaacagcaggaaatacaatttgacgagtctcattcatcctaaatcccagataagtgcatccattccttcttctgggcatgaaaattgcagtggggactggcttcctgcttcctgccaacaccagtttctagtctgatggccctcaaaggttttcctaaaattatatattcataaattaaacataagcctctcacacaagaatactttcaatggttctattgccctatgggaaaacttttaagcttagtaaagcatttaagagctttcatttgataatataatgacctagatttgtcattttccctgtaaaatgacagtgtttaaattaaaaaaaaaatgggacacaactgaagtttgaaattaccttgaagttttgagttgaattgattttaacaatattttatttgcttttatagaacctcaacaaatatgttttaacatcattgttatctcagatctatcacttttattttgttctaataaactacaggatacaaagtagaatgccagaccaaaagttttggaacacaacatctatcaagcaagcaacttcaattgttcccccaatatggcaccatttctttattccttccaatcccctaggaagcccaaggacaagtggtcccatatgagtacattattgctgttgttattaataactgttgttactctgaggcttagagagattaactgatgaactctgcctaacagggcttcatataggtgtcgttaggaaagaaccactgaactctaagaccaacattatgtcttctgtcatgtgttaggcaattccttttgatgtctatgcagttttacaatttaaagtagtcatttaatcaaacataactttcatttgtgaagactgtattccagaacatttctccagacatctagaaatcatcacaaaatttatccaagtctctcttctatacattagcttcacaattagcagcaatcagataatctttttcagataatcattttcaccatttcttctacatagaaatgctcccaattctgaaatgtgaaagtctaggtctgactgtaatggctaattttctattgtacatatctatggaagcatattgctgctactcactcataacattccaaaacaaaaacaaagcttatggtcctctcctaaaaattcgccttcttctgtaatttccttataagttaatgatgtacaccaagctcccaagtgggaactcttgatgccttgtaggactttaccctttccttcccaccagcaacaaaaagtagttttagtataggagaaatagcaaaagaacaggagttgatcttaataacattgaatttgcttttacctcaacatataggtttcaatatcattcatatatccagatttctctctttttgttctaataaactacagtatgcaatgtagaggtccatatataggggtcttggcatccatagctacaaattcacattttcactacatgttcaaccaaccgagcacagacccttaatagttttggccctcagttttgtttctcttttctgaaatggagatgtctagccttacctcgagaagttgtaaatagtaaacatgaataatcagtgtcaaatgcttggcactttaatagtgtttggcagcaaatagatgatcctaaagttgtgttgcctaaagcgagatgcatttgagctgcatcttgaaggataagttggttgttgctatgacctcatgaaaggactttattaggcgggggaaatgagaattttactctgaaagaataaatgatgtagacgcaaacaggctaaacttgaagccagaaaaatagagagaagccagattataaggaatttcctatgacaaactaaggagtttggatgctagagaaccaataaatgttcataagtaagagagaaacataatggagctttgtgtgtgtgcatgagtgtgtttgggtcacagtgggagaattaaatagttgttaaattattcctttattttattgaatatattccaagtttaaaacatgatattttgatatatatatttacatagtaaaatgattactatagccaagctaataacatatccatcatctcatatagttaccctttgtgtgtgtatggcaaaattacctaaaacctacgtgccttttttttcaaatttctggtttatgactcaattttattaactataattctcatgcagtacattagatctccagataacctgtttttttaaagaaagacagttgtgtgcagcttataaaaaatacactggattacaaagggcttaaaacaaacactgaaattcaccaggatgcttaaaatttgtcaattatccagctatgacaaaaccaccgccaacaatatactgaatcagcaaagcctggaaatatccccctagagaactagaacaagacaaggattcccagtctcaccaatcatattcaatacagaatggagtgctagctagagcaacaaggcaacagagaaaaataaaaggcatccaaataagaaaataagaactcaaactattattctttgtggatgagatgatcctatgtctagaaaaccataaagactccaccaaacggctcctgggactgataaataacttcagtaaagtttcaggatacaaaatcactgtacaaaaatcaggaacatttttacacatgaataacattcaagctgaaatccaaatcaagaatgcaatttcatttacaatagacacacacacacatacacacacacacacacacatacacacaaaatgcctaggaatacatctaaccaaggaggtgaaagacctctacagggacaactacttcaaaacactgttaaaagaaatcatagatgacacaaaacaaatgaaaaaacatttcatgttcattaattaaaagaataaatattattaaaatggacatactgctcaaagcaatctatagattcaatgttactcttatcaaattaccaatgtcatttttcacagaactagaaaaatgtaatgtagcattcatatggaacaaaaaaagagcctgaatacccaaagcaactctaaccaaaaagaacaaagccagatacatcacatcttctgacttcaaactatactacaatgctacagtaaccaaaacagcatggtacttgtacaaacacagggagatagaccaacggaacagaactcagaaataaagctgcacacctacaaccatctaatcttcaacaaaattgacaaaaataagcaatcaggtaaggaatgtctattcaatcaatgttgctggatcagctggctagccatatgcaaaagaatgaaactggactcctaccttttaccatattcaaaaattaaccaagattgtttaaagatttaaatgtaagacctcaaactataaggatcctagaaaaaagcctagaacaaaccgttctggacatcaaacttgggaaagaatttatgactaagtccttaaaaacaattgcaacaaaaacaaaaattgacaagtcagatctagttaaacaaaagagcttctgcacaacaaaagaaatgatcaaccaagtaaacagacagcctgtcagaatggaagaaaatatctacaaactatgcatctgacaaaagtctagtatccagaagctataaggaatgtaaacagttcaacaagcataaatgaataaccccattaaaaagtgagtgaatgacattaacagacactcctaaaaagaaaacatacaagaggccaacaaacatgaaaaaaattatcatcgctaatcttcagagaaatgcaactcaaaatcacaaagagatgtcatctcataccagttagaactgctattattaaaaagtcaaaaagcaaaagatgctggcaaggatgcagagaaaaggcaattattatatactgtcggtgagaatggaaattagttcagccactgtggaaagcagtttggtgatttctcaaagaactttaaacagagctatcattcgacctagccctcccattactaggtatatatccaaaacaaaaccaatctttctacccaaaagacatatgcacttgaatgttctttgcatcactattcacactagcaaagatatagaatcaatccaggtgcccattaaaattatgttctttgcagcatcatggatgcagctagatgctattatcctaagcaaattaatgcaaacagagaaaatcaaatattgcatgttttcacttacaagtaggagctaaacattgagtacccactgacataacgatggcgataatagaaacagaggactactagagtaggggtgaatgggagaaacagttgaaaaattttctatgtcctctcttctggatctgtccatgcaaagtaatcaattattttagagaccaaattacgttttgcgtttttgacattttcagaaattctttcttttgtgggggttacttattcaatctggcctccctacagggttcagggagaaaatgagaacaggatggcattcacattactgacagaacaccagtcaatgaaacattatctcctggagccattctctaactgctttattatttttgtgctttaatcaatgagaatgtttacctatggggaaaatctttgcataggtagactcactgaggaatctaacaagtctatcagtagaaagctttttggctttaaaaatggattgaacatattgaattttttaaacaaagaactaggaaacatattagagaccaaatttttaataatgtaagtaaatgagaggttgcaatgagaattgtgaaaaaaaagattcccttttactgtatcacttattaggcctcacatgacttaaataatttccccattttatcctacctcctgcattaatattttgctgttcttgcatgttaatgtttatagaaatttctattttggtatgctcatttttttctgttgaaatatttgctgagttaactctggttactttaaacaacatttccaaaaagcatatttacttgcctgccaatgccttccacatagggataaatgcaaaatcctcactaggacaataaagtcacccacaagcttcacctcctgactcaaatgttgtacttacaaatacacatcatggaggtttaggtacctaaaacgtgttctttttaccattgcgtccttgcattgttagttttttttttttccctattatccctctctaatctttgcctggtgaactcattattcaaacaccatctctggctttaagtattatatttgctaactacccacttatctgttggtatagatttagttgattaataaaataatataatccattatgactggaagaaataatccactttactgggttggggaagaggggtcaccagggcttctctcccctttttgaacaaccttgttcagagctaaaggaaaagcagtaaataaatatctactatgtttaaagttcaagaagtcttatcatctttcctcatactactattaataatataaataatttccacagtgtaaagatgtcccttggaaacaactgtttacttgtaagaacaagctctggagtcagaagtcgcaaattggatagtgtagcggttggctttcaaatgtgatgagcagaaacagagctttcatggaaatgcctgagaggtgattgggagagtggcaggaaaatggaggccaaaaggataggtggaggagaagggaggggagcttgggacaacctaacctaatctcagccagagaagtcccgattttatctgttttacatattggctttctgtatgaccgtccttttcttaaaagaaagaaaacaaaaaagctgcttttctgtatgttaattgaaaactactggtataaacattcttactgcccatattagtgttttaaagcattaagaactttattctgcaattaatgaatcagctattggtattcaaaccagtttgagtcaggtgcaggttcctttaattaagctcccagtgtggttcacaaaagacaggtggctacagtttcactgctttgctcaaggatggcatgctgctttcagtttccactgttatctaatgactagaaataaatttttaccaacgatactgaaaaatgaaatggtcacattatatccttcttttacacctttatgaaattcacctaacagaagaaagcattatgtttcccagttaacttaggtctaacctggcgaaatgcaagggttcaagtttgagaattcataaaattcgtagaagttttatgacggtacatggagatcattcctgttttcctgtattctgtccagctaacatgcacacaccctttttattttcattgttagaaataaactaatttccaaaagaaaatatgaaatcaagaaagctattgctctcctattatgtgcaaatattagtttccaaagaaataaagttaattatgaaaacaattcaaaatgcacaataaaaggataagatatggacctaagaaagtaatacaaataaggaagaagagcaattaaaggcaagtgcaaataaagtaatacaagagcagaaatgaagagcaattgtgttcaaaagaggcaacagatgagaaacaaaaaatggtcacttcctaattttacatctggaaagatattactgtgtgccccaactaaacatgaagcccagaatggcttgctttgtttcctctttactgtctagatagaaggttgatgtgcagatacttgattttctgattgtgctctgaagccactcccctagatgaacaagcagtttctgaccactaagagtaggattatgtaataaaagtacagtgcctaaggcatcaaaccctgattttagtccaggtgttgtccagagggagccaactttgtttcaccatgagctcacattcttccaattgtttcacctttattgttgtgctcttctacttttgtgctcccacagctctggatatcttccatcaatagaatcctcacactatactgcacttgcctgttcagtatgtctctttcattactgtaattcttatgaaggcaatacattgttctacttgattcccattacatacccattgtgtgtcgttttgaaatacagtaggtatactaaatatttgttaagtgaacatattttaccataaaacatacaaccatgaaatattatcctagttgaagaaacacttcaagtaattgaccagattaatgattgagactgaggcagtgttccatgggcaatttatgaagtaagagtttagttgttaaaatataccaaatgtaaaaataataacgcatagatttttaaagaaagttaaagcaaaacgtaaggaaatctttgaaatatattattttgaacattattatgaatgcataaaaagtgttatctacaaagatactcattgcaatatttttaaatagcaaaaactttattcaatacccatactatacaataagaatacaatcattagaaacagtattttaggagccaaaaatgatatatacatcaatgtaatcaatatgcaatacttttattttttcaggtggggtcttgctctgttgcccaggctggagtgcagtggcacagtctcagctcactgcaacctctggctcctgggctcaagtgattatcctgcctcaacctcccgagtagctgggactacaggtacatgccaccaagcctggctaatttttttttttttttttgtattttagtagaggtggggtttcaccgtgttagccaggatggtctcgatctcctgacctcgtgatccgcctgcctcagcctcccaaagtgctgggattacaggcgtgagccaccacgcccggccgaatttccttgttatctattagacaccattaagggcaactactctttattatttacattttgtatctgtgtttagaaaaataccaggaatatgttctatgctgtactgttaattgaaaaaaaataggtaaatgaaaatatttctaaacagaacctattaagagatatttgtgagataagtgtgtgtgtgtgtgtgtgtgtgtgtgtgtaacatatgcacagagagggaaataagtcaaaaagagcaagacaataccaatggtattctctgggaaaattttagtttttgttttcactcagaaataccttcttaaatttttgcactaaaatgttaatgataagaataaaaaaaaacagaactagaaataatgtgaaaactattgaaaataatacaagtttctataaagtgagatgctttgacatgtgacaattcattattagaatggcaaaaagaagtgcaagactaagaaattagaaaaaatacttcaaaaagctgtcagggagtcctcccagatattccaaaatattatcctctccttattgcaagaaaacgctctccttctgtcattatttgctgtgagagtagctacccaaaaagctattttgtagcaaaaccagttttattgttatcattgaaaagaatttttgcctcacatgtctgacccaaattccagtgtgattctaattcacaggtttgtcgttaggatcaagggagatactacttgtgagagaaattgtaaatgtataaatgtataaatcaaatgcagttatactccagttttatgagaccatcagtgttgggaaaaaccaagactagaaaccagaaaatgaatttatttagcagagaaaaatcagtctaggaatttttacttgacaatttctttttctcaaatggcagattagagtgtgtgtgtgtgtgtgtatctgtgtgtgacagagagtatatgcattagtttttaaagcaatgaacagaggtctatgtatttcatttctgctatgcaggaaaaactgtgctgaattgaaacctgaaagagagtggttaacattttcagaatcaactccatttccagaacagtctctgcttttacaatgttttactgtaagaactatgaggtaagaacaaagattgaagtaaaagaaaattattctagggttaaatgggatattgacaaattagattttgggagatatgagaagttaaaggggaagaactttcgcataccgggaagctctgggcctccttgcaagtgtgcaggttatatggcctgtctgccactgagcctgctgaactctctattttgtgttggacggtaagagctgatgtgtcctgtgtttgcttttccaatttatcaatctcaacaatggctcatattattcccttgggttgacagttcaatagagaaagagcatagtatggtagacacagtgtgagttttcgttcagagaaatattgtctatttaacagaggagaaacagtagcaacttgcttatcccctctgagtctcagttttctttctataaattgtaaacaacaacgtctatagtgcaaggatgttgtgaggctaaagatattttaagtacaattgttggcacatattaagtgcataataaatgtcatcatagttactaatgactgattctggcatggatgtctgtttgcatgtgtatgtatgtgtgcaatgtgtatttatacattattaaagaaactatgcattacttcacttctcaagcacgggtttcattcagtctatttgcttttgactgctctatattgactgttctggtcactgttttgtttatgatacaaagaagatacttcaggcagaattatctttctgaaatgcagttctgttcctgccactcttctccatataactcatgtcccagccaacttctcaggtgtcagctctcagcaaagtctcgctctcttccaccatgtgcacatacaaacaaacacacacacacacacacacattgctataatgcacaatgttctctgcgttttctttaagctaactcacaccctgtccccatttcctgggatacccagtctctgccacttttctgaaaatctcctatacatctttcaggtttcctcactgaaacgtttttatgacttcctggactctctaatgtgcccatatagctctctgaacttccaactgttactcagtagcattgtatagattgtaatccctgttaattggtatgtctcatacactagcctgaaggctgcacaagagtggggtttttctccctctttcactgtctcattgctggtaaattgtagagtaaatggtattggtatgcattcaatgagtattggttgaatgttctgatgcaaaattcataccccaaaacgtaaagaaaaatttctaccattaacttctcagtaccgcctactacctcttgtaaattccatagtaagttaaaaaggtgaatgcagaaagagagcttttttttttaatccccaggaatgctaatgtggaaagtcacagggtttttgatgatgtcagtatttttatttttctctcaatatgtatgtatagaggaaatcaaacaatgggtatccattttaaaaataaatcagaacaatttattttcagccttgggcaatcatttccatttcttaaatgagaaaaaaagagaaaataaaacaggaacagatgtctatttccatccattatcccataattgtttttatctgtaaaacatcttctaaaaggaatatagagaagacagtaagaaaaataaaaatttaatagttattatatttgagcgtttggataatggaggattttcccctctcttttctaaactttctataatgttaaactatctttaatgcaatgaataaaatgaatagagagtgaagaaagcaatcatgtttctgaattaccttcatttatccttctgcaaagatagtgaaataaaaaccctgatgttctagatcaaatttattgcagcctattacagtaccttgcaatttgtaagactcgtgtttattgtttgcggattgagggttttgaggaaagagaaaggatcaagacacaattatcaacattccactttttaaaaattcatgcattcattgtagtgtatacacatctacacacacttatatgcatacacacacatctatgccagtagattaaaatcccataccatagaattgggcaggtaataggctctcagaataagacctggagaatgactaatttgtttctttaaatttcaacagcctactttatcatgtttttttctttcttaagtcagtatcttcaaagaagcaaaagaaggtacacgaagcagaaatgtaagccaaatatatacactctgatggcctgttaaagtcacataggctgacctcttctaaactataaaaccacatgagcctccaccttcatttgtttcctctgtccttgccataggcactaccacagtgctccatggggcgctgtggccagtcgctatcagaaaagcacatctccttggtatccacaatatcaacattgcctatgttggatacttaattctaatatccatgctgctgaatcatgtaatttatggtgaaaaaaatcaaaatgtcatttaatggagaaagaaaaattgtgaaagaatcacacaattgagtgctttatgatgctaaagatatttcaagcagtcattttcatatgacttttgtaatgtagcaactcgtcttacaatgttttaagagaagtattttacctaaatgtgcatgtcttctgaccattgcatggagaataagcttctgtaaacaccactgaaagaacatattatgttttatgttaacacgttatatttcatgtcagtcttttggttcataaatggtgtagataaaattactgttcaaagaatggttatcaacctgctgttctcctttcattaaaattaggttcatattctggtcatttcttagcagttttattcaatgttaagtccataggttagctaaaatgctgtttcttcccagtggaagagttgggaaagcacaataccagtcatgtggtgccttctacatcaacagtatcaaaactgttccacctaagatggaaatgctgcatatcttaaagaaaattagttaagaattcaaaagcttttcattgacctcatgagccctccaaaaataatacagagatacctgacattttgtagtgttcttctagagagaatgctaaagtgtttttgcttaacatttgtgtgctccctaaggtaagtaaagtgaatgttattattcttatcacatgttgtataaagaaaaacaagaccagagagactaaaggataaacgtttatttaacaatttagtaatataatcaggtctaacatgagagcccagcactgctcaatagaactttctgcagtgatagaaatggtctataaatctaagctgtttgataccagtggctattgagtacttgaaatgtggctggtgcaacagagaaactgcatttttaatttatttaattttaattaattttaatttaagaaaccacatgtggctagtagccactgtagtagacagcacagctctagtcatttcccctgtgttctgtcctgtaatcacctggctgattttgttaccattgttggcatgataaagtaggctgcttgctgttaattgttctaaccttaaagcctggtggtaggcatggtacattgtggaacaggtgctcggatgggtgaatgtagaaaggcttcaatggcaagggctaaggattaaaatttaaaagactgaatgtaaaagacttttagatttatctttccaaaataataaaatacatggggatactttcccatttactaagttcctgaaaaatgatatggacaatttctataatgatttatggcctgtccaacgctttcacgtgttttttttcccccattggcattaatagtggtaacacaaagccaacaagcaagtaattttgtgttgtttgtatacacacacaatcaaaagcaaagataaggtgagtaacttgttcagttacagaaccagaaggagtttactgttatcattcttcaagaataaaaagagctgggacaattcttttcaatctactacataaaatatttcaaacagttcagcttatgttttagagtcatacattaatcactaatgtgtataaacaatgacactaaaagatcttatggtgattattcaggttcaatggtaacagttaatgatgattacgtatgccttactataacctcttgaaaattggtaaattttgcaaaccatgtatgttaactcttgatgaaggcacagataataaaactcatgtaattataaaattaacaaaaaatgtacatttccacagcatacagaaaataatttgccatatttatttctccactctcaacttcttcgttagcttaaaatgctttttttctatctaatttcttcacatttcatctacactctgatcataccttgttccgtccttgtcccaaatgtatcctgaactttcttgcttcttttccattgtgtgtggagttctgttcattcagagtgcccttcccacttgtccacctactaaaccttaacatttttcagcatctagatcaaatgcctcccactacagaaagtcttttctctcatcagaattcatcactccttgttcagtattttcttagcaattctgatcttgatctcacactttgcacaatagatatttatctgaaagccttgttattagttagtagtctgaatgtaccatgagttgaagaccatttgaatctctttaaagttcctataagataggttcttaaataatgctggttacaaattatttttttaaaaattcaattgtgaaacagcatttgtattttgtcttgctaacgtcagatcagcttcacaaaacagcatcagaaactcaaacctctattcaggcattcctgatactattcacaagtgagaatctgaaagtgcaaagcttagagtagcagattggcacagaatcccctcagcttgaaaattttgtcggaataaataatcacctaacactctgccttcacactctttgcacgtaaaagctaaagtgttcagaatgcaaatcccttaacaaaattccaaagtagagcagtcagagaataacattaaaatcttagtgatagacgatatttatcatggtacactgattctaattaagtgaattattttgttgcaagtattttattcacttattcaagaaatatttattaagcatacatcatacgctaggcactctgctaggctagagattgaatacaaatattacattgttcctattctcaagaattcatagtctcctaggaaaggcacagtatgtagtatattaaaaagaaaaactgggcgggcgcggtggctcacgcctgtaaacccagcactttcggcggccgaggcgggcagatcacgaggtcaggaaatcgagaccatcctggctaacacggtgaaaccccgtctctactaaaaatacaaaaaattagccgggcgcggtggcgggggcctgtagtcccagctcctcgagaggctgaggcaggagaaaggcgtgaacccggaaggcggaacttgcagtgagccgagattgcgccactgcagtccggcctgggcgaaagaatgagactccgtcaaaagaaaaaaagaaaaagaaaagcgtcggtacaataacttctattttgttctcagcttgatcaactaatctgagcctatttcttcatctgtaaaatggagacactaaaattacataccttactgggttattgtgagaacttaggaaggtaatgtatgcaaatacatgaagtatttagtccattgtttgtaatttaataaattctcagtaattatcagtaataataattgcagttcaaggtgaaaagtgctatgaacaaggaaaatagaatatactatgcaaatgtgaaaggatgggacctcattctgtcaacgtaagttggagaagccttctcagaggaggattgttgaaagacttgaacgatgagtaggaattttccaggtgacatcactaagaaaggaatggatgcttccgatgaaaaaacacatcctcagaagaatatattcaagagaattgtaagcagcacagtatggctaaagcagaaggcggatggagaagagactaaagaacatgacaaagagatctcataaacattcagaagaggaggactgtggatgtatttccattttaccaaaagcaatgtgggatgaaatacactttagagtgctgaagcattaagtgagaaaacaagctgtaagtttatctcaacagttccaggacatagatgacaagatcttgaacttagttctaaacaacggggatgaagataagaaaaaaatgaggttgtcttgaaatggtgtaatgattggtaatggagattgagacatcactataaaatcacagaagaaagtatgttcctgttttttcaccaacttactataatgaaaatggacatataaatatatttcatttattgctggaaaactaacaggatcatatcagaaagaatgaagataatttctctctattacattgaagaatattgcaggattagttcatgctttaaaatgatcttcccccatagagacaatattttttatttttactttaaataatcttaatatttcattcattttaaaatgtaaatagagtttacaaaaaaagtatccaaatttatcccacaaaagcagaaagggaagattagaaatctctaactgtgcatagtgttctaatttttaaattctaattgtgttttatcctatctcaaattgtagaatctttttaagaactatttttaattttagaaacttatattttttatactaccaaagattgaagttgacaaggtatagaatttttcaacacctaaaattatcaaaataattaacttccaggacaacactttaactcaactacttccccaacctatgccctccagccaccagaaagaagccttcaggagtccctacagcacccacacaggtcctctccagttttccccctcccttcctgatgctgtgaaaaccacagaataaatgtttatcactttcaaaaatattttatatatatatatataatgtatatgaatttttctttttactgcacataatatagtatcctgttcacctctcagataaataaatcataattatcattttctgcttttaaataccctgaaaatataatataaaaattacataaaatcaattttttgaaacataaaaaaattaaaagaattacaaaaacaacttgttcaataaattttgtcttataaaatatctgccaaagaaaatattctaaagagaataaaaatgattgttcctctaaggcttaggcttaaatattcacacatttcaatataaaatataactaaagacatctttcatttagcataaattgttctgatacctattagataaatcagtatttgcagtgaaggtattttaagataaaccattatagtttacaatagcaattctcaaactttctaagtttcataacacctttgcactcctaagaagtactgaatgctccaaatgacttttgtttatgtgggcaatatccactggtatttactatattaaaaactaaaacacaaatttaaatattcattgatcttaaataacctattacatgttaacgcaaatatttttattgaaaattgtatatttccatagaaaatatagaaatatttttagtgtgaagggtggcatttttagtgtgaagggtggcattttttcttactttatttttaaaaagtttgcaaagtgtcagacttcatagaagatagttggatttttatagctatcgcatttaaaatgctgtgataccatgtgtcagaaagcctacagaaaattcgatcatatattcataagagaatgagaaatagagatatatggcattttaatactatataaaaatagttttgacctcacaggacctgtgaaaggattctgaatctccaggtgtctttggatcacatattagtaatttctgctcttcaggaaaatgtcaattggaagtgtaaacaatttaaattttagtaactgaaaatacaaatgttaagatgattgtagcaaatttatagaaaaaataaaaactgtgatgtcatgttgaaataaatatattcataaaaataccagtggctccatcagagacagatatgtctaagaaattaatattatgcaaattttaactaataatccagattttgtcatttttaatgttcagatgctgaacataaaatataaacatattataattaattttatatacattaatatacgtaaagtttctaaataactttatttttatctgcattttagattttaaaatgtcaaattctaaagtaaacatagttctacaggtataaattgataaaaatatactaatcatctgacagttatagctctttttaaagcagttttgagatactctatttcaagaacaaataagagactactaacacccttccttccctgctccacataacagtttcacctcttatttgagagaatgttcagatattgaccttagttgagtcagccagagacacagagctctgggttagaaccactgcctagccaggaagagggaaatgtgataagaggtcagtgtattgctaaaaatcacactcctatctatgtttagatgagatggaataaatcatgaaggcaaacaaagtcttcttgacagaagaaagtatatatacagctagactttggaaagattttcttttcttgttttccatagaacattttaaactcagtttaacatatggtgtttagcaaagtcatcgctgataagatgacatttgagtagacatctggatgaagggaggaagcaagccatgcagactccgggtaaagcatgttctcagcggaggaaactgcacttggaaaggatctgaggcagacttgtgcttagaatgtttgagaaagagcaaggagaccatttggccagagtaagatggatgaatggggcaagtgaaaggcatgcagtcagagaagtagtagggaactgattatgtaggtctatttatatttagaatgaatgaatttgggaatgactggaaggctgtaaaaagaacagagacattatccaataattaacacatattacaattactgtgtgtcaggctctattctaagtactttatataagcttgtgtcatcctcacaaaaaaaaaactatgaagtaggcacataaaggatattgctaaatattaaaagggctttgtgaaattcttcagattgactttctaaaccacctttgggcaaagacaaatatttcctaggaaggaacatccattgctaactaaagttgagtgagtgctggttaatgcttggtgcaacagacctaatatctgatttaaaagaatcacattagatagtcttaagaatagatagtagtagggcaagtgtggaagcaggaagatgagttgggaagcttacaatacccagaaattttaggaaacttggaaaaatgtgtgagatgaacatgtttgagctgatttatcctagattccccatcactgctggtgacctagtagagttagttgcagttgacagaaatggaagtaaaggagaccactaaaataacatcacagatctgaaaccaaatgaccgtaagatattttccttagtataaacagtaagccaaaaatgaattcaggtgaagtcaaccattatttctgattacattatatataaaaaatattctagatgaagcggtttttaacagatattagcactcccatgatattgataagaaaacaagttcagaaagaagcatgtatactgaagaacacatagctaataactggtagagtctggatttcaatccaatggtgttcaactttggggcctaaaataactgctagattatatcactggctctttaatttatagttgctaggggtactgtgaatctctaggtgagaaattcttcaagaatagcctaaataattcaaggaggtttaactggatccaagtggggtaaaaggagaacaccaaaagtaggcaccatatatgaactcactgttttagaatattgttcttagcatctagacaggtgggtaaacaaatgggtgcaatgtacaagcagctcagctgttcccagtgatttgtgttttgtcaaaataactcagccaagttgtcctcagtaaaaatgttacagcattttttttttttttgcttgttttaaaaacactggcgaacccaaagagacacagcagccaagaattgaggctgccatttgcaactgtgccagggtcaaagtcactgtctgtccttgggccattcattcaaatgttttgagacctcatttgtctcacagataaatggaactcttgctacttatccatttttcctttgagatccttcagataatttgcaatttaatgagaagtatgggcaagatattatcaccttctctctgctaattaaattcttcctttctttacttcccaaacttcaacataacattccaagacttacttgactattcatgatcctcttctttttcaattttatcataaatttgtcatctggcattgagcattcccttcattttaatggtgataatccttttatgcatgtggcctgtctacccagagttactaggagatcctagaaggcagaaccaagattacatatatatttccatgtacacccggtgatcagtgaaatgctgtgcaggaaattagaactggctgagaattcgatgatggtaatgatgactgtaatagcagttactgtttatggagcacatactttgtgccagtcacattatataatgtcttattttatccccacaaaaacttgcaaggcatttattataatatgaatttagaatcaaggaaactgagatgcatagataaactgagatgcataagtagtgcataaaaatcagaaagtcagtggcagaggtatgataaaaatccacactgttctaactctcaaatcagtgcagaatggcagaagtgtcatttcagttatatatgtatgtaggatccattcgccatgcactcaccaatacacttatgcatcagtttatccatcagtttaataatttagccatccacccacctttcctccaaatatccactcttccatccacacactcatttgttcttatattcacgtagccattcttcaattcttccattcacttaccttgtcttccattccaccactctcttcatgcattcaactaaccattcactcatacactaaataattcattcatatatctactcatccaattattttctaactcatccatttattccctaacatatctgtatattgaaaccattaccaatctgttgatttattcatttagtcactgattcattcatttattaatttaataattcctgacatctatccattaattctatcacctattcaactgtttattaaaatatatgcatttattaccattattaagtatcttctttgtagcaaacccttactagatacaaggaacactaaaatgagtaagacgtactctaacctacagtatcttacagtctgattcaaataatctagaaaaaaataatgtgaggcaaaggagaaaatatctttgttgtgtggagagaagcagttcaataaaaacttaccatcccagcacggtagttcacgcctgaaatcccagcactttgggaggccaaggctggcagatcacgaggtcaagagatagacaccatcctggccaacatggtgaaacctcgtctctactaaaaatacaaaaattagccaggcatggcggcacacgcctgtagtcccaactactcaggaggctgaggcaggagaattgtttgaacccaggaggcagaggttgcagtgagctgagatcatgccactgcacactccagcctggtgacagaacaaggctctgtctcaaaacaaacaaaaaacaaacaaacaaaaaaaacttaccaaaggaggtgatatacaaatgcaggcttaaaagaaacagagaggtttacaagttggaaaacaaaggaaacatttcagacaatgggaaatggtaaagcagatgcaaatttacattaaataacaggatatatgtggcatactgttggtcattccccaatatttattatgcctttctaatagtaataaaattacgaattaaaagctaggcaaaatagttgcccagaatcaaatttactttttcagcctcactaaccatacagttagttaggtattgccatttatgttagttttgatcactgaatgtgagcagaagtagtgtttgcaacatctgtgttatgtttcaaaaggagaagaagtaataaacttgccatcccttttatcttccttctggctgaaatacagttatgctatttagccatgttggaccatgtagataaagcaacctggtagaggtggcagaattataggatggaaaaattctagaccccatgacattgtgccggtcaacctcttctagctttggcttttactttttttatcttgtttaaaccacttgtaatttcttaatttggatgttttatggtatgtgaccctttattctatacaatggactgtttcacgaaacgaatataaaatacgtggcattctctttgagacagtaagagaggctgtgaagatacagatatcacatcttggaaagctgaaaactctcagtacattatggccaatatttggtaaaacttgtcctaatacttggaaagaaaactccttcctgtgagagtctatgctcaagaggaaaggtttagaaatattcttattcttattttatgttttagtaaaggcccacaagagatgaaggacactaggatggagatttagtttacacagattggagactctacagatcagtgcagggacacactctttatgtgcaatttgtaatctaggttgactgaaaattttataatttggggccttatatattcaaaaagtgaattgattttgtaacttaggttgaaaaataatagtaggcagccctgaaaaagtactttacctggagaatagaatatggcaccaagtgtttttaattaaaaattgttagtgagacattggagccaccacaatagcaaaaatcgaattaaggatgttaccttcccatccaaacatattattttagatgactcaaaagatagccttcattttatttttctgagagtaacagtagaataggcagggcacagagggttttttttttaaagactagactctccagacttaaaactattttaaattctatattttgctcagtagttttgagaactagaacatgcacatttttaaaaagccaggcaaacagcaagttcacaaattttattgagcccatctgagtgctgtggtcacaggacagccaactgtccaccaataaacaaatagacagacacctgcagggagaagtgaaacatagtaattttccaaaattattgactgacaacaaagcatgtatccaagaagttgagaacaaaaagcacaatacatatcaaaagtgctgtaacttggcacatcatattcaagctactgagaaccaaagacagagagaagttcttcaagatagccaaagaatgaggtcaaattatacacagtgaaataagaataggaattatatccattctcagcaatagacttggcctacttttgtatattaaaaaagaattatatcgaattatttaagacttctcagaaactgtgcaaattgaaagataatagaatgacatctttaaagtgctgaaagaaaaactgtgaaaattgcattaaaaagttgctaagttaactcaagtggtcagaaaaagaacaataaaacaacatattgaacaaatacaatatacctagcagatctgtatattataatccaactacatcaataatagcattttctataggtgttataaacacaccaattacaaaattgttagactgaataaaaatctaaggcatatagttatattctatctacaagaaacgtacttgttttattcagttcaggctgcttttacaaataccttagacagggtggcttataaactttagaaatttatttttcacagttctggaggctggaagtataagatcagtttgccagtgtgttgatttctggtgagaggcctcttgcaaggttgcagacttcccattctatcctcacatggaggaaagagggctagctcactctctggccttttcttctaagggcactaattccattcatgaattaggtcatgaactccatgctcatgacctaatttccttctaaaaaccctacctccaaataccattacattgagattaggatttcaacatattaatttgggttgacataaacattcagtccattgtactacattaaatatatagccttatgtatgataaaagtaaaaggatggaaagagatttgacaaacacacaaaccaaacaaaggaaagctggagtagcaatattaataacagacaaggtagaattcagaaccaggtatatatcatcaggagtaaaaaggtacacaatcaggtcatttctctaagaaggtatttttaaaatcttaatttggtatgtagccagcaacatatgtaaatacataaaatctgttggtacataaaggagacatatacaaacacacaattgtagtggatttggaggcatcaacactcctcagtaattcacagaacaaggagacaaaaagtgaggaagcttacagaagtcttcaaaaatattagctactacttgatctaagtgacattttatgcaatagtttactgaagaacagcagaatatgcattgttccctcaagcatacatgaaactttcatcatgacagaacacagaataggaaattcaacagactttaaatttacgaaagtaaaaatcatacaaagtatattagaccgtaacataatttaaatagaaagaaataatagaaatatatctgggaaacctttaagtacttggaaattaaacaacacatttctaagtaacacagaggtcaaagaagtctcaaggtaaaaatattgaactgaatgaaaatggaaataagacatcaaaatttgtaagacacagctaaataaatatttagagagaatgctatagcattaaatgcttatgaaagaataaagaccttaaatcaatactcaagttctagcttaacaaattagagaatgaagagacaaactcaaagcaagcaaatcgaaaaactaggagcataaatcaatgaaattaaaaacagaaaagcagtttaaaaaaaagctgtgtttttggaaaaaataaaactctagtcatactggcaaccaaaaatgagaaaagacataaataccaatatcaggaattgaataagggacatcattacataccttcacagacacaaaaataacaagggaaaattgtgagcaactctatatccacaaatttgacaagtcagatggacattttagtgtggttatactgttcctactctactgttgcgttttgggtatgttataggccactggatcatgaagaaccatagatagacctaataaaggtgagtactcataacctcaagttcatggacttcaatggactttcatgaatgagactttgaagtctcccccctgggtatgagatgaatacgttctctatgtggaaggaagtgtacacaaatgattggctgaccaaggcgcatactatggcagataattctggttttcctttaatatcaagtgttttctcctctcatggaataaacatgaagcataatctttagcagtgtgtatggccctccggaataaagactgcattttccaccatctttcaaagctagctgtggccatgcagctaggccaagagaaatgcaaaatgtatgtgtggaattcaatgtcatacaccctatcgggcatagtacatctaataaaatttgagaccaatctaagtgtttcaatcagatgatattttatagaagacatttttacacagtgacagacaatccaagaagccaagcataatgaattccttaatagccacaatttaccaaactcactaaagaagatatatgtgtgtgtgtgtgtgtgtatatatgtgtgtgtatgtatatatatatatacacatatatatatatatatatatatatatataaaatcttctgaagagtatttcatctattaaagattaaaaacaaaatgatgcccctaccacttatagggatagagggatatctcagtccattgtatgttgctgtaacagaaaaccacggataaattataatgaacagaaatttatttcttatactttggcacctgggaagtctgaagctatggggcctacatctagcaagtcgttcttgccatgtaatcctacagctgaaattcaagagtgcatgcatgagagagcaagcaataaaggggctcagctaattctttataaggacactactcctgcaataacggcattaatccattcatgagggcaaagtcctagtgttctaataatcttttaaaggtcctacctatcaacactctttagggattaaatttcaacatgagtttcagagggcatattcaagtcatagcaacagataatatgatgagtccaaaagctaaagctccctgctgatggatgcatgttgagaattgagtgatgagagtatgggccatttgtctgaggctagaggcacagagaaaaggcagcttctatggaagatgcacccaagacagaccaagaggaaggaaatacctaacctaccaaggtcatccattggatgatacaacagaaaaggaaaaagtgaagactacacctaagagcaaaaatagagtgaccatcaaatttacaggtgagtcatgtttaggccttccccttcctttgaattcgaatttggatgtgatgtctattgatagtggagcaacagaattgagagatttaggactgctaaaaatttaatgaagaattttatgtgaaaaagcccaattcaggcttatacaaaaagaaatacatgtcatattaaaatcattgttaattttgaatgtccaatacagtagtcaatctgtatcttaattaaaattaatacagtatgttacaattagatctggtcagctggaagaatatgaaagatggagttacaaaagagagaaggcttaaacaggcaggaatatattgtataatttcatttacgtgaaatgtacagaataggcaaatctagagagacagaaagtagaatagtggtttccaggaactaggggtagttactgctaaagggttcaaggactgagcatggtggttcatgcttgtaatcccgactgtttgggaggccaacttaggaggattacttgaagctggaagcttgagaccagcctgggaaacaaagagagacttcatctctaccaaaaataaaaataaaaaacttagctgggtgtggtgacttgcacctgtagtcccagctacttaggaagatcgcttgaggccaggagtttggggctgcagtgaaccataaatgtaccactgtactgcagcctgggagacagagtaagtccctgtctctaaaaaataaaaaataacacaaagtgttcaagatttttttagggtgataacaatgttctaatattagacagtataagtaatttcaaactttgaaaataccctaaaaagccactgaattgtatacttaaaaaataaaaaccaaactaaaaaataagtatgtaagagtcagataatcaaagggtttagatgatatgacaagaaatctttaattatttctcttggctgtggatagccaggatcgggttttttagatgtagtaacaataagattagattttttaaaagaaaacttcagcatcagtgtggaaggtgtattatagacagcaaaggacaatcctgaaagtacgacaattatttagcatagacaggaggaaataagggcctgaacaagagcaatagcaatgaatacagaatggaagtaatgaacaacaggtgaggagaaaactaagtggataatataagaatgcatttcagtcatttaacttttgttcccatcaattgtgcattctaagagatgacctaaaacacctatgctttaaaaaattttcatattttttctgtcactgattatatatatatgtatatatttacttgctggaaaaataagatgcaagtatccaagcatgtgagaaacactacccaatgcttggggacagtatttttataccccaaactaaaccttctgcaggtagttttaggtaccaaattaccctctaaattaagatctaactgcttcttgcggaatgcatcaaatctaatttccccatcaaaagaacatctttatgtcagtgatttctttactgaaaccaatcagtgatctcttggaactcctattaagaaaatgctcctgggtactaacaaaatagagtatagcaaatgagctgaaattacttttaactttatcaaatatgtgatataaaggtgttaatgtttattaacatggcttcatgttaatagctccatcaaggatcagatgtttatagcagtaagaattctgtatgattattttacatcttttgctttagacatgagaccatcattaacagggaagaaataaactgatgtcaaaaagaaagaatatgtatatactttgcattttccattaaaatgctaaatttcgtgcacagaaagaaattcagcatgacatatatagctttatatttccatgactgtcttcatacattttgagttatagtcatatcaagaaacttgacttcccttaaacacaatatccactgcctcatttgccgtacttttatacatgatgttatctctaatgggaacataatcttatttcctgcttctttaattaatacttattttttccaatactcaagtaggtattacctcctgtgggaaacgtttcttgattttcttccgtatctaacatgtattaagtgaccttattcagtgtacatataatatactatgcataactattcaacaggtataatattataaagataatattagtttaagatgttgtgtgtgtttgtgtaacttgaataagcttctgtaacaaatagatcataggaggtatagtggcttcaagataaatggatgcttttttctcacctacctaatagttcaacgtgggtggctctgcttcacatagcataacttacgaagctctgcttcttccatcctatggcccctgcttcccctagattttcactgaaatctgcatccatcaggcaagagtgaagaggtagtgaaggagatatagcttcttcttaaacgtctttgtctggaaatggcacatatcacttctacttgcattccagtggttaaaacatcatcatttggcctcaagtagctaaaaaggaagctgaaatggagccttactctgtacataggaagaagaaacattgatttatcttggacagctagcagcaacattaaactgaaagtaattaaactactacattagtcaagctttgggtaggcatgcccagtggggacagagaacagcatgtcagggcccactttgggccaacgcattggtatgatgagtgtcacatatctggaatcaacagttctaactgataaatttgtcttcctttttctctttccctttttgaaagttcagctttcaggtgttgtacacaatatgtaggcagtgggaagtgggcagtgggcagtggtatgtaggggcccagctatgagccagcatattaatacagggaaatgaaattttggggttgtgctttctaaatgtccttttcttcacccttctttctgccctcttttaccttcttcctttccctacttctccccttcctttgtgtgagcttttagccagtacacccaatatggatgtgagtcaaggacactgctttctgctgtcatggtgaggagtttgttaacaacggcaggactgaataaattaggaaattcatttagggtagtggaaaacatatttctcattgttgaaaatgggacttatgaatatggaaaggagatagttttggaatgcaagtagaagcaccagtgtgcacaatgatcaaatatgatagagctccagttaaaattaaaatataaaaacatatagatatacacatatgtgcatattatttgtatacatagatttgcttttttaaatttaactgtttttaacttttattttaggttcaccggcacatgtgcgggtttgacatataggtaaattgtgtgctgtgggagtttggtgtacagattatttcatcgctcagatgatgagcatagaagctaatagttttttgatcttcaccctcctcccactctccactctcaagtaggccccagtgacttttttccccttctttgcatccatatgtacttaatatttagcccccacttataagtgagaacatgtggcatttagttttctattcctgtgttagtccacttaggataatggcatccagttccacccatgttgctgtgaagggcacgatcattttatattttatggttgcatagtattccatggtgcatatgtaccactttttttaaaatccagtttattgttaatgggcatttaggttgattccatatctttttcactgtgaatagtgcataaatagattttttttatctgactctctttagaggacatacatgtaattacaccgcagttatgaggagcacatatagtgtcctattatttgtttctagatactagggagccagagcttcctggggaagagtacctgactccagggctgaggcagggaaaatacaagatgatctggtaacatcctgttgtgccagaggtactctaggggcatgtgcaaaagacataagaaccagttgaaggagcttccactagtcaagtctgggacaaattcaaataagtgataattgacacggcaggagcatcgccatcttggacaagcactgccatcttaaagttccccttgatcaaaaactgcctaaatccaaagggcatcagcctaatggctaaggttagcatgaccataaaccataaatgacatctccgaccagaaacattcgaaccgtaatataaacctctccccaaccagagacatgccagccctgagataacctcccttccaaccagagacattccaaccctgacataaaacttctcccccacacagaaacatttcaagtctgtaataagttccctcaccctaaaaccaatacatactcttagtctataagagagagcactcctgactgaaattggccagaagcccctctcaggtttattctccaaaataaacctgtctttgactgttgagccactttttgtgtttcttttctctttaactcttaacaataataatgaccagttataatattttgagtaaaataagaatttatgagattttactaacataaatggatacatatataaattgggggtggtgctggaattggaagggaattcttccaggccaactaattaatctacaaagaattatggaattaggagattaccacttgataatcatcagtgaaaactcattcaggcagaattcatcaatgaatgccaaatctggtgtgtaaaagactgatgaaaaatggagtattcacatagtctcaaagtaactttccatcaatgcataatgattatttattgataacatacttattaactttctagtgtagaaatctcacaggcaccattaattaaataataaatgttaccatcatcaataatgaaacaaaatcagcatgtataccttctgatatacacactgcaaagagctcagcatcacttctgtggtattcttgccagaaacatacaaatcttaaatataacaaacattacaaatggagtcacattctacacagtaactaggctaatttttaaaaatgttaggaccattaaagacaaagaaaaaataaggaactattccagattgaaaggtattaaagagatatgacaatgaataaaaccactgattatggattggctagtgggcctaaaaagggtatatctgggataattaggaaaatgtaagtggggtctgtggaccagaaaataatattgcatcaatacttatttcctgattttgatggaaacattgtggctatgtggcaaaatgttcttgtgcataggaaatatatattgtagaattaagaggtatggtaggaagaataatagcccctaaaggtatcaggttctgaaacctacacctgtttaagtgttgtcatataacaaataaggttctttgcagatgtgagtaagttaatgattttgagactgggagattatcttggattgttcaggtgggccctaaaataccaccacaagtgctcttatcagagagaggcaaggcgatacttaatccagacagaagaggaaaagaaagtgttaagatggaggcagaaattgggttaatatggaggcaagccaagaaacattgataaccaacattagttgaaagaagcaaggaacagatctctctctggaggagacccccatcctgccaataccctgatttcaatccaatgaggctaattttggatttctggtctccagaaccatgaaagaataaatttctgttgtttaaatccaccaagtttgttgtaatttgttaatgcagccacaggaaactaatacaaggagtaatggggtatcataactgaaacttactcttaacatttttgaaacaagagaaatgttaacaaggaaatctgggtgaaagttatacaacaggtccctatattttttcaatttctatgtaaattttaaattaccgaataatgcttttaagaatttaaaaattagaagattaagtaaaggttaaaagctattgcctggataacatgaaatgggaggaagatcaacactttctagagggattcagacattcaatattctactattttatcctctcaaaatgttggcctttatcctaaagctatttatttcctagttctaaagtggctatagtatctacagatatcatatttgttttcaagatcagaaagagaatagagaaagatgataaaggttcatgccagttgaacctgtgtcttttttatcaagaaagcagatgttgttttaggtatctccagaaaatatttgtttaaatcttggtagccagaactatacccaactgtgagggaagctgtgaaggtgggcatttgccttcccagcttctggagtagatatgaaaatggagaaaaagattgaaaaacatctgttgagttggctaacaaacagtgttatctccctggcaatagagatagatagatagatagatagatagatagatagatagatagatagataatctgtatttagagagcctagcacaatgctttaaatatatgttcaataaatgcttataatattaattggtgtatgtatgaatgaatcataaatggatgaattaaagaatcttatattccaagtttatattagccatgtgaataaatgtcagctttattagagcatagtccccaatatagaatcatttcagaataccttaacaccctaggccatcatttgtgtttcagtttgtaagttttacattctatcatgattttttgtcttagattttcttttgtgtgcccaattttatggtattacattaaaaccgtatcaacttttagcatgaattgttacaaaaatctcttatctctcatctctttaatgtcttctctctcaccccattaaatgaggtaagtaagtaggaacatactagaaagaaaaataggaaagacaaaacttggtaaataattaggtgtaagaagtgattcataagaagtagtcaatcaatattctgaagaccttgtcttagataattgcagtggatgggaatatcaaacacagaaagataattgagaagacttatcatgtaaaactgatgagtgctgttttagacataaggagtctgatgtgtcaatgggacatacttgtgcagataaatatgtatttgagaattagacgtttaggacttaaattaagagaagttagaacaagagatataagtttggtattcttctgcaggtaggtgctagttaaagcttgtgaatagataaaatttctcaaatatatcatataaagtataaagaaagaggactatgaataaaatcttgacgtttcacaaaccgtgatggcagccaattccagcactgggagaaacaatctggtatagaggaagggagtgagaagacatcatttctttttctgatacaaattcaatatgcaatttacattaatgcttctcaaactgtagtgtgaacaaaaattatcttgaagtcttgttaaaacacagattttcaggtcctatttccagatattctaattcaaggggtttgaaaggatgccagggagtttgaatttctaacaaactctcacatcatgctgatgcctcccacctaggaccacccttcattatatctcaaagctctaaattaaaccttcttactcacagtgtggcccatgggccagaaacattggcatcacctgggagcttgatggaaatgtaaaatcctaggctccaacccagatctactgactcagaaactgccttttaacattatccccagttgactcatatgggcatgaatgtttgtgaagcactgccatctaaatgtattatataacatgttgtttcatttctgttaaaatgacaatgttggtctcattttgattccaacatactatgaggtaaaaaattaggctttgaagccaaacattggtaagtcaattgtgcctccactaaccttagtttccccatgtataaaatggagatcataatagtgtcctcccttggttataacaagaatgaaataatgttatgaatataatgtgcctagcttccatttgaacagagagctatggtctcacgttggttttacactttcacatgaatattcaggttgcagctagcacatggctgcttgtgaaattgcttatttgttatgttggttccacctatttgattagttaatttgataaatttaatgatgctttaagtgaaatgattccagttaatgattattgattttaacctcaagaagaggaaaataaaattgattcctaggtaattacaacttaaaatacatagagtgtgtgcagatactgactgattaaatataatgaatatttaaaaactgatataaaattgtgaccaagttggagagaatcggattgtggttgtgacagtaattaaaacaaaaattgagacctggctggagtgtacttcggtctcgtgaatcttgcgaatctaccatttcctctcctttcttcaatgtcactttttttatttctcaaatagaactatggtagcctgaatcttatcttccaaaggttttgtttctttatccaataaatagatataatatatctaatacatggggttgttgtaagaaaatttaaaaatccaagtgctgaacacagggcttggcaaaaaaaaaaaatgaattaataattgctgttattatgtaaattttacccataatagatttgaggaggaggttgatgatgctgagtttttcaacactgtattctttaggattagtagcactctattatatacagaagcaacactcaataattgtttgctgaattgagcatccagagtaagtttttatattgtggtagttgcaattaagcagtaaatctgacacacacacaaattgttttttcagagataaaaatggaagttcttttatgctgctagtgaagacttaacttcctccaactcttttctataaatacaaaaaaaaaatacttagatatgctattttttcctgtatacttagcatattccccttaaataatactgttggaaagagaaaaaatgaataatgtcatccctagtaaactagtcaatattgagggagaaactctcagtttaattttctaatagatcatataaaactctatttctcatgtggggagatttagagtctagcaagattttattctcaaataatagattcatttgaagagattaaaacaagtctttgtcaaaatgaaggaacatttttaaatgaatttgagaaattcatcccaggtgatttaacataaaatatttttgtttctatttttattttatattatattattttattttattttatttttttgagatggagtctcgctctgtcacccaggctggactgcagtggcacgatctcagctcactgcaagctccgattcccaagttcactccattctcctgcttcagcctcctgagcagctgggaccacaggcgcccgccaccacacccagctaatttttgtatttttagtagagacggggtttcacagtgctagccaggatggtctcgatctcctgaccttgtgatccgcccacctcggcctcccaaagtgctgggattacaggcgtgagccaaagtctttaaaaaactgagttcattaacaaaaataaagttccattcggaacgcagaaatttaaatttccaaagtattatctacttgctatcagctatgaaggtcttaaatatttgaagtggtgtcatatacaagaatttgagactagctcaaaataagtgaccacagcaggtaagaagcacatttctgcaagtgaaagattaagattttaattcaagatttcatattttgttgccctggatattcaaggagaagccacttgctatagagggaaagacagatgcaacatgcatagaattacctcaaaattctgtgctgcttatgacaattgacatgaatgttatttggcatcacaatgccctggtaaatataggtagagagaacaattactttctcttgcacatcaacacacctcccttgtcaacacatacaaactcatagtaatcttgcacaaaattgttttattaccctttcattcagcatttctgcttatacatccttaagtatatcatctactttattgggtatcatatagaaaactgcgcattttcatttgtagtagatcagtttctgctccacttgaagccaaccttcctcacaattagcctgctctaaaatacaagataaataagtcctaggtatttactgtacaaatatagtgcctgtagttaatgttgtattgtacatttaaacacttgcaaagagggtagatcttatgttaattgttctgtcacaaaaagtaataataataaacaagaaagctggaagaaacttttgcaaatgatggatatatttatggcattggttgtgctgatggtttcatgggtgtatatttacctccaaactcatcaagttgtatccattaattatgtacagcaggggtgtctactcttttggcttccctgggccacactggaagaagaattgtcttggaccacacatcaaatacagtaacattaacaacagcagatgagcttaaaaaaaaaaaaaaaaaaaaaaaaaaaaaaaaaaaaaaaaaacctcataatgtcttaagaaagtttatgaatttgtgttggggagcatttaaagccatcctgggctgcagtcgcatgtggcttacaaggataagggttggacaagcttgatgtacagtattttgtatgtcaagaaattaaattttaaaaatgttgaaaatataaaatgttgatgttggagagaaaaaaaaaagcagctaatattttgagcaccttgcatgtgccagtaaccatagaaaaagctttctgttacgtcatagaatcctcccattctctattaggtatctattatctccattttgctaatgaggtaactgatgctcagagtagggaacttgtcaaagacacacattcagtgagtggaagagccgagattgaacgcaggattcctaacttcaatttgtatttctttaagattgcactctttactgtgtgagaaaagacataaatactatagagtgtatcaaaatccttcatacacctcctaccgtctttaaaacagacctagttttaagaaaaattcatttcacaaagagccataatttttcatcttcttgttcagcaatgcagtttcattcctgatgctgctattaactcttaaataatctaaacctaatgaataatgggaaagtcacaggcaggtgaaaggagaattggggccttggaattctcctgtgatgagtaattagtttatcctgagaaaaaccagtcttttaaaacaacagtagcctctcaagtcatggagggtctaactagtctcactatcatgatttcataacgccgggagggtttattgaacttttgattccaaaatgtaaacaaaatgattttttgaaacactggaaccaaatatttcctggaataagaaaatgcacatttattctctaacttacatattaatacatatatcaagtgacaaatgttctgtgagtctgacataaatttccaagtcattacgttacaggtattacaaaaatattaatcctttctaggagactatcttatttgtgtcaagactctttagagatgtctgattattgctgatctgttttgtgagtataccatgccatttgctttttttcagggcccatcttactatttgtagaaaagccttcagctttgcccaaagttgtcttttgcctcatctgtttaatattctggttctgactttctctgtgcttaggtctgatgcttctgtgaattcctgtctgtggctctcctgtgctgcagtagagagaggagtactttatactcctttctttgtggaaaaaaaaaatcacttcctaataggggcttgagccgaaatcaatgagtaactgagcagacatgtgagacagacattaacattttttttttaaacactgttgctgttgagtcacggtctttctaattcccagattcttattgaagacctcacattggcctaaccagggcaaaaagcttggaaatctaaggcattttattgcatgggctatttacccaataaaggactatacaattttaaatgttggaggtaaagaaatgtgggagattctgaagatatgatcattgggagataaatagagtcttagtgtgcggaggttggattttgcagacttctatccacagactaattcttcagtgcatatttttagaattgcctcctagttttataattgaaaaaacacagctgaaaattttggaaatattaatcagaaatacaatatctctattacctactcaattaaaatggctaaaaataagcattcaaattttggtaaatgtgttctgagtagttaacaaaaaataaattatatctaggcaatgtttgttaatgaaattaagagagtcctaagtgaatgtggtttctgaacattaagcaggagagagaactattgatgtcctcaacctaatcactacctcatgttggtgaaatatctaaaatctaagaaagagctaagaaatgcactcctaaaaagttagtttaattaaataaaagtgttcttattttttctagtagtttttccattataaaaatgatataacctggccgggtgcggtggctcacaactgtaatcccaacactttgggaggcagaggtgggtggatcaccaggtcaggagatctagaccatcctggctaacatggtgagcccccgtctctactaaaaaacacaaaaagttagtcgggcgtggtggcaggtgcctgtagtcccagctacttgggaggctgatgcaggagaatggcatgaacccgggaggcagagcttgcagtgagccgaaatctcaccactgcactccagcctgggcaacacagtgagactctgtctcaaaaaaaataaataaataaaaataaaaggatataacctgacctgtagtagttcagttaatagtatcataccaattgtttggacaaatggtgatgtaaaatatcattaaggaaaactgaggtaaggatatatagaaattatctgtactatttctacaacttttcttaaaactaaaatagtccctaatcagaaaaaaaaaatgagttttttaaaaaaatctatggttaggaactattttttgcctatattctcttctcaaagataaagatgttaatctaggcatacaaggtactctgtgatctctgcctcttcaacctcatttcatcaatgctttctttcatttggcttcatcaatatatgcacgtgtttgttctatgccatacactttgttaatattttagataggccactgcattcaaacattatatgaacctttttacccaaatattaaacatgaggaaactgaagctcagagacattaggtaatttatctagtgttacatatattcaatgaaacatcaatatgtacaagtctgtgacttccaaacctagactcaaaactgtccagattaaaataataataatgaatcagtataaagttaaatttttaaatggcaaaaatttcacatggaagcttaatctagttaattgtgatctttatgctatttacagacaaaacattggaatggattaccaaaggattgctctccaaactatgagtcaaggagagacagtcattcgttctggctgatttagacatttattagtcagaaatagtatacacaaaaaaaattatttctctaccccccaccttgccataaacaactgggttcttagtttcagattataaaattgaaatacctaattgatgtttaagtgaaaagaacacagaatcaggagtcattgaactgaagttcgtatctcagctctgccctcaaattctggttaccttctatagccctcactttcttcatctgaagaattagaataagtccttatatcacagacagctataagggttaaattagatcaggcaaataaattgcctacaggagaaattggcatctaggaggctgaattaactttgaacctgagctgtatcttaatattgatcagccatgttagttttttcttcccttttgtattcctacaatgcaagataacttgaattttctatcctcaatttattatgatgtattgctccaacatgtaaaaaaccttagggaaagcaaagtgacatttcaaaatcctgctgttggtattgggtaaccaatatttttgcaagtcaaatagattccaattttttgtttctatcaaaattgaaggaaaattcaacagatgatcagctggtcactaaaattattttctcatgttcatcatgtgatttttggaaaatagaaagaattaaaaacattcaatgtcactgcaatagaatttcttctagcctacttgttcatttatgtgaacagtatttcatagcccttacatttataatacaatctaaaaaatacaaataagtgatatataaacctttagcttacataagtctcaattctaataggaagtaataattatctatggatccatgaatcatttggaaaaagaactccacccatcttataaaaatttgtcattgccaaattattttatctgtaataattcttttaatttgtaatatagttataatgttttgatcaatttaatactaaattatttatgagaataatactgttcaggtttttaaaatacagggaaatagacacacacatatatacatgcacctgtacacacaatttatctattttttgttttatacacacacaataaatctttaaaagtatatcttaaattataattaaattttgtgaaagaaatgtaatgaaaatacaaattatagaggaatattaatttttaactgttaaaatcagtacatttgtactgatttccatcttatatagaagttggccgggtgcagtggctcatgcctttaatcccagcattttgggaggccgaagcgagtggatctcctgaggtcagaagtttgagaccagcctgaccaacatggagaaaccccgtctctactaaaagtacaaaattagctgggcatgatggcacacgcctgtaatctcagctactcaggaagctgaagctggagaattgcttgaacctgggaggcggaggttgcagtgagctgagatcacgccactgcactccagcctgggcaacgagagcgaaactccgtcacacacacaaacacaaaatttagctaatctttacaggcatgatatagcctcctttttcaatgtttctttggtcaggtattcaaattcacattttttaagtgtatgctataacaataacagacaaatctggactactgacataaatctgttggattatatcattacaattttttcttcctcatagcaattctcttactactttacattcacacacaaataaaactctattgtctccttagttgtttctcaaatttatcttaattggcacctaaagagttcatgtgcatagtaactacagttatgcaccacctattgccagaatgttttggtcaacaagaaatcatatatgcaaaggtgatcccataagattataatgaagccgaaacattcgtattgcctagtgatgtcatagttattataatgtcatagtgcacctcatcactggtgtttgtggtgatgctggtgtacaaacctcctgtgctgccagtctcacaaaagtcttttttataatatctcataaaatctaacacatacagttacatacagtacctaacactcattaatgacaataaatcactatgttactaatttatgtacttctgataatatactttatactttttatcattattttagaatatactccttctgcttgtgaaaaaagttacctgtaaaacagccccaggcaatctatcaggacgtattccagaataaggcatttttaccataggaggtaatgcccccatgcacattattgcccctaaagattttacagtgagaaaagtggaagacagtgatatttacaggtcctgattctttgtagaccgaagctaatgtgtgtgtttctatctcagtttttaacaaaaagttaaaaaataaaaacttttaaaaatattaaaaagcatatagaaaaggaatataaagaaaataattgtgcacagctcttcaatatgtttgtgtttaaagctgttattatgataataaaaaacttaaagtttataaagtaaaaaagttacagtaagtttattattgtaaaaaggtgtcttaataaatttagtatggcttaagtttactgtgtttataaagtccacagtagtacagagtaatgtcctaggtcttcacattcacttgccactcaccaactcaccagagtaacttctaatctttcaagcttcattcatggtaaatgacctatacgggtgtaccattttttatcttttatattgtatttttactgtaccttttctatgtttatatatgtaaacacttatcattttgttacaattgcctatagttttcactacagtaataggctgtacagatttgtagcgtaggagcaataggccataccacatagcacaagtgtagcgtaggctatcccatctaggtttatgtaagtacactctatgatgttcacaggatgaaactgcctaatgttgcatttttcagaaagtatttccactgttaagtgacatatgactataaatgtatattatgcagctaattagcaatatctttattatcttaactctgagaattaccttcctaaatttaaataaagattataaaattagaataaatgatattcactttaaacttgtaagacctatatatttttaatcaaaaagggttaaaagtttatgtaacattcaaacggtttattaaagctataggagaaagaaaggtatttatttgaattacagcactgctggggaaacagagagacagcacttggatgttttcattttccagggcatcatatactaaagaatcattccatctaatttcttcaaatctcaagaacacacacctggcaaatcatgaaaataaattttatgttgttatcaatgatatttttaaatgccattttaataatttgactcactttttttctaatcacagtattatgtgtatcatcaatctggtactcaattttactccattccacttaatcatttattaagtcctttgatacaggtacagtctaagaaataaatacacaagagccataaatcccactctaaaggaataaagcctgccattccactctcacacccagttctcttaatctcaccatgttttttaagatttggttgcagtatcatcatttctctggaaaaactattttcatacccacaatcctaaaggttagatgccataactcatgctcctacatatataaccaattttgtttatttatttttccccagactctggcaaattttaggtacataataaaaatcctttgaatgatttcattttagtcacaattaagagaatggaaaaaattataggtgattcttctgagtataaactaagagtcaagctattagagaagcattccctaaagcaatcaagataactaaaggcacaatttattgtctgtggatcacagttgagcttaccccatgagtcctcgtatactgatctcatgaaaactcatgtatgcttcggactatgttttaataaacaacactttctgacataaaaaaaattattaattaaaatgaagtcctaatcataccaagaacaccaaatgtttcacttttccatattaagtttaaattcagcagttttcaaacatggccaaggatgcctttggtgtccccaagacactttcagaagatttgcaatgtcagtattattatcatagcaacactaaagcattttttgtccttttctactgtatggatgcttgcagatgcaagtatgcacatcaatctatgtcaaatagggttagctaacaaaataatacaagtgaaaatcagggtaagttatcaaaacataactgctagtgtgtctaaaatgcaaaattacaatatcaatcatttatatattgctgatagtagtataaaatagtatgtccaactctggaaaacattttggcagtttcttaacaataataaataataaataaacattccaccactatacaacccaccaattgcaatcctgggcatttatcctaaaaaatgaaaaattatatttacatataaatgtgtacacaaatgattatggcaggcttattacagatatccttaaatggatgaacgtttaaatgaccatggtacatccatctcatggagtactattaggtaacaaaaaagaacaacctattgatactaatatatacaacaactaatataatctctagagagttatgctaagtgaaaaagccaaaggtcatatattgtatggttcaatttatataacattcttgaaatgacaatactatagagatggagaacagattggtggttgacaaggttcagaaaaaagagaaaatggaggaagtggtgtggctataaaaggataacatgaggtttcctagtggtgatggaacacttctctttcttaactgtattaatgtcaatatcctggtggtgattttatactataattttgcatttgtatattttctttggaaagaagtctttgggaaaaaatgtttattcaactcttttgctcatttttatttgggttacttgttttttgctactaagttgtatgggtcccttacacatttttggtattaaacccttcctagatatgtggtttgcaaatatcctcttccaagccataggttgcctttttattttgttgcttgtttcctttgctgtacagaaattttggtttaatatagtcagatgagtttatttttgcttttttttttttttttttttgcactcttggtatcatatcctcccccaaaaatcactgggaagaccaatttcaagaatctttccttctagttttcctatagaagttttatgttttcacatctcacatttaagtctttaatccacttctagttaatttttgtatgtaagacaagagtccaggcctggcatggtggctcatgcctgtaatcccatcactttgggaggctgaggtgggtggatcaagaggtcagatcaagatcatcctatcgggggaaggagccaagatggccgaataggaacagctccggtctacagctcccagcgtgagcaaggcagaagacgggtgatttctgcatttccatctgaggtaccgggttcatctcactagggagtgccagacagtgggcgcaggtcagtgggtgcgcgcaccgtgcacaagccgaagcagggtgaggcattgcctcactcgggaagtgcaaggggtcagggatttccctttcctagtcaaagaaaggggtgacccacggcacctggaaaatcgggtcactcccacccaaatactgcgcttttccgacgggcttaaaaaacggcacaccacgagattatatcccccagctggctcggagggtcctacgcccacggagtctcactgattgctagcacagcagtctgagatcaaactgcaaggcggcagcgaggttgggggaggggcgcccgccattgcccaggcttgcttaggtaaacaaagcagccaggaagctcgaactgggtggagcccaccacagctcaaggaggcctgcctgcctctgtaggctccacctctgggggcagggcacagacaaacaaaaagacagcagtaacctctgcagacttaaatgtccttgtctgacagctttgaagagagcagtggttctcccagcacgcagctggagatctgagaatgggcagactgcctcctcaagtggatccctgacccctgacccccgagcagcctaactgggaggcaccccccagcaggggcacactgacacctcacacggcagggtactccaacagacctgcagctgagggtcctgtctgttagaaggaaaactaacaaacagaaaggacatgcacaccaaaaacccatctgtacatcaccatcatcaaagaccaaaagtagataaaaccacaaagatggggaaaaaacagaacagaaaaactggaaactctaaaaagcagagggcctctcctcctccaaaggaatgcagttcctcaccagcaacggaacaaagctggacggagaacgactttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgcgaagaatgcagaagcctcagtagccgatgcaatcaactggaagaaagggtaccagcgatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgacggggagaatggaaccaagttggaaaacactctgcaggatattatccaggagaacttccccaatctaacaaggcaggccaacattcagactcaggaaatacagagaacgccacaaagatactcctcgagaagagcaactccaagacacataactgtcagattcaccaaagttgaaatgaaggaaaaaatgttaagggcagccagagagaaaggtcgggttaccctcaaagggaagcccatcagactaacagcggatctctcggcagaaaccctacaagccagaagagagtggaggccaatactcaacattcttaaagaaaagaattttcaaccaagaatttcatatccagccaaactaagcttcataagtgaaggagaaataaaatcctttacagacaagcaaatgctgagagactttgtcaccaccaggcctgccctaaaagagctcctgaaggaagtgctaaacatggaaaggaacaaccggtaccagccgctgcaaaatcatgccaaaatgtaaagaccatcgagactaggaagaaactgcatcaactaatgagcaaaataaccagctaacatcataatgacaggatcaaattcacacataacaatattaactttaaatgtaaatggactaaatgctccaattaaaagacacagactgacaaattggatgaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgatgaaacagactttaaaccaacaaagatcaaaagagacaaagaaggccattacataatggtaaagggatcaattcaacaagaagagctaactatcctaaatatatatgcacccaatacagtagcacccagattcataaatcaagtcctgagtgacctacaaagagacttagactaccacacattaataatgggagactttaacaccccactgtcaacattagacagatcaacaagacagaaagtcaacaaggatacccaggaattgaactcagctctgcaccaagcggacctaatagacatctacagaactctccatcccaaatcaacagaatatacatttttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcactcaaaaccgctcaactacatggaaactgaacaacctgctcctgaatgactactgggtacataacgaaatgaaggcagaaataaagatgttctttgaaaccaacgagaacaaagacacaacataccagaatctctgggacgcattcaaagcagtgctttgagggaaatttatagcactaaatgcccacaagagaaagcaggaaagatccaaaattgacaccctaacatcacaattaaaagaactagaaaagcaagagcaaacacattcaaaagctagcagaaggcaagaaataattaaaatcagagcagaactgaaggaagtagagacacaaaaaactcttcaaaaaattaatgaatccaggagctggttttttgaaaggatcaacaaaattgatagactgctagcaagactaataaagaaaaaaagagagaagaatcaaatagatgcaataaaaaatgataaaggggatatcaccaccgatcccacagaaatacaaactaccatcagagaatactacaaacacctctatgcaaataaactcgaaaatctagaagaaatggataaattcctcgacccatacactttcccaagactaaaccaggaagaagttgaatctctgaatagaccaataacaggatctgaaattgtggcaataatcaatagcttaccaaccaaaaagagtccaggaccagatggattcacagctgaattctaccagaggtacaaggaggaactggtaccattccttctgaaattattccaatcaatagaaaaagagggaatcctccctaactcattttatgaggccagcatcattctgataccaaagcctggcagagacacaaccaaaaaagagaattttagaccaatatccttgatgaacattgatgcaaaaatcctcaataaaatactggcaaaacgaatccagcagcacatcaaaaagcttatccaccatgatcaagtgggcttcatccctgggatgcaaggctggttcaatatacgcaaatcaataaacgtaatccagcatataaacagagccaaagacaaaaaccacatgattatctcaatagatgcagaaaaggcctttgacaaaattcaacaacccttcatgctaaaaactctcaataaattaggtattgatgggacatatttcaaaataataagagctatctatgacaaacccacagccaatatcgtactgaatgggcaaaaactggaagcattccctttgaaaactggcacaagacagagatgccctctctcaccactcctattcaacatagtgttggaaattctggccagggcaattaggcaggagaaggaaataaagggtattcaattaggaaaagaggaagtctgattgtccctctttgcagacgacatgattgtgtatctagacaaccccattgtctcagcccaaaatctccttaagctgataagcaacttcagcaaagtctcaggatacaaaatcaatgtacaaaaatcacaagcattcttatacaccaacaacagacaaacagagagtcaaatcatgagtgaactcccattcacaattgcttcaaaggaataaaatacctaggaatccaacttacaagggatgtgaaggacctcttcaaggagaactacaaaccactgctcaaggaaataaaagaggatacaaacaaatggaataacattccatgctcatgggtaggaagaatcaatatcgtgaaaacggccatactgcccaaggtaatttatagattcaatgccatccccatcaagctaccaatgcctttcttcacagaattggaaaaaactactttaaagttcatatggaaccaaaaaagagcctgcatcaccaactcaatcctaagccaaaagaacaaagctggaggcatcacactacctgacttcaaactatactacaaggctacagtaaccaaaacagcatggtactggtaccaaaacagaaatatagatcaatggaacagaacagagccctcagaaataacgccgcatatctacaactatgtgatctttgacaaacctgacaaaaacaagaaatggggaaaggattccctatttaataaatggtgctgggaaaactggctagccatatgtagaaagctgaaactagatcccttccttacaccttatacaaaaatcaattcaagatggattaaagacttaaacgttagacctaaaaccataaaaaccctagaagaaaacccaggcagtaccattcaggacataggcatgggcaaggacttcatgtctaaaacaccaaaagcaatggcaacaaaagacaaaattgacaaatgggatctaattaaactaaagagcttctgtacagcaaaagaaactaccatcagagtgaacaggcaacctacagaatgggagaaaatttttgcaacctactcatctgacaaagggctaataatatccagaacctacaatgaactcaaacaaatttacaagaaagaaacaaacaactccatcaaaaagtgggtgaaggatatgaacagacacttctcaaaagaagacatttatgcagccaaaaaacacatgaaaaatttctcatcatcactggccatcagagaaatgtaaatgaaaaccacaatgagataccatctcataccagttagaatggtgatcattaaaaagtcaggaaacagcaggtgctggagaggatgtggaaaaataggaacacttttacactgttggtgggactgtaaactagttcaaccattgtggaagtcagtgtggtgactcctcagggatctagaactagaaattccatttgacccagccaacccattactgggtatatacccgaaggattataaatcatgctgctataaagacacatgcacatgtatgtttattgtggcactattcacaatagcaaagacttggaaccaacccaaatgtccaacagtgatagactagattaagaaaatgtgtcacatatacaccatggaatactatgcagccataaaaaatgatgagttcatgtcctttgtagggacatggatgaagctggaaaccatcattctcagcaaactatcgcaaggacaaaaaaccaagcaccacgtgttctcactcataggtgtggattgaacaatgagaacacttggacatagcaaggggaacatcacacaccggggcctgtcgtggggtgggggaggggggagggatagcagtagaagatataccgaatgtaaatgacgagttaatgggtgtagcacaccaacatggcacatgtatacatatgtaacaaacctgcacgttgtgcacatgtaccctagaacttaaagtataataaataaaataaataaaataataaaaaaataaaaaataaataaaaaaaaagatcatcctatctaacatagtgaaacccacctctactgaaaatacaaaaaaattagctgggcatcctggcgggcgcctgtagtcctagctcctccgtaggctaaggcagaagaagggcgtgagtccaggaggcagagcttgcagtgagccgagattgtgccactgcactccagcctggaggacagagtgagactctgtctcaaaaaaaaaaaaaaaaaagacaagtgtccagtttcattcttttatatatggatatccatttttcccagtggcagttattgaggagacttttcttccatcattgtgtgttcttggtacccttattaaagattagttgaccatatatgtgtgtttaactctgggctctctattttgtgctattagtaaatacgtctgttttgaactgagtaccatactttctaaattatagtagctttgtaatatagtttgaaatcaaggaatgtgatgcctccagctttgatctttctcaaaattgctttggctattcagagtcttttttggttctcaaagacaaactgtttctgtgtaaaggtaatgtaatattatatatagaaaaccctaaagaccccactgaaaagatatgagaactataaatgaattcagtaaattttttttctggttttatttctggtgtttttagtttgtttgttttttgagacagggtctcactctgttgtccaggctggagtgcagtgatgtaatcatggctcgctgtagccctgagatgcagtgatgaagtgatcctctcaccttagcctcctgagtacgtggaatgacaggcttgagccaccatacccaactagttgttttgactttttgtagttacctccatatgttgcccaggctggtctcaagctcctaggctcaagcaactctctcgctttggcctccgaaagtactgggattactgatacaaagcactgtaccaacctcagtaaagttttataatataaaagcaatatacaaaaatcagcagcattcagttactaacaatgaaccatcccccccaaaaaaaataagaatataatcttatttaaaatagaataaactataaaaagaattaaatgcttgggaatatatttaaccaaggaggtagaagatacatacaaggaaaacaatgagacactgatgaaagatatttaaaaaagacacaaataaattaacagatatcctgagttcatggattagaagaattaatattgttaaaatgttaatattactcaaagcaatctacacattaaatgcaatccctatcaaaattccaatagcatttttcacaaaaagagagaaagtatttttaagtacctggtagggtgcctgacacaaaaacccattattattatttatcactttaactgattatatatatatatatatatatatatatatatatatatatattacaattgctgcaaagtattgatatgacaataatatagacattgtgaatcctctgagagaatcttggagacagcagagttagccatggtcattctttgaaagccactgaattaaagcattacagaaaaaaaaaaaaaaaaacagtaaaacactttgttggtgttcctgggatgatttggatttaactcagattaagattttaatttactttatatcagaaagttctttttgttttgttttgtttttttacaaaatcattgtctcaagtatgtatgaggttccataagatcaagatccaaggactggtgggggttgaagttctattgatatctatagagcttccctgttactgtacattatggttttagttatcttaattgttttagggaatgcttcacctatagcttgcttcttagtttatcctcataacatttacctatgctttcattccttcccataaccataactaaaatgaaattatttaaagaatgtttattacttacctataaattgccaaaccctggagataaagaaatgagcaaaatggtctagctgtagagctcctaaactttgagaattgtgagcatgagcctggttagaaaaattcccagaacaatgatgatactgaaactaagctttaaaaatcatagagtaatttgaggagagaataggagacagttattatagcatccacatgtaacaagatatgaaataagagatccagcaagaattggttgtacagagcaaaagtgaacatatgagttaaaataaggccagtgaccaggcacggtggagcatgcctgtaatcccagcacttcgggaggccaagggaggtggatcacaaggtcaggagatcaagactatcctggccaacatgatgaaaccccatctctactaaaatacaaaaaattagccgggcgtgtttgcaggcacctgtagtcccagctactagggaggccgaggcagaagaatcacttgaacccgggaggtagaggttgcaatgagctgagatcatgccactgcactccagcctggcaacaagagcgagactccatctcaaaaaaaaaaaaaaaaaaaaaaaaaaggccagtgaagtacatggtataaggtactgaagtggtgtgcaccaatgttgtagaatatattcttgggcaaggacaattaaagattctctggacttgacaactatgatggctgctgcaatctgtaggatgtaaatcatttgacattttctaaatatcagttctcatttctaatgatatgattgaaaaatggtatataggttgtatcagacatgtgaagggtacccagcaaaactcaaatcttgaaattccaaataaaatatctacaaatgtataagaagaatgattacatattggggctctgggcatggaaagaggaagaaccatatggctgctttcctcacctgaatccttcatccaaagactttccagaaattgacatctccctcagaaatggtcatcaaaaccataaccaaagaaagaaaaaagaaaagaaaaaaaaaagaaaaacctcacagagaaacaagagtatatagctgctagtcaaagtaaatgtatgcttgtatgagatcttacagcttcacgttttttaggacagttttaattatcacccaacgtattagtttcacagttcaactcagcatgataaaccctgtgggataattttactacaaaatggcctattttccatacacacaatttgattacagctgtgtctttatctctgaaatccatgagaaatatgttcttcctttggagaagaacaatactgataaacttccaaaggacatctctgagcacttctgaagagaagaaatggtatttggtgtacttgggcttcataagccatgcaacacaaatcaagttataacaattctgacactatctatggctgcaactaattacttgtcaaatttgaatgatgatacatcaggtcattatactacagaatgataaaaaagaggacaacccaatcctaaagttatatgcaaccaacaacaaatcttctagtaatgtgaagcaaaagctgatacaatttaaaagaaaaagggacaaaaccacattttagtggggtacttccatgccacgctctcaaaaattgacagaactagacataaaatcagtaaggatatagacaaacatatctagtaaaacatctaattggcatttatagaacattccatccaagagaagaatacgttcttctttttcacgtgcctttggaacatacactaagatagaaaacaaaccacaacaaacttgaaagacttgaaatcatgcagaatgtgttgtttgaccacaatggaatcaaaacataatcagtaacagaaagataccaagaaaatctcaaacacataaatattaaacaatacactgctaaataatctacatgctaaaaaggaagtatcaagatagaacttttttaaatcattgaactaagttgacaatataacaaaatttgtggaacacagctaacacagtgctgagaaatgaatagcattaaatgattttattagaaaagaagaaaatctctggatgggtgcagtggctcacacctgtaatcccagcagtttgggaggctgaggcaggtagatcacctgaggtcaggagttcaagaccagcctggccaacatggagaaaccccagctctactaaaaatacaaaaaaattagctgggctttgtggcaggtgcctgtaatcccagctacttgggaggctgaggcaggagaatcacttgaacccaagaggcggaggttgcactgagccaagattgcgccactgtactccagcctgggcaacaagagtgaaactctgtctcaaaattaaaaaaaaaaaaaaaaagaatgaaagaagagaaaaatcttaaatcagtagcatgactttccacctcaaaagaaagagcaaaataaatgcaaagcaaacagaaagaaaataataaatataataacaaaaattaataaacttgaaaataaaaaatagagaaaatcagttacttcatttaaaaaaatcagtaaaattgacaatcctctaagaagactgaaaaaaatgagacagagagagagaggacatgaattcatgaattaccaccatcatgactgaaatgtgcaacatcaatacagagccttcaaatattaaaggaatagtaaggggatactacaaatagcgctacaaacacatacttgaaaactttgaggaaattaatcaattccatgaaatgcatagacaatcacaatttactcaaatacttaaatataaatagataacttcaacatcctataactattaataacattgactttataatgtaaactcaaaaaagtcatctccaggccaggatgatttccctggagaaatttatcaagcattaaggaagagttcaaatatattttatacattctctttcagaaaagagaagagtagggagtacttctcaatatgctttatgaatatagtacattcatgataccaaaaccaaagaaagtattccctggtatgaaaactaataacaaaaaaaaatgagagggggcaggagaagaaaaatatgagaggcggagagagaagaaaaatagtaaagagagagagaggagaagcgagcagtaaagaaggaaggaaggaaggaagagggggagggagggagaaactaccttgcaaatataaccacaaaagtttttaacaaaatattattaggtagaattcagcagtacataaaaacgaattcagcagtttatacaccatgaccaagtggtgtttattccagggatgcgaggttggagtgatatttgaaaatcaatcaatgtaatataccatatgacatgatcatatcaatgaacgcagagataccatttgataaaaatcaacataaattcattgatttaaaaaacccaactctcaggaatataggaatagagagaaattactcagcttgatgcttgataaagagcatctccaaaaaaccagcagtaaatgttatacttcatgttgaaagaccaaatgctttagtctaagattaggaacaaggcaaggctgaccaatcttcccattattcaaaatagcactagatgttctagccagtgcaacaggcaatataagtaaataagaggtaaaactaagattagagatgaagcaataaaactgtttccattaggagatggcatggcagtctaaatagataatcccaaggaatctacaaaaatactcctaaaactgacaagtgagttcagcaaagcttcagtattcatgataaacataaaaatcaaatgtatttttatatactagcaatgagcatatggacattgaaaataaaaaattaccatttacaatcactaaaaaatggtgtataaatctacaaagtatacaggctttttctatatatagacaagattattctaaaatgcatatggaaaggtaaaggaactagaatgccgcatgtctacaactatccgatctttgacaaacctgacaaaaacaagaaatggggaaaggattccctatttaataaatggtgctgggaaaactggctagccatatgtagaaagctgaaactggatcccttccttacaccttatacaaaaatcaattcaagacggattaaagacttacatgttagacctaaaaccatcaaaaccctagaagaaaacctaggcaatatcattcaggacataggcatgggcaaagacttcatgtctaaaacaccaaaagcaatggcaacaaaagacaaaattgacaaatggaatctaattaaactaaagagcttctgcacagcaaaagaaactaccatcagagtgaacaggcaacctacagaatgggagaaaatttttgcaacctactcatcttacaaagggctaacaatatccagaacctacaatgaactcaaacaaatttacaagaaagaaacaactccatcaaaaagtgggtgaaggatatgaacagacacttctcaaaagaagacatttatgcagccaaaaaacacatgaaaaatttctcatcatcactggccatcagagaaatgtaaatgaaaaccacaatgagataccatctcataccagttagaatggtgatcattaaaaagtcaggaaacagcaggtgctggagaggatgtggaaaaataggaacacttttacactgttggtgggactgtaaactagttcaaccattgtggaagtcagtgtggcgactcctcagggatctagaactagaaattccatttgacccagccatcccattactgggtatatacccgaaggatcataaatcatgctgctataaagacacatgcacatgtatgtttattgtggcactattcacaatagcaaagacttggaaccaacccaaatgtccaacaatgatagactagattaagaaaatgtgtcacatatacaccatggaatactatgcagccataaaaaatgatgagttcatgtcctttgtagggacatggatgaagctggaaaccatcattctcagcaaactatcgcaaggacaaaaaaccaaacactgcatgttctcattcacaggtgggaattgaacaatgagaacacatggacacaggaaggggaacatcacacactggggcctgttgtggggtgaggggaagggggagggatagcattaggagagatacctaatgctaaatgaggagttaatgggtgcagcacaccaacatggcacatgtatacatatgtaacaaacctgcatgttgtgcacacgtaccctaaaacttaaagtataacaataattaaaaaacggaactagactagctaaacaattttgaaaaggaaaaataagtcagtctccctggtttcaagttttattatataattacaatagtccacaatatgttatactggcagaggaacagacacaggtcaatggaatggaacaaaaaactcagaaacaaaaccacataaatatgcccaactgatttttgacaaaggtattaaaacaattcaattcatagcctttttaataagtgatattggagtaagtcatcatcagtgggcaaagaaaaaagaaacgaatctcaatctaaacctcataattcaagctggatcatggacttaaatgtacaacttgaaattattttaaaattttaggaaaaaatagaacaaagttttcatgactttggactaggcaaagagcacttaaatttgacaccaaatacaagattaataaaaggaaaaaaattgtaaatagagcttcaacaaaattaaaaactgctctgtacaagaccctaaaagaattaaagaaaatcaacaaaaaataagctacagactgggagaagatatttgcaaaccacgtattgaacaaaggattactatctagaatatagaaagacttaaaactcaatgtttaaaaagaatgctcattagtatatgggcaaagtcctggtcagacatttcactgaagggaatatactgatgaaaaaaaagcacataaaaaaattccaacattattggccaccagggaaatgcaaattaaaaccacagtgagatagcactatacccttagcaggatggctaaaatgagaacataaataaataaataaataaaaccaccaccagtcatttatacattattcatgaaaatgtaaaataacctgctaggttattttacataactccaggagacaatgttaaggtttcttggtggaaaaaaaaattgccaaactacattttccactatcatacaatacagcaatcactctcctgggcatttatcctagagaaatgaaaacttctgcttgcacacacaaaaagtgctagaatgttcacagcagaattatttgtcataatcaaaaaccagaatcagatcaggcatccttcaattggtcaatgtttaaacttcagtggatggtatatccatatcaggggacagagatattgatacagccaacaacctatataaatcaccagagaataatgctaagtgaaaaagccaaacccggaaagtcatatttgtatagttccatttatagaacattcttgaagtgacaaatttataggaatggagaacaggttagtggttgtcaggggtcagggacgtagtgggtagggaagtgaatgctctaaaaagtaaacatgaaggatctttgtggtggtggagctgctctgttcttgactgtattagtgtcactacactggctataatttgtacatagttttgtaaaaggttaccatttgaggaaaaactggtaaagagtatttgagacctctctatatatttctcacaattgcatgtgagtctacaattatctcaaaataaagggtttactataaaagggtcctaacatcagcaacctggcttattaaaaatgtcatccgaagactgtcatatcacattaatcataattatgtcaacaaaaacaaggtacatatattttaaacagactgtcatttttaaaacaaaaatactaaatcttatttgttcttaatgctctaactgaagcgtaatttttacttatactaaaacaaaaagcacctacatttcttatatgtgagctattttctccccctagagagctggaaatatggttgataacaacattttaaaaggcatgtggaaggacataaagtgaatgcctggagctcatattgtcttctaagattcttggattgaacatatttctattttaagtttaactatttttggcatgttttccaaacagtatctaggctaagaaaaatgtaacatgccaaagtaatggtaattaataattccagaggattatgctttaaataaagtcataacaaagagctaacatgcttttattaaaatgtgtaagttatttgcatcaaggaaagagctagtggatatatttagcaaaccggatatgcactgattttgttattcaagaacattagataaagtgcacagaagaatcctgtttgggagctctggcttcctaaaaaaaactcaaaaataagaggctgccaaagctaataactagatttgttgcccctgattcccacataaagacaagcctcttttgtaatgaatcctgataggttatccccttggcaacctgtcattcaagttcattagttcatttattcatctactaaatatgttatctgcaacaagggcaacttttactttgcatgggtcacttactactaaagcacagaaccagtagagatgagtgtttaataatctattgcaggacattttaccactgattatattctcctgtattttcacttgtgtattttaacataaatcagagaacctcatccttccgttcaaaaccctccaaaggcttccatttttatgaaggatgccacactattcccactgctcagaatgcttcccccccagagagccacctagggagcaccttcatctctttcagatcattgctctaaagtcctcttctcagtaaggctcacccagagaaccttatctaatattcaatttagcctatcttgctctaacacattttagggttcatttacttttcttagtgtccatctttacatttcctttataggattttttttgtgttcttgttcactgcactatcccaaaaatttttctcatgacaagaacagaatatatgctcaacaaaaacatgttaaatggaagaacttacgtttttcttggtttgctatgctttctacaaacacttgcttactatttataatgtaccaggcataattctagcagtggaatcaactacatgctacacaacccttgctctcacaggtctcactgtggaggaaaatattgcagttggggtgagaggaaggtattaaaaccggacggataaccgcagtacaatatgggatatagtgccgggcttcttgaaaaaccccgggatataaaaacaaacaaaacacagcacagtccttgaaactcttatccttaggaatctaattacctaatgagggaatgccatttaaaagagagagcagggtgaggggggaagataaataaacagaaaaacttttaaaagcaatgtaatatagcatgcattgagatgaatgcaaaaaatggggattcttaaagcatggaaaaaggactagctagatggcctggagaactctaagaataacaatgaaccaagtcttaaaagattaatggcaaatttttaaaggtgctttttaaattataaaactaggatgagttttaaaggaaatctgctaagaccccgtctttgaacatttaaacaacttattattattattttggagagtgggagagtaaattgatgaataaaatgtagttgtggtattggccagaagtaaattgaagctatataaggtttgtgataataaatttaagtaaagccagtcagtagtgttttgtgtttgatccagccctgttgagtggcccaggcacaggtgtaaattaggcagacaggtagaattagccaaagctggagttgctccagtcaagtatggtggcaggtacatgtacaagggaatatagagatatcccaataagtgattctaaagctgaactggaaatataagctgaataaggtcggagtgaaggcttaagaaggataatgaacattgaagggtaggcaagatcaatagtgagttgtagatccttttgagatcaaagaattattggagttcagggtgttgaagaggtataattcaaaataaatcaaatagcagaggtcttcgcaaattaataggtactaaatgctatgttttcaaatgaatacttaacaactttctcttaaatgcaagaggctggaccaaatgatctattatcctctatgataaattataagagagatgtctaaggtaggtttttcatttcattcaagtttaaattgtttgctgtatgattttattgggggtagattattaaacacaaataatattttaaaagtctctaatattgacatttatatgctggaatttaaatgacattgaacttctcaaattattatagatttgattatctctgtcaaaaatctcttatacttggatcaaagagctttccttctttaaaatactttcttactaagcaggattggggaccactggtgagtacaaagtttgggcacattatataaggaaagcttatggaatttgagaatgcttaacctgaaacaaaaagaaaaaatttagcagtcctaagatgttgaaagtgggcatgcacaaggtaagatctaaatagttccgaatttaggctctggaatcatttagatctacatttgaaatgtagctttgtgacttgggcaagttacttatcttactaaaaattattttcctctttctgaagcatttctgaggaagtcatttgcaaggttggtgagaaagggaatttgattacatgaacttaaatctacaattatttaatcccatatgcaaatagatgaaatatttatgtttttgagactagaagcctgtcttctatttaaagacactgtccttcaaacagagctcttcttcgttcctcagtctaatcaagaactctaaaaccaggaaaaacagcatatgggttacatgcaattgaaaactcaatgattccacctccaaaactggaatacattttggcagaccagactgcctctaggcttaggacattactgacttctctgactatgggatttcacagctgggagcaggaccaacttagcaaaactcttacatagatgaaatctatctttggatttatgctgacaagtaagattctgcaactggtttttaaaatattttactaaattttatgtgtttaaatgtaagtatgaaagaaagaaatttgaagttgtcagagcttgttgaaagactccttatttaagcagaagttgacaaatttattacattgtgtaataaaagcaggctatacatttcatatcgggaaggaattggaaagagcagaaataacaggagtcaggaagaaccacttgcttgtattagtttggcttggcttggagaaaatatccaatttgtcaagctagggtcaggaaagtcaaggtgtaattttccgtctaacaatggatagttataaagggccaaacaaaggtaacagtaatgggaatggatatattataatctacatcgaatatctctggattcagaatgcctttaatgttgaattctggagtatgttaccttagataagttactcggtttttcctcagctataatatatctatttttagagattctgcgagtattaaatatggcaaattagtaagtatttatatctgtgcctggcatttaggaggtgatcagtaaggtattaccagtaatgtaacggtggatgccttcagtgatcattggccagaaatgttgtacgaaggatacagggaatgtttgagggcttgatttaaatggttatcacaagcattcatttaatttaaattttgttgctcacctaccatattgttgtcattttgctaggtattggaactatacaaataaaagccctattccttgtatttaagagtgcagtctagtagagaaagaataaaacaacaggataacaaaatgtgctatgaaagcacaaaggacagatattagcaaagaccggaagcataaaggggcagtcgttgaaaaaggcgtccaggggtttgaaacaatggaagcgtatttcaagttgagaaaaaagcaaatgaaaagttataacatgtaaaaagcacagtgttgcagaatacggaaagagaacagtatagcagaaagaggacgtaatttataattaaagaacctggtttccgtggcctggctatgccatatactgccacaggactaagcaaattgatacaacttatctaagtttcaaagtactgatctgaaaagtgagattcataatatctaccctgccatagttgtgaggcttaaatgagataagttatgcatttacttcagaaaagtatttctttttatacccactatttccaaatgagctgacagtcttcctttcttttggactctagtcattaactctaactctctccctgcttccacctggacccctgctcctaacccattctccaccatccaggctgaagaacctaaatgcacaccagatcaagtcacatccccacttaaaagcccccaatgacttcccattgctcctaaaaccaaattattaatgatgggctaacagatcattcatgatttgtcccctgactgtctcactaaagtcattttcacgccttgctttcctcactctctgtgcaccagccactttggccttctttgagtttacacatatccatgccccttcctgctatttgtattttgcatattacctttaccttgtccttgtcctcctctttctcccactttgcctatataatttcaaatcttttttgttttgttttgttttgctttgttttgttttgttttgagacagattctctctgtcacccaggctggagtgcagtggcgcaatctcggctcactgcaagctccgcctcccgggttcacgccgttctcctgcccaagcctcctgagtagctgggactacaggcgcccgccaccacacccggctaattttttgtatttttagtagagacggggtttcaccatgttagccaggatggtctccatctcctgacctcgtgatctgcccgtcttggcctcccaaagtgctgggattacaggcgtgagccacggcgcccggcccaaatcatttttaaaatcttgcatcaagtgtgcctatcccacccttatttattaggccacatgcccctatcataggatctcccaggacttgcttcctttactttttagcacacaacaaagacaaaattttgcatttgttaagtgataatttgcatccttccaaccagaccatgaccccaggagagtagtgaatatttgctttttcttgtactataacaccactgttcttttcatgtcagcatatctctctgctaagtttagtgccaagtatatagtatgtgttcaggggcatcttttgagtggaggaatagatgaaacttcaaatccagtgattggtcacattattaataatcaatcaacaagagtgattttcattactgccattatcattctgctgctattttatgtttagggtttttataaatagagcatagatgcaagacaagaagggagaaaagtgatgctgggggaagtacaaagagactagataggtaataaaggtttatttgttttataccttgttaggtcatacgggttttatccaagtgtataagaggaagaattaaaggggcttaagcagaagggcatgatgaatagctcaatgtttaagaacctctggtagcagaatgcaaaattaattacaactatgaagtgaaggcagggagggcagttagaagactcttatgaaatcaaggtgagaagtaaaagaaagtactgaatgaagactgtgaatcctcagtttctgtagttttctaatcttcctgtgtttaatgctgtgtcattaataatttcacatgattggtgaaagtggcaacctttcattccttgtttaatcactcacaatattaatgtatctataatataacttcaaataaagaaacacagtcctggataatacttaaaatttgaattccaaacttcaataccattgtatgtactcagaaagaaactatctttgttgtaagaggagaaatatgtaatacaattatatgttttttttctgagtcttgatttaaaaggaaactgtgaaaaaacagtatggcataaagatgaaaaaagtctctttggaccaaaatttcttctttgaaaacctatgctggaaagaattcgtatgcagtgctgacatgtaaattcaaggatatataatgtttactacttaaaccatttactttactaaccaaaataaaagacatggttagctggattatcaagcaaatattcaaaataaaattaaatttaagtatgctcagatctctatcataaatcataaatttcctctggtgttatttctctccattatatgtaaatagacaaggactattcctgcaaaattgttttaccacacagtctgtatttatgcatctaaaatgttattcttcatggctatgtttctatagacatcaaggttatctaaatttgattttgataatagtatatatatccaaaactatgataagtgatggttcactagttgttagtacttttgttataattgaactcaaagaacacaatcatgttgttactggtttcatcgtaaggttaagttctccagtataaaatttcattactaggcacttatgtgggagaaaatagtttggtctactctactgtctttatatactctgctatttctaattcaaactcatgaaaaaaatgtttcttcacattacactacaaatacgattaccatccataagtaatgatttacagtaaaaggcaatcaagaaaaatcatgtttagaagatagaaggaacaataaatatgcataagtttttgaagaatattcttgcattttcatttgcctctgttattcctttagtttgtttcttaattaagggcattttagcataattttaaaaacataactgacaagtgataactttttacttacaactaattaggagcctaatttacctttagccctattgttttacacacctcataaaagataacatcaatgtctgatccctcttacgcatctcttccttctttgtccctctacctaaaaataaaaataaaaaaccttaagatgtataagataagcaaaggttttataagttaattttaagtgtataaatgaataaatttgttaacacaaaggtaagttgacatattagcataccaagatgtaatgtcactaaattgtaaatcaagtaattacacagagtttattcatacctcttttccttctttggtattccttaaccttttcaagtttaatgagctaatttcaattttgaaaaaaggaattgaaaattagataattacatccagctttattttaaccactaattgacctaagtttcttagcagaccattgagaaaattaaagctcagagaaacagaggaatttacccaagattatcaagttaacagatgagaaaactaggactcacatattggccattatattcattaagtaatataataaagtatgtatgaaattgtgcagaatacaaaaagtgtttaagatctaaaagcaatgatctctaagccataaaataaaaacacaaaatcaggccgggcgcggtggctcacgcctgtaatcccagcactttgggaggccgaggcgggcggatcacgaggtcaggagatcgagaccatcctggctaacacggtgaaaccccgtctctactaaaaaaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaaaaaacacacacaaaatcaaaatgtttacaattgtaataaatatatttaaattgaaacatcaattagctacaaactccacatatgtatatacacacatattatatataatatagttatatattatatgtatacatgtatattaacatatatatatgtacacatgtatatggccatatacattacaaaggattgaggcaaatattgagcaaatgattattaaatgtaaattttcaaagtcttaagatcatggcctattatacacgattatatgcaataaaagcatgcccacagaatactctcccttaaagttagagtgtgaatatatgacgtaaccatgatttgcattgagatcttttggattccaaagtctaagattttatcatgacactaccctataaacatggcccacagaaactgtgtaacttggtcaaatcttacagcaaattcagagctagagaatgtgtaaaatatacataacccctgcttcccaataaaccctatgagtataagctatttgagaaggaatttaaatgcccaaggatcacagaattatgaaggtatcatgtggccacctagattagggtccttagcctagaattcatgcaactgtaagggatttagggtggcacagaattgttaaaatgatatatagctgtattttgtgaaaatttcatgtttatgccaattaaaattatagacaacatgttattcttaaagggagttataattgttaaaagtttaaaaattattgatataaacaactttttagatgactaagtggaaacacagagagccaaagtgactgtggagaaccatacaactggataatgggagaatagttattagaacgtaggtttcttccttcctttccctcctcaactgaccatgtcatggtgccatatgtattaagccacaccatgagcttgcaaaagcaaagctaatatctgcagaggatggcacatgattatgagaaaatgagaagccttagtggtctgaggcatcctgatggactctaggtaacttactcctttgctttccaaaagagtaataagaaaagctatatttaatttaatgtggttccatttgtagagagaaataatatctgcttctttattaacttatggtgcaaggataactcaggccattttctaaggaaactcaatgagttagaatctgctaacctcagtaaacaaaacctcagttagctgtaattaatgttcatagtgcatctgcttaattttcctaatgcactagcccttttttctttcgttttcttttttttcttttaaaacttctgtaattcttcatgagctttactttcagtaacttatggggaggtttcttaatcttattttaacatggtattgcaatattaatttgaatttttttgatggtggagggattttaagaaacaattttaaaacaaataggtctattcatcaaaatgttcaggctaaaacagttgtgaatatcgtgggaataacttataagggagacgacatcttcattattagttcagtggtgtctagttgaaaatgtctatattacagagaagttggcaggagctgctaaagaatgcttcagcttgtccacaagtaagaattaatcctaactgattactgaaaaccagagctttgcacaaaattgccttttcattcatagtggcatctcaacactgattacgtgaaatctgcaatgtactttcaaagaaactgagatgatatacttgataaggcataaaaattgatctctgccaccaccaccaaccatgaagcagcctacagcatcttgaccattaaatgaattgattattaggggccagacagtctgctaaatacattgcatacattattttatgtaaccttcatgggattgctattatatagatgcaattactcttaatctatctacattatagcaatgttatttcatagatgttttcatagatgaataaatttgcatttaaggagaattaaaaatttgatcgtttcacagaatgattaagggaagaaattctggatttgacctcaaattaccttgattccaaagctagttccattaactatcaagttacatcctttcccattctgatagcaataatgcataggctaatggatacattttttataatgatcaaaaaattacaatgaaagaaaaaaagggtgggaaaaagagagaatggagggagtgagtgaagaatggaagagacaaaagaagaaacaaataatttagaagcagaaaatcgacaatcagaggagaagacattgaagataaaaataaacagcaaagtaagagtagactttttgttgccatggagatttcggaaatgaaggtaaaatgtatctgcatataatacttgcaaataaagatctgtaggggtagcaggaattcctcatgccaatgaagtaggtgcccagcaggaggaagctgactcgcactccttacatcagagcatcctggcctaatccagcgaattctgacatcaagctcccgtgagcagagtctgaaccatttaacctagcatggtgagagagtctatttggtcatctttattgttgcaaataggggtattttttgggaaaatgtatgatgcgtaaaaaatataattaccttatgactctacattgaatgcatacattattctctctttaggatcaaatccactaagagaatcaagaactgctgcacagaaacctttgatagccaatgtcctaatacgaagaagaagtaaatgaacagaaggagacatagacttaaagctctcgcaaaattgaacaatatttcaaggccctacattgaccaaacattaacgttaaaagagcctcaccatgtcagcattccagccagcccaaatcgtcaaagagcaagaaagcaatgctaaagaacaatgtgaaggaatcattacataccgtttgaatagtttcctaaattcactcagtgctctatctattattagctatagcacagagaacttgtttcctattacagatggtagagaatttctagtttgcataaaatcaacatcctctaaagttctgaaaaaacatatgtttgcagacgcttacccaaagatagcaacggaacattcattattcattagctgtttcatttcaaattttttatgatctatttgccatatttcactgaatctaagatcttgcagacaaagttgataggtactccctttgtaatacagttaagatcagactttaagatagcacgtcgtgttgctacatgtaagagttctgtaagtctaatgcgatagatgacaaatattggaagctaagcatatgtgttatttttctgcatttgtcaattactattttagaggaaatatttaggctttccttgctcatgttcctgacttggtccacagagaacaaatgtccacaaataatcttgtctttatgagaatattagaaagaaacaaataacttctttttcattttatagctttaaaagcacaagaagagggagggtactacttcattctccatgtatggcttgaatcaagctggtttacggatctctgcattgcacattaggagcatcatatattggtcagaatcctgatggtgaagtcaacaatacaaattcaggcgtcaagcctcactctcacacctgacaattctgtgtattttgaagcactccgaaatctttatgagggcagacttgccccatactactatcagggaagaattatcttgcttctcagtgcaaaaatagttgtaaactgtcaaagctatttatcttctcatgtcaactccctgctcattattagaggttcagggaaatgtcatttctactgagaaatggtttttacaacccaaatccaaatccaatgctacctcttctgtgatcccttaacaattttaatcttattttagcacttatcacagcctaccagatagttattaaaattatttgagcatgcaccttgctcattgactagaagtgaatccctagtggttagagattaggtaacacttattcatgtagcctcccacttcttacaaagtacattacgtttgaaaagtatggaaagacttgaatctttaaggcttatattttttattctagttcagaagagacagtgtgcccaacatcagtaagtcaggtattctggagatatttgctacatagtcacaagtatatccattatcatatgcacacatacatatacacaaacatacatatatatgtttgtgcatgtgtcaaatacacacacaaacacataatcacaaatacaacactacaggtatcttcccttttcttttcacaattgttgctagtaactccacctctatttcttaatagaaatttagactacttaaggaaagaaaattgtagagatcatagagatctaccaagaccattagtatcacagcacatggtacagaaaacagaatttgtgttactactcaacagtgccggctcatcataaaagcacaaagacaatttgctgagctgagctgagcttggtttcaatgctattacttcaattcattttcccctaaagatagggctgttttttttgcctctttcaattgaactaatgtacatagagagtagaaaaatggttaccagaggctgggaagggaagtgggggctctgggaagtggaggcacagatgattaatgggtacaaaaacaaaatagaaagaatgaataagacctactatttgatagcacaacagggtgactatagtcaagaataacttaattgtatatttttaaataacttaaaaatgcaattggattgtttgtaactcaaaggataaatgtttgatggaatggataccccattttccaggatgtgcttattttatattgcatgcgtgtatcaaaacatctcatgtaacccataaatatatatacctactctgtacccacaaaaagtcttaaaaataattttttaaaaattttaaaagctttgcttcaattagtcttgaatgcttggttctggcaccgcctacttcttgtgggcatagtgcccactgtacgtgttcaagtgagctgcactcatccatctttcactagggctgattcatagggcggccagaaccctatttagaaccatagcttgctgcttacataaatcaatgaaatcatatgaaacacaatataacatggtttcattgaaagagcacaggtgtcaaaaggatgtgagtttacatattacataacttaatatttatttgaacttggactcgtcacttagcctggttgaacttcaaatcctttattggtgaaatgagcatccactcataaaatttcataagcctatttcaaaggattgctaccttatataattttataaactatgaattctcatacaaaagtcagtgataccagatcacacaatttaaaatttataggcagacacttcactacttttgcttcccttcactgtgaagtaacacatgctatcaccttggtggcactcgcagggtatctgttggctggctgttttattgggcttcttcctgccactcaagtgatcatgactgagaagaaatcaatgggtgtctgttggcagtgtttttaaagacatattccttaggtaatacaggtagtcactcataaaaaaaactttttttctggatattagtctgccctcgtggatatctcagggcctcatacttcatcaggcaatggccagttcatttttttaatccaaagctacacagagtgaaacactttattctgtgtgtgttttaaaagcccaggtagcactaaataccattttccaggaagtgtgccaagtactttggaggatgtacattgaacttttcattagaaaagcttcccaaatggataagagttatctgacagaaaatagtttcatatctcattatacctttgagtgtgattacacaaaccagcttggaagactaccaggcagcacctggctgttctcaccttgactctaccattagctaacaatgtgagttagggggcatgtcatttaacctcatcgcttttgttttctctcctgatctagaaggcatgatatatttgccacttgaggtcctccctgtttctaaaagtgatcaaatgtggtttttagtagagcagattgcagatattgaaacaatcaaaacccagttggaaggaaagagaagatatcagtgatctacagggaaaaaaacactagattcaaaaatttattttagtgctgagctttctagtgttaaggtaaaactaactaaacacatgtaaattatatctatatataaatatgttataaatatatagaaccattatatatgttatgtattatacatatatttatttatatataccataaaacatatttgtgcttatctataacacataacatatataatatatattcatctttcatatttattatatatacattatacatatatgtacatgttatgtgcatgggaataatggtttttcatatagacagatattttcataaaatttgtttcaaaagtaatttttatgctgacatgtctttatataaggactttgaataacaatattcttgttgtctttaataatagtcttatagaaagaaattaatattacatttccaatattttgtggtggtagtatttgctaaccaatgcataatcctttatatacactgtctgttgttatttaagtgtccctgaaaagtaattgttatctcctgtttgagaaaggatgaaattagcatttagagaagtcgagtgattttcttattgtcaattagcaagtataacagtaagccattatgatgtggctgtttctacacatctgggtgtactttagtgggcatgcttcttttgtgaggccaagtcaataaagaccatgttggctcctgaaatttagtatatgcatactaaggtctacctctagtgggataggataaaacagtcaggaagatattttcctaaagtaaatactgtttccactcagtttttcattgcaaactggataatagccatctgcagacaaaatttttgatgggagtacatgatgagagtactttaagttgtttgtagaaagaaaagctatacattttaactaccaaatacaggtagcaaggctagcactatcattaacaccaagaagctttcttcatattctctcatttatgactacacagaggtagatataagaataaatttgatgagctctcaagcccttccaaactttaacattctgtcaccatagaataaactatatataaactaagcaaacgtttgactccactaaaaatatgaaattcatcagtgcatccttgttctggtatgaccctcagaccaccaaggtttaactaatggacttctgagtattaccttggctctagtctgtagcaatgctcaatgaatagaagataagtagactcttctgttaatactagtttatgccctacaaaataaactttattgagaatgtcattcttgagacagattcattcaacaaaattaaaaaacaaacaaggcatagcataatgtacagaaattgaaagctggccttcagcacacctcctccttccaccagctactgtgttttacttctctccacagatgtaatgaaaatgcctcttaccatttatccaataaatacctactctgctctcagtacttgatacctatgacttaatccttccaacaacctttcaagagaagaatgataactcccacttacaaaaaaggaagcagaagctgaatggccaaggtaacagagctactaatggcagacccaggatttcagtccaagtgtatctgattccaagcttgaaccctttaacacaatatgcttcttctcacaagtactatatcagatgcactgttgcttcctgttatttgttgagtacccaccatagagtttctattccagaaggaaaataagagatttagaagaaaatctacagaatgtttggttttcagttcctacagagaaagggtcataagtgacccaagcatttagataaaagtctaggtcaatatgcccatcactagcactttgtttttacttcttaccacctctttctccagtacctccctcctactctttcagttatatatccactgcttggcacatgataggccctttaaataaaattacttaaactatctgcctcaatttcctcatctataaaataggataatttaaatttcaggtttgttgcatggatgaaattagtacaatacagcatctgacacaatatatggcacataattatctaataaagggtagttattgttgtcattgccattacacatttgttgaatgatttagtgaatgaagctcacatgcagggcacatgtagtgtctataggccaaatagttgtgcttaacaccaaggagtatctgtgtaccaaatccaacccccagaatagagccttgcccctcagaaacaagccacttgtcagtaattatgtcatcagtgatgcaataatatgtgaaatgtactgtggcgagatccctcagtcattgttcttttcaacatcatatcagtacaaaggcagctgatgtcacttgctgggcttaatatttctgccccttcagttactaattcattaaaaaatgcatttatttgttctaacattgatttattcaatatttttaaaaatttattctactatgtcttggacatttatctatctatctatcccaaatgctatgagaggcactgggatacggaaattaaagacctgtccttgaagaacatttagttctgtgaaaaaatggtcatacaatgcaataaggactagagaggagggctgatacaaaccatggtgatgggggatagtgggaagttatgggattataggattacataaaaggttaggcttcctaaaagagcacccagaattttgaaggataaataagaaaaataatattttaaaataaacttttcatttcagaatagttgtagatttatagaaccactgtaaatattgcacagaaagtccctatatactgcatacccacattttcctgctaacatcttgctttaatatggttcatttgtcacaaagactaaactaatattgatacattattattaactaaagcctatagttagttcagacttccttagtgtcttcctagtatccttttgcttatctgagatcacatccaggttaccacactagatttagttgtcctgcctccttaggctcctcaaaacggtgactgattgtcatgtttttattgttttagatcaccttgacagttttgaggagcacgaatcgggtattttgtagaatgtccttccattgggatttgtctgatgtttttctctcagattacattggggttgtatgttttggggaggaagatcacagaagaaagtgccattcttatttacatcatattgagggtatgtgctgtcatcatacccttatcattgtttatgttacacttgatcacctggtattagtgtttgtcagctttttccaccattccatactatctaggctttgtatagaaaaatgtcatatcaagaacaaaccctttcagctgggcatggtggctcacacctgtaatcccagtactttgagagcctaaggcaggtggatcacctgaggtcaggagttcaagaccagcctgaccaatgtgatgaaaccccatcactactaaaaatacaaaaaaaaaaaaaaattagctggtcgtggtggtgggtgcctgtaatcccagctacccaggaggttgaggcacgagaatcacttgagccccggaggtggagactgcaatgagccgagaatacactgccactgcattccagcctgggcaacagagcaaaactctgtcaaacaacaacaacaacaaacatacccttttatctccaatacttcccaaatttcggagtggaaggattatttctgatgccagaacctgtagaaaagtttctgctataaaacaggaagacaaatcagacacctttggtttaatcattcatatgattcaatgaaagaggctgtactgcctgagagatgtgacatggctctggaggcccctcttattatgattttcttcatacacacaaagagctgttttatgggctgcagctgcagcaaccattaggaagtacctcataatctcaacagtgcaaaatctgggcagggacagggtgagttcagccatgcatggtttatgcaaggtcagggaggtaagccaaagcattaccaattgttaattctcactattccaggggctgaatataccttatctaatttaatttaacccacataattaccatgtgagttaagcatttctggtcctatttatagtgtacaagtgaaagtctcagataacacaaaatagtaagtgcagaattggaatttaagcccaggtgtttggacttccaatctcatgtttatagcatcaaaagacattttaggcaacaatccaacattaataatatgtcacatccattttccaccacagattgttcagagcatgctcccttacaggaaacattcttaagctaagtcatcatctttcctgtaatgggagaaatagtagaagtccatactaagaatgtggaccacagtagaatttagtgatagactgttggaattgctaaagatcagtgggtgctgacagtcagagaattaaaactataacactgttagaggagtaaaaacaagccaaattatggccatgatggtcctcattcaattacactagtaggtagtccacttaaaaaactccatataatctggtctacatgtcctagacacagaaccggaggaaccatcgattccagcttcatgcctatctggtttttgatgaattaatgatccattatccctgtgagaccattcattacatattattctatgttaaaaataatgtgtgacatacatttatgcaatatatactatgtgccaagcatgatccttagggctgtattaatcattatctcatttaattctcaaatatccttccatgtaatcacaatgaatcttatttggcaggaaaaagaaaaaactggcttagtgagattagtgctttctaatggtggcagaattagggctcaaatccaggatattctgtttaccaaggctatttcctttccaataccctgtgagagtctccatgaagaacgataaataatacatttgaccacagtcccctcatttcaccatctaaattccaggtcatagttatctttacacaacttcattagtgaatactgaatggatttgttattacaacagtctgatactcaatattttgaagctaatgaaaaaaagaacagaagggattcagtggatatttggagtcctagaaaaaagaaaaagctttatgaagttcctcagaagtcctctgcttccctcaatgtaataaacagaaagcaaaatgtgcaggaagaaataaaaaagaaaatatcactaacaaggtcactccatcacctgcacaagcctctttaaaatcagcccacagccaaggttcctgctgtcagctcactggactggcaactcattggataactgcttccttaatcctatctttctgcttccttgattctcaaggaagtttccaaaagctggggctgtatataccagaattattgggagaacaggtggtatgtaaggttgcagtattcatttcaactcaagaaaatgattaactgcacagctcagcacaatttggagaagttttcaagtgcaggcagtcagtactaaaaaactgcagctcaaattcccgtgatcccttgaaaaaactggagacagatatgttaaaaggggaaaaatcatgtgaagatgaacggtagagctaagaaatgcaatttttagaattggaaagaattgagctttaaactctagactctatattttttgggcatgtcacttaagttgtcagagtctcagtttgtctatgatggggttataacgtcttcctcacaatgttactcactctttaagtcattcattcattcagaagtatttttttccatagatattatgtaccaggctgcccctgacatttgggatacaactgttaatatattagacaaagtctgtctcatggatttgggaaaggggcagacaataaacaagagaatgagttaaaccacatgagaatttgagatgataacaaacgttcttaacaaaacaaaacagagttttgtgatagatcatatcctgggaggggctggtgaaatatttttccccagcatatcacatggggcctggtttatagcagttattccatttacattttaactaaacacatgcctggactctagtaagtgctcatttcatgcattttctttctatgcttgtgaaagctggtttttgtagcctaaaggagccaatattcactatacacactaaccgtaacttcaactattttgatattatagaacttttactccatattcatcatataccaactacttaaatatgaatatgatccaccacaaggtagaagttatgcaagattaaaaataaaagaataggctgggcgcggtggctcacgtctgtaatcccagcactttgggaggccaaggggggcaggtcacaaggtcaggagctcgagaccagcctggccaatatggtgaaactccgtccctactaaaaatacaaaaaaaaaaaaaaaaatagacagacgttgtggcacatgcctgtaatcccagctactcaggaggcagaggtaggagaattgcttaaacctgggaggcggggattgcagtgagccgagatcgtgccactgcactctagcctgtgtgacagagggagactccatctcaaagagatagacagacagacagagagacagatagatggataaagagtattttactcttttttactttccttactagtctggcctgggaggtaaaatgtgctcaaatagaactgcaataaacgacagtgcattataaggtcctttagtataaaatgttttctgtgtcaagaagtggatcacttgtcatggggctagaggagggttcaagcaggaaatgggttttgaactaggtcttagatttaaaaatgaaaatgtaggagcaaatgctttgtaggaaatctgtttaaaatgtctcatccccagagtttctgattcacaaaatcagggatgggtcccaagaatgtgtatttctgacacgttcccaggtaattttcatgcacgtttccagctatgtttttttccaaacagtgatgtattatacttggaaagttactgtatcactgcaccctcctgtactattatggggcatgaatgaagtatatgcaaagagtgtgtgtgtgtgtgtgtgtgtgtgcgcgcgcgtgcacatgtgcgttcattgtgtgggtacatggaaaatatcagaataatgatgaagaatctttcatacaccatcaggggggtaattgttatccctttcttttgtctctgctttccatcttacacaacatgacccccaaacactcttcttctgctctcttctccatacttcccagacgcatcctacctattataatgttaaatcaatggagtattgctatcaagttgagattaaaaactgctggggtccttagaacctctgtagtctcagagtaatacagagtagatcacaaatctagtcccagacataccagggtctttccttgtccagccatgcgtgttcatcatttccttagtattttaccttacagtgggtcagttaagaaattttaaggccaggggctgtggctcacgcctgtaatcccagcactttgggaggctgaggcaggtggatcacgaggtcaggagttcaataccagcctggccaacatagcgaaaccccgtctctactaaaaataaattaaaaaaaaatattcaggcatagtggcacatgtctgcagtcccaggtacttgggaggctgaggcaggagaattgcttgaacccaggaggcggaggttgcagtgagccaagatcacaccactgcactccagcttgggcaacagagtgagacttcatctctaaataaataaataaataaataaataaataaataaataaataaataaaaataaattttaaaataatgatcttaatattaaagttgtccatcagaggccaggcacagtggctcatgcctgtaatcccagcactttgagagatggatcacctgaagtcaggaattcaagaccagcgtggccaacgtggtaaaaccccgtctgtactaaaaatacaaaaattagttgggcgtggtggtccacatctataatcccagttactcgggaggctgaggcaggacaatcatttgaacctgggaggcagaggtcgcaatgagttgatatctccacggcactccagcttggaggacagagtgagactctatcttaataaataaataataaagttattcatcagataccaagtatcttttttaatcccaaagatactcattgaaagattacataaatacaggttcagacagctagccctgccgggccagagatactgaggagactatgcctaatgatccctcaactgcaccatcactaaattatctgcagcctcctttaatttcagactcttatatcaggatcttcatagcaaaaataattctgatcatctaccaaattaatgaagaagtttattttggcattaaattcatttttaatttgcttcaaataatgtaagttttcaattgaggtagagtttattaaacataaaatactggcagggatgtttatgtatatcttatcacctctttagctcaaagatctcaagatcaaaataacagaaaatatttgtattctattataatatattatgaccaaaaatatcgggaaaacaaatattttctactttgtccaactttcaatgacatattttcaattcttatgtgtattactggaaaaaacaaatctaataccttggccaataagcttgaagtatgaatcaagctttgaaatataatattggaccttcacagtctgctaacaaattatctacaccttggcccagaattgcttcatagtagactctctaaataaccataactgactgttaaacaagtgaatatctcaaaggacaggtaatcaaatgagctctacaccactaacagacaatttttccactaaaaaagatttatttatatcttcttaatgtctgcctcaagccacaaatctatacaatgttagttagcaggagaagctgaaaattaggtgtggtaagaatgaaatctagaaagtcatcttcacgttatactggcttcattttttcttctgtatcttgtaatgtgaggatgtgggagtactggcataaggaaaaaaatgttatgaaccatccttttctagtccgaagagaaaacctccatttgtgtctctaactaccaggaagcaaccttaactctgttcaagagatatcactagactggatctgccctggtggctgacaataaattgtaagctcagtggctcagatggacagcaaacatgtttggaagttgctaaggatggcaacaagagacaacatggaaaggtaaagataggtcatattgatgaagacttcagtgagagtgaaaatatgagaaaggttaatgcagacataaggagagtagagtcaatatactctacactctttaattataaaggagcatgcaataataggaactacgcaataacctggaagtgatctatgcttacaaaatgcatcagatggaattgaaaacatgttcatgatatatcattattgttttttaaattaagtcacaaaggaaggtgcaaaaatcaatctcaatttttgttcaaatatgatttaataaaatataaagatagagagggaaggaggaaaagaaatggatggtgaaaatttatgctggcaaggttgcatagaaaaaagaatacattgctggtagggatataaatttgtttagctgctatgcaaaacagtttggtgatttctcaaagtacttaaaacagtactaccattcaacccagcaatcctgttactggttatacaaccaaaggaatataaattgttttaacataaagatacattcatgcatatgttcctcacagcactattcacaatagcaaagacatagaatcaacttagatgctcatcaactgtggagtagatttaaaaaatgcggtacatatacgcagtgaaatactacacagccataaaaaaagcaaaatcatgctctttttggcaacacacattttctaagcaaattaactcaagaatagaaaaataccacatgttctcacttgtaaggatgagctaaatattgaaagcaaatggacacaaagaagggaacaatagaccctggggactacttgagggtggagggtaggaggagggagagaataaaaatctactcactgggtactatgcacattacacaggtgacaaaataatctgtacaccaagcacccacaacacacaatttacccatgtaacaaacctgcacatgtaccccctgaacctaaagtaaaacttaaggggaaaaaatttagagaaaaattagaaaatttaatgtgaaactgccaatagtagttgactccatgagtagaattgagggtcagggtttcatatagacactttatacttctttagcatctgcatttggaacactgaatatagatagcatggtgtaatagaaagagtctttggagtgagaaacatctaaaataaaattttgtctcaagtttactgtgactttgtaatattacttattttctctgtaccttagtttccttggttcctataaaagacaattatatctgcattgtaagacaatgtgaaaataaaatgagattctatatatgaaaatactaacacatgagagtcattcagtatatgcaatctactattatttctcatattctaagccctgctggaaggaaggaaaaggaatacattaatcactctttctttacctttaaatggaatacttttaagaaaagagaactccatagggcaacagggaaagtcaccctggaaaattaatcttatgactagttatttctgtcttctcacagtatttcacaacctattgaagtcatatgttttaagtaacccatgtgacgaagtggaggtgttgaagtaaggaatggtcaaatgattgcacatgggacagaagaaaaagggcttcatcccatcttctcaagagacagagacaagttttcctttccaggtgtttgccttctcttttatattggatgcttgctcactggccacccccacaaagctgtaccacattttctttcttttttcttttctttttttttttgagatggactctccctctgttgccaggctggagtgcagtggcgcaatctcggctcactgcaacctccgcctcctgggttcaaacgattctctggcctcagcctcccaagtaactgggactacaggtgcatgccaccacatccaacaaatttttgtatttttggtagcgacagggtttcaccatgttgcacagggtggtctcaatctcttgacctcgtgatccacactcctcagactcccaaagtgctgggattatagacgtgagccactgcacctggccggcattttcttactcactcaaatatttttcaaagcctgaaggaattagttactaagttacagtgccaaacaggctactgaaacaaggaagactaggaagtttggtttattagatgaaaatagtttatgacaaagcttctgattttcacacttttacattaagtaaaaaatcctaaccctggggttgcagtactgaccaagctctcataaattagtcaccctggtctagtctacaaaataagaccgtgacatctaaatcctgaaaggaaacacttccatattatttagcatttctgttttcattaggacatgtgaacgtatttaaattcaacattgaataaatataattcagtatgtatttatttgacctccatgtactcaaaactatggcaactgctatgaacaatgtcaaagaaatttaatatcactgctatggtctgaatatcctctccaaaacacatgttgaaatttgcccttgtggtggtgttaacaggtgggactttgggaggtgatggggccatcagggctctcccatcatttgtagaattaatgccattttaaaaaaatgaattaggcccccatttgccctcttttccttggatcttctgccatgtgagatgaagtatttcttcctccaggaggacaacacagcattcaaggcactatcttagaatcatcaaatctgccagcgtcttgatactggaccttccagccaacagaattgtgagccaatacatttccgtttataaataatccagtctgtggtagtctggtatggcagcacaaaacaaactaagacaaacccttactacaagaagcccacatcctcattaattataactaacatccacgcagcacttatcccaatttttattacctgtttttttaacaatttaagtatcaaattttggcagacatggtggctcctgcctgtaatgccaacactttgggaggccaaggtaggaggatcacttgtgtccaggagtttgaggccagcctttgcaatatagtgagactatgtgtctacaaaaaatgaaaataaaaaattagccaggagtggtggtgtgcacctgtagttctagatcagggactgagaaagaggctgagacaggaagatcacttgagcctgagaggtcgaggctgctgtgagccatgatcatgcaactgtactcagcctgagtgacagaataagaccttgtcagaaagacaaaaacaaatccaaaacacatttgaagtactataatttttagccatatatcacatgacgaaagtgtttggtaacccttaataaacacacaatgtaatgatcttaaaaaggaaagatgcctcagtacatctctaaaagaattggttgatttcattttgttagtaatagaaaattaaattaaccttttctgttttttaattatactttaagttctggagtacatgtgcagaacatgaaggtttgttacataggtatacacacacgtgccatggtggtttgctgcacccgtcaacccgtcatctacattaggtatttttcctaatgctatcccttccccagtcccccacccccctacgtaccctccctgttctccttcccatgtccatgtgttctcattgatcaactcccacttatgagtgagaacatgcattgcttggttttctgttcttgtgttagtttgctgagaatgatggtttccagcatcatccatgtccctgcaaaggacgtgaactcatcttttttatgcctgcatagtattccatggtttatatgtgccacattttccttatccagtctatcattgatgggcatttttctaaccaaaacattacagaatttgtaacacaaataagcttaacatgttaatgagaaaaggaaaactacaagttatctggtagaaacactgttaaaaaattttttggattattctgtcagtataatatttgaaggaatcattcaatataataggaaataagctgtgataattagtgacataacaaagtcagataaattaactcaaccatacttagtgagaaggttgatagaaaacttaagtctccttaatactagtgctttgttcttcagattctggtataatttgatagcaggacatatacatacatatagcatatatttcaataaatctatagaatgcttttctagttttctatcaccagcactctgaacattaacattacacatgttaaaatttaagcgttgagtttattgaggctttcttcaagttttcttaacaccagaatgctgtatacttgattattccagatgcatccctaatgagattttacaggagtcattgtggttgtgcatgaaaaggatgaggcctactgaaactttttatttcctaaatgccttatattaaaaagtccttacatctcttattcaagatttcctactaaattgtttacaaaacttccttgctgaataatcacggtaaggtggttagctgggtagtagacactaaggaatgctgggtttccagggaaacagtgccacgggaagcaacaaaagagacaaccaaagctgtagatgtcatattacacaacattttattttttactactgttatattgttatactttgttattcttgctttttccttctttctgggagacattgtctctctttaagaactctaaaattgacaccaataacaacacacaaagcatgacattagtataaaatctattaaccagaattcatcttttttcaaaataatacaatgacaacgggtgcaattatgaaacgtatttttttgatcagctgaccctaatgtacttcctaaatgataaaacttggatatttgacttcttccctaattcttccagtaaaattctttttcaataaaagtgtcttcagaatgattggcctttataagagagcccaaatgctttttttcttatacaatatattgtgtctctttggctttatcagtggttacagagctttgtggtaatctcaaaatatcaacaccatccatcctggggaagtattttctccagcaaaaggagaaaaagcaagacagaaacaatcataaggccatgtgaggttgactttctccgggagcactttgataaatacgttcttttatttaatgtctttgtgccttcatttcctcatctggtaaatggtaattaaaagtacttaactcatagcattattgtaaggactaaataaaatagaaccacaatggctggaacatattaagcagttagtattagctatgacaataaaagtaatcatatatttaaagaataactctttaaaaatatataaaaacaaagtccttaagatgggttgtttgatgttctcaagttagtataaaattgagaatcttaggaacagatgatctgattcaaaattctatgatcttatgccctattatacttaagaacactgaattattggtaaaatattctaatactatggacaaacaccctatagtttacatgcgtatttgactaactagtccatggtggaagtaaaactaaacatgattctaaatataaatgtgtctaggaggggaaaatttatccaattagatgatttaaagaattattggaagagttgaaataaaaattacttgtagagttaagagtagaacttatgaagaaagattaaaggatgatttaccttagagttgaggtctaacaaaagtttagtaaaaatcttactctggatatatggacacattatatatttaaaacttcaaaattatattttgtaggacaaaaactttatttcaagaacaacttaaagtgggatatccatgggaagggataggcacaatgttttctttcttaagccagtagtaagatgagtgtttttatactaactaaactttttatgccagcaattatttatttaaaacacttacaatattgctattataagtaataaatcttaaaaactattaatatattttcaagttgtacaagaatttaatctttttgattatttttgtttttgttgttattaagttaattagattttttaaatacagagataaatatcacatatttatgttcctttatgtgctttttggaattgtgaaaaataaaaaagactctgagggctcccaaactggcaatgttgtggagaaaagacaggatattataatgccacgaataacaatgtccataaaaagtatgaataacaagagaaaatgtgctccttacaatgctcagtaaaatgaaaaaatgcaaacaaaaacatccaatattatgtatatagctgcttttttaaattgtgcataagataattagaaatgatgataaaatgttaaaaggttttatttctgttgcaatattagtgattaaaaaatttttcttctcttatttcttttctaaatgttaaataatacctagctattaaatcacttttatatttggaaatcatgtatcttttaaaatatattatttgcatcctccttattttcacttaatacatatagtttaagttgttctcagacaccagaatattaggagaataattcaaaatgcaaagaaaggactcgagaagttacagttgaaaccatggctaggccaaaacaaaaataagaaaaatagtattaacagatagcatttattgactgcctattatatactacacatcataaatattgcatacatatttttaaaaatactattaatttaatttgcataaatattttatgtttgtttaccattattttcattttctgtgacttggtttaaataaattaatgaatgcaatgtgctcagaaaactgcctggacacctgataaatttcatgtaattgttttctagcagtagcagcatcaatcattttacaattgatgaagttgagatttacaaaggttaaataagttgttcaaattctagtttatttaaccatagagtctagatctatgtccttaaacacagtgataaaaacagtaaactaaaaaaagcatataatatatatacatacatatttcaattataatagaacatacatttgttgtgagaatgagtgccttaaaataaatattatctgaatattaagcatattttcccaacagtaccctggcaccaggagcctcgttctgtgcaagcactcctactcaccagctctgtgaccttagacaagttgtttaaatttcctagacctgagtttcttttctaaaaatgaggaggttaaaaaagaacaaatactagcaggaactaacatttttgaacccttattgtgtgccaagtattacgctaaattaatgatcacaactgtcctatgagccaacaatattgataatcatcccttttttgaaatgtggtaatttaggcatagggaacttgcctcatttccacagcaaatagtgatggaccagcaaataagataacacctggtatttaaactcaagtgtatctgaattcaatgtctgcactctttcttgatgactactcagagctcccactgttagaaatctcagatctgtcccttccagatctgaaacttaatgaatattgttaattactgatggagcataaatatgtgaaaaaggagtttaacttcttcccccagccaatcaatatctcactatttttgctgttataaagacaccattaatgaagtctttgattagcacctaatttccaaagtactgtactcaatattttgtaagaaaacttaaaagcctagtccaagtgcatagatcttggcacatagtgagtgttcatttaataattaatttatcaggcagtcttacacttacaaagtgcattaactgattattcaattgaccatcataacaaaacattagtacagaaagtgcaggtacagccatctgtcatcttgcaaatgaggatctgtgtatttataaaggttaagtgagctgcccaaggtcatcccaaagtggaaaataaaatatggtttccagagcaattccaagattaatactctttccactgaccttgaaaccaaattgtttttattttataaaagtatcagaaacaaagttttacatattcaagctgaattacttcagcattaatttctgctctttcttaggaatggttaaaatttatttcatttgcctatgattagaaattgtgtacaatctacaaaactccactcatgtccactttagtatttcacatataaaatgttgaatttttaaatttttcttttttgtgtttctaaaggacatttttttatccagctaatggctcaagtgttatactctcttcagcctcttcaaatttttaaattgtatgcattaattttccatgtattgatagattgaaggtaaaagcaaaagtatgtaacaggttttgaagctaggagaaaaatttccagccaaacatactcaaattactaatctctaaagtcacaaataatgcagtctcctttaaaaaaaggtacattccaaatacgtgaaagcaattcaatccaaacatcaattatattgattattcaaaagaagagaaaaagtaaaaagctaagactcagaaaaaaacaggaataaaaataagattgagaatttcaaaaaagagacagatatcaagaaatatttgagattatgaatcaattcagtcaaagatgttaaatttataccaagaaaaatgtagcatggttaaaatataaaaagtgtttatttaagtctttccagagttccacacagataattagataattattatgaggtcgaatagtcctaaaaataaattgtttcactgttaaataagccagagaatatcttaattacttattatggattttataggttattgtttaaagttgtatgctatatctgtcagtgtggaagatttaaaatctcactcttttataaaaaaagatattaatggtgtgcaactcagacttcgtatctcaaagggaacagtactgatgatcttcatactgaatcagagccattcaatagcataaacaaaaaggaattacttactacaccatctacggtgctctaaatgatataaaataacattatattaaacaaaaacacgacacaattttttttacttcaaccaaagctatccatacatattctattcatctcttgccatatagataactttgtgagtttctgcttacatatgaacatattctttctatgaggggaaatgttctatttttatgcagccatggctttgtatatatctgagaaaactcatgtgctagcaagtgcttccagttcacttttttcacagtatctaccacagagctgagtacagagtatctacccaataaatatttgtagactaatgaataaaataatttatttgtggtagtatcacatggacctcaagctctatttggtgtgctttcatggactatatatttgcattgaaatgcaaatatctgtatttcattgaaaattatattttgtccaaaaatttctctcaaaacacaagttttaggttatttttataagttcaaaatcttgtcaaattaaagtactaccaagccctcaaatccttttttttttttttttgggagggaatgtattaggtataagaggctttgctgttatcaattttatataaatacaaagtcgtataatattgcaagcttgatttttagcatatgtattttaataaaacctatagttttaacataatatataatggaatctatagttatttacatgtttttgtatcctctgagcaaaaaattaatatcagttattctcatccaaattataagaaatgaatgaatgtattgagaattgaaaacagtagaattcaattttattacaaataatataaccagagagtataatatttctgtcttcatgtatttcctgttttatgaaatcatttccataaaaacatattgtcaacatcatttgtagcttttattatactttaagttctagagtacatgtgcactaattccataaaagtgaaattaaactgacatgtacttcagtatgtcttacttaacttttatattttttcagcttctcaaaggataaaatgctatcatatgtaattcagtaatatatttttcattaacaaaaatggcactctaactttattagggaaagtcaaggattgaaatcctaacccaaatctagtgaaggtcaaatatatgacagttgaaaagagggtatataaccaagcaatatgaagacagtttctgaagaaatcattaaaaatacaaataattatatttttattgttcttgaggaaaggaatgcagaaatatcttttcattctatttttattctatctacttttcattgcagctatgaatgagactactgactttcaggtagtattaataatatattaataacagcacgaaaatccaccttgatatcactttatagaataaaggaactttgacaatttctgaaaataaacacttcataaataagttatatattcattgttataattggaactacaacaatctggcagagcatttaatttagttttcaaactaatgcagcaattaaatgtaatctgcctatttcctagggtccatgttattttttttggttttaaactcaggcccatggcatatctcaatgtactacaacttgtttctaataacgaagtttctagttggagaagtaaaggcacataagcatgtccaatttgaaatttacaaagaagttatctatctactgcttgtacctatttttttcactataaaatttgcttatgcttgttgaaaatgtaaaaaagaattcaaaagtacttgaagtatagcgttaagtttccatctttaatcccctctagtttcatctcctacacccactcacatcaaagataaccatgttcacagctctggaactgtccaggccttgctcatcttaccacagcataatgcctctcaacatatatcaccaattggaggaggaaagcgtggggtgtatttgtacttatgccaaagcaataagcaccctacctttttcgtgcaattgcaaacttatcttctaaagtgaaaattagtaagagtctaaaattcactacatatattggtaactttcctgaccaattctccactccattatgttgtcaattataactgggcaatgatgaattgaaacatcatttatggtttttttcttcaaggccaagataaggcaagacaggttcttggcaggaaaatttagaagatacttactgaatgttttctgtgtgccaagcttgatactaagtgctttatatttagttttcaaaacaatcttatagggcaggtatttttatctcaatttgataatgaggaaattaaatgtacttgtccaaagtccctcaactggcaagactattaatcagtatttgtactcaaatttgccccaaagtccctcaactagcaagactattaatcagtatttgtactcaaatttgcctgggttcatcctactacttaaatgagaattatttcaaagcgtcaaaaaacagattccaaagatatttttgcaacaaactgtgaatttaagttattgcactgtaggttacttatttcattaaactacttttataatacttttaaaagcacactctcatatattatcatactatattttacccatagtatttggtccaagcttctcattctcaaaagaagtctaaattttagacttgagtatatatcaaatgaaattattcatataatttttgggacactcagagaatagtggaagactgccactttatatatttaaacttgtggcttattacacgtagtgcacatgtggtgcactatgacttgtttatatagccaaaaagttatcttgtaaatggcacaaatgccttatattttatgtgcttgtacctgtatgtctctgtgtatgtgtgggggggagttagaaatgttaatttgttaaatgtaaatgtttaatgtcaaaataataatatttttggcatttatttcttagtgtactacattgggatattaaaaattaaaatgctcccagcctgtctttatcattgataaaaactaggactagaaactcgcctgacctccttgtctagtatccactccattgtcctatcctgatgcgtataccatttaccaaaattataccaattatttacataattggtataattgttcaatgagtaacctacagtgcaataacttaaattcacagtttgttgcaaatatatccttggaatctgatttttcaccctttgaaataattctcatttaagtagtaggatgaacccaggcaaatttgagtacaaatactgattaatagtcttgctagttgagggactttggacaagtaaatttaatttccttattatcaaattgagataaaaatacctgccctaaaagacagttgttcaatgcttctatcatttcctaccatgggtgccttgaaatttttgctcgttttaaatgagacctaaaacccatcactccagaaaatataaattaaatgacattgtcacagaataataaattcatgtgtatcggttacatttctctagaaaagtatttaggaataacatgaaaaagagaagtagagtaagtcacttttaaacttttaattttttagcttcaagacacagaagaaatatattttaaatggtaacccacaggctatttatggctatgtgtaactaaggtgaaatttacaaaatacctaacctatgatgtaatacatgttgatatttatattttactctagtctattttaatgtattctctattaaattctgatttcaaccctctaaattggttttacaaataacttatgagttatccactatttgaaaaaaaagaaaaacaccgactagataatctctttctttagaatctcattgtgtgtgtgtgtgtgtgtgtgtgtgtgaaaatcaatgtgtaaatgtaacattgggctgaaatcacattacaaagtcccctaaaataaatgtatttgactattacacctcttgccaaaacatctcctcaattcaacatttgaatgtttgataaatctttctggagtatttgcaaatgtgccaaaatgagatttcataacccacaaccctgatgaattccaaagaattgcctttcatatataaggctacattatttaacaatatatcctccagctcttaaaaaattctgtaccatattgcttcctgctattattggcatctgaaggacagagtgtggagcctgtgatggagatgtaaatagaaataaccaagcacagtctgtgcttttcatcagactcacaaagaggtcttctgtgaggtcaacttgttaccacaggcctcctccttaatttgttttcttttcactataattaacccattccatgggaacaaggaaaggtgctgctttcaaagctagataaaaagacacaaaaatatgctcaaaagatactctcagtggagaaacaagtagggttttttgtttcccagggaaggaaaaagaaccaggtgatgtccatcctacttttccttggagccacacctactccaatgtaaaggaatgagatttagatttgtttcaaaggagttggctttggatctaaatccttgctctgccactaactttagctgcagaaaaaaatcactctttacttgtccattctactaaaatggttaccttatcagactgtgttatgaaataaacaaactaaccaaatttaaaatatagtatatatggtcaggcgcggtggctcacgtctgtgatcccagcactttggaagtccaaggcaggcagatcatgaggtcaggagatcaagaacaccctgactaacatggtgaaaccccctctctactaaaaatacaaaaaattagctgggcacggtggcacgcacctgtaatcccagctactcgggagactcaggcaggagagttgcttgaacctgggaggcggaggttgcagtgagccgagatcgcgccactgcactccagcctgggcgacaaactgagactccgtttcaaaataaaaaaaaaatatatatatatatataaagtgattatgtttcaactcacaaagtagtaagatcccaatggcaactgattgtcaacattgggaattatcagaagaacaaatagtccaacatcgttctttcctcaactgaggtttaagtccattttccagagtcctccaagtgattgtccattgcaggtttgtgcacaaggagttacagagaactaactcactatctcctaagagtggcaattcctttattgaacagttctgctaataaacaaaaaaaaaattttttaaattaaaccatactttgttactcttgtattttagtaattagctgtctctgtcaactgctggccagagtgaacctagctcttttccacctgaatttacaaatatctaaataaacaaaatatgtaaatatatcagatacctaaaggtagcagtcagggccctgctgtgtcttgtcttctctctactaaatttattctgaggatatgatttcaaattgcataaccatttgggctactctcctttgaacaggccctgcttggttgcatttgatattggtcttgccctgtcacccaggctgagtgcagtggtgcaaacttcgctcacttcagcctcaacctcttgtcctcaagtgatcctctgccacagtctcccaaggagctgggtgcacaccaccatgtctagctaatttttctttttctttctttttttttactttttgtagagatagagccttattatgttgcccaccctatgtccaacatttaatgtagcccagctgtagtctgcagaagtttgagcatagcaagtcacagaaacttagtcttgaaagaaatctgtacgaacattctttgtagtgcctgtttgtataaaaaaaaaagatgcaaggagttgaagtgactttcttggagtcacagagtaaaatccttagttctcatgtcagttatcttacttttagcacagttagtaattttaacttatttttccaactccaagatagcattaatgtaatcatcatattttatctattcactatcaaattaacaggataatgaccagacttacagaagagcctgcaaaaacaaaaacaaaacaaaacaaaaacgcttccagataaaaagagatgaggaaaaatgataaataagaaagaaagacaatgtcggttgtcgtagctcacacctgtaattccagcacttcaggaggccaaggcaggtgggagtttgagaccagcctgagaaacacaataaggcctcatctctacaaaaaattaaaaaataaaaattattcacacgtggtcacatgtgcttgtagtcccagatacttgggaggctgaaccaggaggatcgtttgagaccaagaggttgagactgcagtgatctatgaccatgccactcttcttcagcctgggcaatagagagagaccctgtctcaaagaataaaaaagagagagagaaagggagagagacaaagaaaagggaaggaggataggaaggtaagaagttataaaggaaggtaggaaggaaagagaaggaggatggaagaaaaggaggagggaaggaagaaaaaaaattctcaagatactccctctagagttttgaggatctctattcttgctttctcttacatgcttgcttagtttatgttgggcagaatttactgtgcataatttgcttttcattctgtgttttatgtgtttcaagctgtacactggaacataaacatctcacagcatgccctctcattccccagcattccttatgcagaagcaacttcaacagaagtggctgaacactataaacctagaagctaaaaggttttaatgacatctggaataagagtgaccaagggaaaacatgcatgtgtgcagctgccatccataagatgggtaaatactgaatacctgataggctacatcctaagagatgatcttcacatttaggtaagcatctgattatttagaactgtggaagtgtccacaattgcacatcaccagagatatttctgcattatgggggagcagtgcagtgaaatccgctgaaaacaaaattccttttaactcagcttagtcatcctggacatggagtatttgtgggagttttctagtattttcagcaattgatgacagcaatggtgcctaagagagaggaaggtgggaagctatcccaggcattagtctcttataggtgagccagagtctaagccagaaattgtatcattagaaatgaatctgaatatagaagaaacactgcccaaaccacatgtggatatgtcagcaagctctatatttttctctgaaagaggcaataataactctcttagaaattatttactgagtccatagactgttccttctggaagggaagaggagggaatgcccctctaaacgctctttccagagctatctgtatttttttcactgctagcaatgaagtttctgacagtgatatatgaatatgaaaaactgtttctttacaattagagttgcccactgtgtttcccagattacggatccagatccaacttactaaagaattcccctaaaagtttctgcatcttctaaattgtatatattgttaagtcagtggtaaccaatataattatacaatcaatccataatttcaaagatttctggggatctcatgttttcagaatttttgtggagcaaaggaaaatctttcagagtttccgcaaaccttcgatacgacccaggaaaaggagcacttcatctaatttacagatcaagagcaaattgatcatgctatttctcaaggctaatttttatttttattttttgagacagttttgcttttgtcacccaggctggagtgcaatggcatgatcttggctcactgcaacctccacctcccaggttcaagcaattctcctgtgaaggctaatttttagatgaattatttcatttgtggtcccttctactatttcagatagttattaacactttcagccaattgtttagaaatattggtgccactgagataaagggagagtgaataaaacaatgcaatggagaggtagaaaaatggcaaaaaggaacctgactaataatctccagcaatgttttggaaaccaagttctggacagaaatcttgagttccaagacacaactctgcaactaattatctgacaagcaaggtagagttatgtgacctttctattttagtttccttaaccgtaaaatacagaagattaaatgctggcctgagacacagtgttaacattctatggaatgaatagtaatttatgtgtctttattattaccatgatcatcccaaaatttgttttaactctcagcactgttcaattcctggagaaacaaaataaagtccttttaaaaattattcagtagcttccacagtaccatttattatttttccaaggtaaattgtcttgtgtaatgataattagtagaaatgctgagatgggaaaagtgtactcccagtttttagaagtcaaacaagcatatagactatgaatcatactgaagttccttcaatcaaagctggattgttatcacatttttaagtaaataactgatgggaagtcatattataacctgaaattgcaatctctaggttaacctgaagaccatatcttcaataatgtatgctaccagtacaatttattggtacatttttctccccagaacatcactgatttgttttttgctgtaacaaattaacattcctgtcattagacagaaataataaattcaagaaccagtgaaaacagaaaatgaagtgtagcgtgaacaggattttacaattaatcaagggagtcattttgacacctcatttttataaagaagcaaaactaaaaacttacaagtgcctgctatttatccacatactatatagtcataaatggtgagctacgtacttcactaacacaaattcctctattcagcaaatagtctttgagcacatattatatgatgggcactctaataggccctgtggatatgctgtagattttcaactaaagtcaggaaaactagtgaagtgtgaaatcttgtcaatcacccaggaagtacaatataaaatttttttttgtataaaacacaatacaataattacttttcttaatgaagttgaactagatcaaggtaaagaatataataatgaaatatattcaagcgcttaactatttgaaacattcagactttaagggaactatcacatctctagccacagaagtataggcaaagcattttaaatattctttcttgcccacagcatatattctgttttatttcatattcgaatttcaagaatattaatgcatgttatttttttttttttgcttttgaagtttaagcaatagtatctgatttgggagaagggaagttagagactaaagtgagagggatgagtatgtttatactggactccatcctgaaggcattttttattgctaacaataatagtcagctgggtaatgttgagggtttcagctgggctcaattatgtgattgcaattagctgtgggttggaaaggcaattttgttgatctgcattgcacgctctcacatgtttgaggtcaactggtctaagatgcactcatttggaaaacctgggtgctctcatacttcacagggtgacaatagggttccaacacaaactaggaagaaagttctcacgtcaaccaagtgctattggtcaaagtgtcagaaggccagtgctacatgaaagtaaaagggaattatcaagtcaaaagcaaatgatgtgaatacagaagcaccattagtagacgtcatcaatgcaatctgccacactgctaaatgggcaagcaccatcaatcctgtgtcatcgtgggcacatgtatcaaggtttgcaaaagtactaaggcaaaggaccctttacatttccttagtgcagagagagttcttactccattaaaagaagtgattttacttttcttctgagtcattgcatattcctttcctctgcccagttgaagagctagtttgatctgctctttaaaaaatgctttcttttttcttcttcttctgttttatactataaatctctttgcctagaagttccaggcataatttctgtgtaatagaacaagccacagtaaatacccagtcacacagcctactaaagccataaatcacaggaaatagcaagtgtaagagattaacatcgaagctgaaacccagttttccttgtacactcctctggaattctgtgatgacatacactttcttgaaggaacatcttgtggtacccgtgacacagtacggttaggtttaagtataaaacacataggcaattaggagaaaaaatgttttttgaaaataggaccacatcttttcacagaccttaatggttcatgtgaaagcatttggaaatttccatactcttcaagaaagagaatattgatggaacaaaggagaataattataagaatatgaagataaattatcaagtactgggattaattctcctaatgctagagaaaatcacctcaacccagtgagaggaagagactggatgataactgacactatcatttcatggaagatcccaccaagactttctgaaaaaccaagtggggaggaaaaaaaaaaaaaagcatgaccttagagagttcccacagtacccaacaaagctgtatcctgtttgactctcacttttctgatcctggaggtgagtttcaccttgtgaaaattcctaccatgccattcttgtactgataaatcataagacttaacactacataacctcgttattcacatacttgcttgggatcaaagcaagataaatatttcttgacacaaccacataaacagtaagcaaacgagtatttcttccaacctttgaatgtccaattccaaggtttgttctctcctgaatcctggtggtacaacctaaatattttgcctgaatttggcattgcaatttctattgtcttttgttttcccacaaatagaatgttttcatgtaattgttatatttcagtaggtaaattatgtatttaatatagagcttaaagtgtatgtatataaaaattatgcataaaatattccacctcatttcttaacttagatttcttctcagaagcagcaactcttagtagttttgctcttctctgagaacaattctatgaagatccaatcaaattgtttgcataaaaaccccttttagaaaaaataaaatgttatatatacagaaatgccccttgttttattcacctaagatgatcttggaaattataatcattacctagtagaatgtctcacttattttaatagctaaatgataatgcattgtttgaatacatcataacttattttattaggttattagattgttattggggtaaatttaggataaaacaacagtttaaactagtaaaagccaaaggtcatgactaagagtttcacttggggcacaattgaattagcacttgccacaccgtgaccaagcactgatcttctgaagctagaagggagtccctaataaaatgcatgatttatttgatgcaaaccaaaacatacctttacaattggccttttcaagcacatttttactttctcacctagtcatattttcttatgcttttcactgaaagccatccctgctaattttcaccaattgtcagtattcttcttgttaaatttcaattgtcaaattccatttccttctgtaagattcccaccatgacccccataaccacagaggaggaggtgatttttttctccatcaatttcctttagagtcagatttgtaacattgtgtcattttgaattatgattatgtaagtatttgtgcatgcctcatctcctttgccagattgcaatcccactgaagtctgtgatatagaaaacaaagggctatcattcacaggacggtcagagagccttgcatatgtatttgtgcataatatgtgttgcataaatatattcctaacctctgaagtggggttagtaacttaattccacattttaccagaccgaaatatttggactatattgatatgttaatgcagaattttaagaatctcaacaaatacaataattcgatgatttataaaaagtattttgtatcttcttcagtattctatagtgtttaatatacacatttttttttttctagaagaagagctgcataacaagcgagtctgcccatttgggtcacaacctctgtaggtcaaaacaaattttttccaaacagccatggtcaagaactaatgatttttaaaacaccataaaaaacaaagggctacttattattaactattataaaacatcagtcagatttttctttcctcactattcttggagcacaaagaagcaataaattttaaaacaaacatgttgaattatttaaaattatacttctcaaatatgttctatacaaggataaaattaatttattcttatctccattttggatttgaccatgaattcttctgaaaaaatagctgtaagaccaaactttttggtaattctctataacaacacacctaggttagaactggctactaccttcaatcctatgtgtatttatgtgtaccttgctttaactattagaaacaataggcacctagaacaatcgcgaaatgacaaaaatatgaggtgttcaatgaagatatagagacttgaaaacctctagtaatgaatataaaaaatcattagagtagaagtataatatagcatcagtatagcagaagtaaataatgtaattcacaatgaaaacaaaattatatttcaccaaatattggccacatacacccttctgtagtttaagtctttgtctctctagatatatgccatccagtctgttcttatagtactggtataactcggacaattcaaaatatccaaaataattaggaatagtttactcttcccaaacctgaaattgtaactgttgagtgcataataatatatactcgatgtatgcaaaggaaacttaccttctgtgtgcacggctgatacataggtccagttgtacctcttcactatgtccaccatggcccttgcctgctgagcatctgaaggcacaaccctcatgaaatatttgaacagagtcttgtcactcagatccatgctggttgctgagtaagcaatctgaggtatgttgaaaagctggagcaaattctggacctgaatggctacagaactggagccaggcccaatgacccctactatgggcttcttggagcggaaggaagaggaggagccatccacacagcgtaccaagccttcttcctcttctgaagaaatgagggaatctcttatgaactcaatgctctgctctagggccacagccgaatgccagcaggagtcccttatctcacagcccagtgtgatgttgggcaagagtgtggggtctgaattgatcctttccagggtatgcagcatggcctccactctctgaatgccatactgttcacggaccgccccacacttcctctcatgaactttgtccacagtaggctggtgatgaacagaaaagagagctccaataatgatgtcacccggcatgtgagccaccaccctcctctcactggactgtgcactcccacggacatcttctttcaaaagtaagactgacaggatcaacagaaggaccattttaggaaaggagttcaagccaataaagatagcatggtggggaaaattcaggagggttctgatagctacgaacaagcgatgtcctacgttgagtcgcaaatcaagaaattagccagcaattcagatgtattttctaaaggaccattttgtccccatgtaccatttagttagatgatccatgtggtcatgatcttctaaac

SEQ ID NO: 687 - DNA, 162922 bp, Homo sapiens
attctgtaacttttttttttatttttttcaatttttccttcttttttttttttaagcactagtctgtgctttgcgaacagaatcaagacattaacaaagatcagcttctctgaagaaaagcatttctatagaacaaagacagctacatgtttcgctgccattacacagctccaaagcaggaaaagaaaatatttacaaaatacaaggttttttttttccattttttgtttttgttttttttttcaatgctaaaagggttattcagaattttcaaccttataaatagaagaagcactttatgcatagggatatggtgcattattgtatttttttttaaagaaacaatgacaaaccctttaacttgcaaacagaaaaaaaaatcactaatgttgaaaattgtgaaaaaaccccaaccattaagcagttgtctactatttttatacgattacaaaatggccaaaaaaaaagagtcttctcccccctccccctttttggtgatgtgatcatacaggagacaggcacaaggttaacagagaagggtgaagggggaacaatgggaaccacagctaggaccagacaatgttccacaggcaaggggagcgtgaaagaccaagagtggaactaacaccgacagggatctggatgtgaaggaaacatggcaaagtgaatcagagggaaaaaaaaaaaaaatcacacagggagatggctgctcacttcccacaacccccagtttgcaggggagtgggaatagaggttaagtagtcctaaccctaccttcaaagatcaggataggtggtaaaaatattccaagtggaaggacgggttgtgggtgtgtacatggcatgggagagcagacagggaagggtaccaaggggcatgaggaggggaacctgagcagccacagccaggttactgcagtgaaagagtcaaaacagagaagaccaaatgcagatgaaacaaaaaatcagtctcttaagttctgggtgagaaaggaaaggtgttctgccagctgagcactcggggagagcagctggcagttatggcagagaggctctggtggggatgttccagcacgaaaaaccaaggggacccagccaggagggccacagcagagccaagccacagatgggaggggagggggtaagagtccagagcaccctgccccattccaccctagctcaagaaggccatgctaaactgtagcccgccaggctgttctgccctgcccacaggtgtgagggagggggtggtcatctaagatcagtaagtccagtgattcaacagtgcagaggatgtgccaggaccaggccagcagggtctcatcctgaacttctgtttgccaacgggaggaagtgctcaggtgtgtgacaagaaaacatggaaacaaaaacaaaacaaaaattaaaacaagaaaaaaaaataccaaagtaggatctaaattccttaagttcactaaaaactgtgaaaatttccggcatatgatgtttgaatatcaaacgcagagatttctgaagctttaatgccaatagttagtgagtctgtttagatggctgtctcccgctcatctgtgagtcgggcgctgagctgtggctgctgccaccagatgccgactcttgagggggacaatgggaggcgaggtgggcgctgcctctgtctcccggccagtcttgctgcctgaggtgcgtcgagtgcagcgggctgctcgctcctgtgcatccagctggtcctcacactccgcctggggactgtgcgccagggggaaggtccgccgctcccagggctggacagactgtaggcagacaagttgctctttgaggacccagtcccagccagcctgcttcctgctccaaggccctgccacaaaccttgtggcctggagcctaggaccagtctatctagtgttcctgcgacagtctgggaacacccctcctagggtatacccagacaactgtattgatcatttagcagtgatcaatacagttccactgaacgttgaggagatcaatttaagtgcagccctttgtcccttcaaaagggggaggggatggctaggtccctcttcagcagatgctgccccttcctggttccatcccccaaccatgccaaccccacccaaaggctgcgtcccttacctgttcatccagccccagctctggtgtggaacaacgggtatcctcactggctaagtgtcgcggagtgtcccgagccacaggggtgaggggtgctgagtgcagttccgggctaatggggctcctaggggactgaccatgggagtattctgacaaagagtggctactgctgacatcaggggaggcaggctggggggtggaggggttggcactgcccagctggggggttgtccggccgtctgatgacctgtaggacctgcacaccaaggaatgcaaatctgagtgcctgggaaatgtttacttatgggggtagagggcatgaaaaaagcatccccactggaggagttgaggcaaacaaacaccaacagattttccttaggatccagcaactcccatttcttcccactattctctggaggggtaggtatacaacatttaccatcccaagaaaaaagcatggctgaacaatgccaggtgagtccatagcaaagtgcctagtgaattcaggaggttagggagattcgtgtagactttgaaaactgtagtcaaagaaaaaaaagtaaaagtaagagctcccaaaactttctacttgagaatcccgagggtttctgccactgttaacaataaatggagacagggtagtgatggacgttaagggggggcagtttcttcaagtggcatcacaaagccactgtccaaaggaaggttaacttgtagcgaggccttccaagctccccgggttgaatcaccatgaccccccaactgtcttccaaatgccacagatcatgggaattcagaattacatagtgacttctcagcaaggatctagcacttggctccttatatctccactagttccatgtatctccactagttccaacaaacaccaaggaaattctgagctatttgccactgccagtagatgagtatgatgagcaaccaagaggcagtagcaattccatggactcaagtagggcccaaactccctgtccaccctctctccacaggccctggggacccaagcctgccccatcacctgctgccccgccgctggggtggcacactcgtggtccacagccaccgtgccctctccatctcctcacatttggcatgcagggcggcgaaggctgcgtcggataggtcctcaatctgcaatagagcagcttcatcgatcccctcttttctccaggagttaagaaccagtcccaccccattctaggttcttcccggtcacgacaggaatacaaggagcttgcacttcacacccacaagtcttcaggccatttagggtgtgtgcactcatatgtatgtgtgcatgtgtacacacgtgttcttctaacagaagaaccaggccattacctcttcattctcctcatcaggactccccttcagagactgaagatcaacctcccgccagctgcaaaaccaagaacagacaatcatgagatggcaagcaggctaaaactgggggcagggtcaaagtgtccatgcaaggatgagaatcctgcacctgtgggtgacactgctctctgccgggtaggctctgccctatcacagctcagtctccctaccctgtcaaggcctgtgaaattggccacctactcaaatgcccaagaaggccagaaatgagagaagcggcctagggtaaggctgaggctgagagactgtgacaaacacaagaaaagaaacctgtttaaagaggaccaccactgttcaggaccagctgattgctcccatatggaaatgcatacccagggttgcctaatcttctgtttggcaacaaaagctggaaacaaagatttttatgtgaaatcctgctttgatgttgacaacaaattcagtattttaaaacatactgtatgtgttgacaaaaccggtctctagaccagtaagtgaatggcctaccaggctgtgactgctggttcgtttggtgtattcctataatggaatgagagagaactatatacagaaataatttcgttcttatcagataagaatttctcttaatgagaagacagaaccaaagactagggcccaactcttggtcagaagagaagagggaaaaagggcaatagcaggaagaatggggagaggagccaactattctgagcttctacctgggcgtaaggatttccttgtattgcagtttctctacgcgagttgttgcagcaacagacattgggatgacaatgttgttaatatcaaatgagctctctccccttctcctccttactggctgctgctgtaagataaaaattaagtttaaaaggaaggtacaattttacagacatcaaatcattcatctaagagttaaagcaggatcaccaataaccaagcatctgggtccttgggttgaagctgagtaatgaccatagcagctgctcccacctaggagtcagtctccaacagcaaaaaacctcacggagaaataccaggtggtcatgaggagttagtcccattcataagtcccactggtcaccctcttccttcaagggctcatgcgtaaatttcataggggtgggtacctgggatcttaactgttggggttcctactctatatacacctctattaacctcctctccttttacaatctttatttccttcctttatccccgtttatgacttaagactcatagtggcccctcccctaaaagcaatgcttgaaagcttatgctgaaagaggcccaaaggataggcccatctcaatacatcatctaaccttggttgtcatgaatgcacctccttctcaaagatctgaactcttcagctaaatctgcacccaccatctgcccagtctttatgtgatttcccctcttttgatgattcttggggaaagagctgagagctttctagctgtatcaaaggagatgaatggagggaaactaaagaggagaacctgactatacctcacattcctggtgaaaggaaatttgcttctataggaaatagttgagaagaccaaactcttggaaaaataagacttccaaggatcgaatatcagaggcagaggtaagcatctacagtagctgggagactagggaactaaatggcttagtctcttggatggaggaagaagtctactagctgctgctgcccagatagttaataccctatcctgaaacagagactagcaactgagctgtgagaggccagaaggaaacagtggcataacaaacacgctgccatggcaacaaaacagctggaaaacacctaagaggctgcatttatacctaaaccaccaagtgtggtcagtccacagggaaggggttggaggagtaagaagtcccctataactaacccctctatcctctgttcctggacggtgagataccctttattcatcctatcatcttaggacattctcagagaatgttaaaagtcagcacttcctgggccagagtttcagtcactgtcatttataacttcagatgaccacaatgcccttttcacttcaatttctttctctatcaaatcagatgactgccattgacctcagaaatttaggatatctggttaaccaaaatggttaaacagacttttggggatcttgcctgagttctgtagctgaggattagtgatctcatacccagagacctctgccactgccagatctgtgctgaaattatacatcccactacaagaaatgcatcttaagaaagcctcaagagagacagccttcccagtatcttggtcaagaataaatgtgaaactgctggcagaaacaggtatacactttccctgaaacttcttgggcttgttgttagtaccttcgagaaaaagatactggagcaggttgtgggatggttcaacgggctcttatctcatcctctgcctagacacaccccctattatgttagctactcattaggtctaaattaactactatctcctatttagagccagagatagagagcaggtgatgagaataaaactggttcccaaacttggttgtatatcagaagcaacattaaggagtattttttaaaaaaaaaaaaaaggttctaggactcccccccgctcttttataaaatcagaattttgtttgtttgtttgtttaagagatgaggtctcactatgttgtccaggctggactcaatctcctgggctgaagagatcttcctgagtagctggagctacaggcatgcaatatcacagccagcaacaaatcagatctttagaagtgtctggttggttggttttgttttttaaagctgctgaggtgattctgatgcagctactggcttttgggaagcactgacaaaaacactcgctctcctccctacctttctccagtgtcctctggcttctttacttgatttcaaggagagctggccctttgtatccatgggttcaaccaattgtggattgaaaatatttgggggaaaaaaattgtgtctgtactgaaaaggtacagatttttcttttcattattctctaaacaatacagcatactatttttatagcatttacattgcattaggtattatcagtaatctggagatgatttaaagtatatgggatttaaagcatacacataggttatatgcaaatactatgctattttatattagggacatgagcaacaatagcttttgctatctatgggaggtcctggaaccaatccccactgcagatactgcagatactgagagcctgctgttatctggcctatcttctttctttttttttttttgagacgaagtcttgctgcgacgcccaggcttgagtgcaatggcttgatctccgctcactggaacctccgcttcccagttcaagtgattctcctgcctcagagtagctggaactataggcacatgccaccacgcccagttaatttttgtatttttagtagggatagggtttcaccttattggccaggatggtctcgaactcctgacctcaagtgatccacccgcctcagccgcctccccaagtgctgggattataggtgagcgccactgtgcctggcctatcttcttttacataaatccagagtctttgaaaaaacttggcaatgagagagcctcaggggttagcatagtgctatacacaaaatttttactcaataaatggtaaaaatttcaagtgatccaggcctaagttaacattctccagacacagaaatattgaagtgctcaccaagtcctgaatctctgagttcagattttctatcagaattagtttagactcttttttataaatactttggttatctgaaaccctttgctgctggataactgagtatgtgagggacactacacacctatttagataaaatttgtgggttacgggggtaaagaaagtcgaagagcaaagagaccatttggaaaagattgatttgtaacagcaaagagagaacaatgtgaattcctacctgatcacaggagcctagtgagtccattttatgagcttggaagtttcctgatctaggctctgaaggaacttcctaagttgcctctgcaataccctcacccaggcttagcctgtgtagtgtaatggtaaaagagctggctctacagtcaggctgcctgagtttgaatcataattataaccctcacaagttgccttgacagttttcatgcatataaaatgaaatccacagtaccaacctacatctcaaaaggcattataacatgtaacacatgtaaatcactgatcactggtatgtagtaagtgttcaataaacattacagttgcagacttttacatttaccattacattacattgtaattattatacaaaaaggaccctttgagtaggtccatagcagctacaggtatgtatgttccaagagggcacacttgaggaattaaaatattagaatgaaattaaaggaaatgtgtctggaatagctgtgcaaactgcttccagatggagtgtggtatcgtaaaatctggtgtgtgcatgccaaatgtcctgccatgggggcctgctggatctgtaattctgctctgtatacctaaaaagcatggactctgccttctcccttcccttctcttctggtaccctcacgcctagtgtttattcttagtacttcacctccactcacccagagagtaaaaccaaggaaatcaaacactgcttccaacgcccatgggaatctcccctctacccacccctcctctcttgttcacttcttgggccaacaggattagggccacggaactgttgagtcctgtgtgaaacttagtccaacagatcttgaatagtcacagatcaccttaagagtttgtccctgcatcaagctttctatggatggctcagcataaatccatctctgctatgaaaaacaactcaagaaaaacaacagaaggtcaagtaccatgactttgacttaaaaatggtacagacatacatacatatgtcatgatgagctgagatcctataaatgccctgggctttataacccaccctcacactgtcctctggagccacttgagtgagctgtgacctgcagagggggtgtccggccaaccccacacaggtacttaccgatgtgctggctgtaacctgtgagctagagctggcgggtgcaggggaatctgaggaggtggagagctgtcgcaccaagggactgtgtggaggatggtgggtggctgccaagtagctcgaactgctcatgtctgtgtgatgcttcaacactgcagaagtcaacagaaaagagagaaatacatggctatcttaaccagcgttacttctaacacaagcttggaatggcagcaatacatactaaaggcaaaaatgttttctatgcctagaggataaaaaggtgaagcacactagctgtgggaagtaggggcagggcagaggttgctgtagcagttaagaagtgacctccatttagaagcagtagcgtccctctactctgctttcctagaaagtgaaggacaaagctgggggtaattaagagaagcctaggctgccccagaaagccctgagcaggtgcagttgcaggtagaggtgccatgggcctggccctaccttcacttctctcagatgaatggtctcgcaatctcattttgctgtggtttgggtcatgcacgggtggtggtgggttgagcaagcgctctgcttttggcgctgtcactcgctccaccatgggcacggcccccacatcgtctaagtgctgcctgtgggtcctgtcaggccgggtttggtgatgggacagctctgaagaggggaacagaaaaagagctgtgaaatatgtcctctcaaatattttcttattcgagttccaagctctcgagttctctctaggccaacgccgtatacccagggcagcaggacagtccttcaggactgaagtttctagtaatttgcacaatggctaggataggcacagggagcccagaaccagagaaacatgtcaccaggatacagaagacacctgcccgtagatgaactcaatgccatgccattgctggctgttcactgagcattttgggtcttgctccaagatccatggtgtctagaatagctcccgaagtccatctgagagcatccaagacaagcagaagcagtcactgtgagctgaattttttatcggtcaactgcctctcccaaccccaacatgcatgcaaactacaaatttgagaatataaaaggaatgaaaagtcactgatactctgggggacttcccggctccctgacacttactggctgttgttaggaaggagctgaccaatttgtgcctgtccttacgagctgaatctggcagactgcccggcatgggtgctctgtgcttaagcgataactttttgggaggtttgattttgtcaaaaggcttgttctgccactgagatttcagcatgctctggaaatgcaggcttgtgggaacatctgcaagaaacataaaatgctacaggttagtccaaacacctggcctctctagtgttcaagacctacactccatcctcctttaatttgcccagtggcctgacacttggcagggcaagtgctgtcatatggaagatctgtttacgtgaacattactgaaggtcattcttctatttgcaagcaggtcactttagctttttactttcaagtcccaaagggaaacaaaacaagacacctttttggtttggttgatggagtttttgttcttgtatccttgtttgttgaatttactggtttgaaaacatcctgtttctattctagagatttaaaaacatatttaagcctacttcttttctatcaatataaagttaatcaggatgcaattattcaacaatattcattatctatgttatcaggcactgtactgagtactacatactctctccaaataagaactacataccattctctctttccttcctctgtggctccgccaattcccatcatgagattatcggggatttttagctgactggttaatgttcaatatcacaaatcaacatcttttggactgaattttttatgctgtttcttatctttccattttcttagatttttcccaagaatatatccttgagcaattcctttagaaaaggaatttctagatttaaaccattttcctctcaaacatttaaagctattcaattcttccgtgtattctaatatccagtgctatatttaagagggaatcggattctttcttacttgtaggtggtctggtttttgccttttaagcttctgcaaaaaacaacaacaaacttgtggtattacactgactctacagatcaatttggggacaacttccatgtgttccaccaccaatactgaatctttcaatcgactgacgtggtatctctctctccatctatttacgtttgtcttgattttctcttgacagcgtttagttattgttgacataccggtcttaaatacaatttgttaagtttattcctaagaattagtgttttctgatgggcagaagttggaagagtttgcagggttcagaagaagacaggaagatgagggaaagtctggaacttcttagagatttgttaaatggttttgaccaaaatactgatagaaatacgggcagtgaaggccaggctgacaaaagtctcagatggaaatgattaaagatagtaccttttaaaatttcaacttcagttcttcattactagtatatagaagtacaataaactgctatataatgaccttgtagcctgtgaaactacttcgttatagactttttcttgtttattcagtaggattttctatagacataagtacatcatctacaaatggagactgttttaccttttctttccaatctgtattccttttttacttcttgcctattactctgactggaacctctggtgctgatgtacaacttttagattttccttttcatgttttcaatattctgacatttcaccaccatggatagcggtgtgagtctgttttcaagcttctgcaaagctttccagggatattcaaatctaaaagccagcacatttttcctcacctcccagttcctcctgggaatcggtaaccacttggggcatgctcagaagttcccgccagagtccctatccactgcttcagaatagaatgaaacaccactacttcaaggaagaaggctctggtggggtgagaggacaggaaaggaaaatctaacctagctattccaaaatgagtccaaatttatcacccagacaaatgcccaggtcctatcactactccttctgccctttaattctgggtcaaaaacctcctgtaatcagttcccacctcacagcaacttactcctggcatgtgctttgggctatctttctatttatttcttcacagttatcttgtctttatccatctttcaaaaataattacaaattccagtcactgatagcatgtcttctagaactattagaaatttattttgtgtgtgtgtgtgtgtgtgtgtgtgtgtgtgtgtatatttttttttttttgagacggagtcttgctgtcgcccaggctggagtgcagtggtaccatctcggctcactgcaagctccgcttcccgggttcatgccattctcctgcctcagcctcctgagtaggtgggactacaggcacccgccacctcgcccggctagttttctgtattttcagtagagacggggtttcactgtgttagccaggatggtctcgatctcgacctcgtgatccacctgcctcggcctcccaaagtgctgggattacaggcgtgagccactgcacccggcctgtttaatatattttctaaaagcttatggggttttgggtcccatagagcacagaggatatgctcaatctgaactgaggataagaaggcagggaagagacgtctaaattaacattactgaacccattattatctgccaggcactgtgtgtttatcatcatgcgtgtgccacttaatctttgtaacagttccatgaggcaaacacaattatgcttattttaaagatagggaacaggtgcagaaaggtacattaactatgtccaaggttacatagtttaatgagtaacaaccaactttcaaactcaagattatacaaccctaaagcccatactcttagacaatataccttgaggctactcactgatccagaggatggagaggattctgtagtaaagtcaattatttctcaaattactcccaagaaatagacagtacaaaatattttccaagccagttctgcagagtaaaagaaatttagccactcctgcctatggtatagatgatgaatttcatgacactgaatgttatgccttcgaggactgaatgttaggccttccaggactggaataaaaatctgagttggggaaaaaaaaaaaaaaaaaaagctaacattctcagggatgatttttcccagtgggtaagcaccctcagctccatgattgctgggctttatgacagtgaaacaaattaggaaaactattaaagttttaatgaaaacataacatttgctacctgtccaagtgtaaaaacacagtctctgaggacagtgctgtcttctcaaacatttttcataatcactcttttccacacttaaaaactcagctataccaaatcctaggaaataaagcattgtctagaagcattcggccctgtaaaacaatctgaaagctgggctgagctggaatgtataaaagaggctcaagaaaggagacgaggtcacttctgcccatcccacaatacccctttgtcagcagaagagttactcccacttggcaaaggctgtgtatgttttgtatatatatgtaatggaactccaaaaaacatagattttattttttccttttattttcccccatcgttctcccaaatctgaaaatgaagccaggaaaaaaaaaagggacagggatatgagagacctggttatagtgaaaacagcaatgactagaaacaagtaggcctggattcaggtcctggttctatctcgagtagaaggagaaagcaagaacaaatcattcagctgggctttagttccacctgtgaaatgaggcagtggggctagatcagggctggcaacattctagcattcattctctaaccctcctgttgtactggaggtacaaacacagctgtctttcctgttgtactggagacctcagattcttcccaaacaatacattaaataactccagacagttactgtcaattcatttgaataggcacaagaaaggacatctatttgttactgctagattatatgactgctatgagtctctcaactctaaaatgtttagtcaatgactcttcaactggaactccactcctaaacccttcccctcaactaaatgctcttaagtgcaagttggcacattgtagaacccaagtcatggaacactaccttgtactctccagttgacgtattaagcggaatcaagagcgattcctctttaaacccagtataaacagtttaaggaactccagctgctagactttgttagaagtttgctgtgttgccttttaattgcttccatgttaagagtgaacaggaacccagttatatcccccagtcagtaaaaaaaaaaaaaaaagatatcttaggaattgctggttgagttcatatactaactagtaagtgataatacctaggttctgtgaagagttaaaaatctaaaatagactggatacgggacctgaaagtaagcaaaaaaagggatatgaaatggaagagaacacaccagagatccattcagctagaggtctcctacattccatacccacataggtaaactgctattttcagagaagagggtgctgatccttatcaggtaaataacaggaaaataagacgaattactaatgtcatccttaagttactgtttcctcaaacaaaatgaaagatgaatgagaagaccctgacttcaggatgactagggtctgacattccacgattcacctggctgtctggctccttactttccaccattttctcaggcgcactttttccgggtgttttgtaatgctcacttcttcctcctgctgggaagttgctgtagcctcatgtgcagggtttggcaagctctctcaaaataccacagatcttcatggccagcaggtggtgctcttattaagccccttttataaagttaacaagcttttctccaaggttatatatcctctacatttccaactaaggattaactggatttgattacttgaggtgataaaacaaagcccccttcctgctggaatactaacaggttattataccctagtctctccaccttccacagccaggcgtagagttggctataacacagtccctcaatttctatcacccacacacacttaatgagaggggctgaggtacagtcaaggtgcgaggcacaactccaggatgaaaagcagcagttggttgttattctaacaaactacacaaactggttaggaaacagcactaaaactacttaaaaaaatatctgtcctatggggccagaaaacagctaagtatcacattcaaacaattttctgcctttatgtctggtataaatgtaactatatggaatcaatgaatcaaaatcatttttaaccttgttatgaaaaaaaaaaaagttggaaatcctgccactttaaaacatcttctagagaagaggttgtaagggtggcccagtagtaaaatctaccacacaaatgtttgacctacacagtcgtatgccaagctgctagccttcactgttatttactgctatacaatgatgtacagggaatcccaagacttcagggggtgtgttatttacacgggatattatgtgaatggtgccctttggagttggctatctctgcacccatgggaatcttctgatttccaaatggactgcattctgaatgtggcagttgtttgggtcaaagcaaaattattccaacaggaataatattagacatggtaatcaggtcttcaggtcaaccaactgaggtgtaattaatctacaggcaaatacagtagttaatagagcctacatgtaaaaatatatatatatctccacagtctcataaggagaatttaatgaccaactttttcgtccaaaccccagggccatagctagaagctcttcgtgtgtgtgtgagacatagacagaaaaacaaataggattagatgcaggaaaataaaaaccataaagaccagaaaagggggagtgttccctatctttctttccattccccctcattgctgcctgtagttgctctgaatgatggtgtgggaggtgtaaggtatgcggcagggcagcattcatgtcagatctatagtgtcctgcagtcagcaggacagaaaatgttcaagggaaatggaacctcttagtagagatgctgaatgatggaacaggagctgagagacacacagtctgggtatatctgagggtgggggaggttatttgcaactgtatgtggtaatgctgttgacaaagaaatgactgttctgtttagcaggtgatatccaatgagtgtgcttaagtgtccgggcttcctgtccttcttcaagtatgagactatacaattcaacacagtaattcagagagtaacccaacaaacattcctaagtcttcctagtggcgctgtctgtagccagaatcccaaaaagggtaaaaatctgactcctcttaataatctgtctggaaaggaacttgaaatatagtaaaaggaaggacaggcatcagataatctgggtctgaactgtgaaggcattcaaacccattagccatttagttttagataagccacaaccttaccaagcctgttccttgagcactaacactgaagtaacaccttacaaaatttctgggccgggcatggtggctcatgcctataatcccagcactttaggaagccaagatgggtagatcgcttgggcccaagagtttgagaccagcatgggcaacacggggaaacctcttctctactaaaaatgcaaaaaattagccaggcatggtggtgtgcacctgtagtcccagctacccactgaagtgggagaatcacctgatcctgggaggccgatgctgcaatgagccaaaaaccacaccactgcattctagcctgagtgacagagtgagactctgtcaaaaaaaaaaaaaaaaaaaaaaaaaaaaaaagccaggtgcggtggctcatgcttgtaatcccagcactttgggaggccaagacgggtggatcacgaggtcaggagttcaagaccctcctggccaatatggtgaaacccccatctctactaaaagtacaaaaattagccgggcgtggtggcgcgtgcctgtagtcccagctactcaggaggctgaggcaggagaattgcttgaacttgggaggcggaggttgcagtgacccgagattgcacgactgcactccagcctgggtgacagagcaaaactgtctcaaaagtaaaaaaaaaaaaaaaaaagaattttgaaagcagcatatgagacaaatatgagaagagtactacaaactttaaaatgctatacaaatagtaactgcagttacatgggctacataaatccaatggcaagggaaggtaaaagtcagtgactctggaatctgaagcacagaggaaaatgttttagtgttttccactcattgtgttcaagtttatttattgctccaccagctcctgactatccatgtgttccaggttttctgtttcctttctcttacaagaaatcacatggccacaggaatattacaccacatccttatcacagctagggggttttggtaacaaaagccaaaaatcccggtatctactggatttaggtggccagaaatgcaatcatttgaagaacagatgcagaacaggggattatagttatctaatatttgatcaactgtcaattagaaggattctctctaggacaagggttagcaatgattgtttttataaataaacttttgttgcaacacaatcaggttcatttgttcacatattgtctatggctgcttttgtgctacaatgacagggttgagcagttgtgacatgaactgacatcaattatatggcctgcaaagcctaagatatttaccatatggcccttgaagaaaaagttcaggccgggcgtggtggtttacacctgtaatcccagcactttgagaggccaagatgggtggatcacttgagctcagttcaaaaccagcctgggcaatatagcaagaccccatctttgtagggggcgggaggcggggaagcaggttgtggtggtgcacacttgtagtcccagatacttaggaggctgaagtgggaggactgtttagagcccaggaagtcaaggttgcagtgagctgtgatcactccactgaactccagcttagggcaccgagcaagaccctgtatctaaaaaataaaaattaaaaaaaaaaaaaaaaaaaaaaaaaaacttacagactacctgggagatattatgaagaacagcatggagcccttatcctcagggagattacatcccatcccttccccactccccccgccaccaagacagggtctcactaccgttccccaggctgcagtgcattggctcaatcatggctcactgcggccaagacttcctgggctcagctgatcctcccacctcagcctgctgagtagctgggacgacaggcgtgtgccaccacgcccagttaattcttgtgtttttagtagagatagggttttgccatgttgcccatgctggtctcaaacttctgacctcagatgatgaacccgccacggcctccaaaagtgccaggattacaggtgtgagccactgtgcctggtccctaaaatttaaataacagaaagcaaatacacaaacagccataacataattcattaacatattgataaaacacaatagggtaggtgcagtggctcctgactgtaatcccagcactttagggaggccgaggcgggtggatcacctgaggtcaggagttggagaccagcctggccaacatggtaaaaccccatctctactaaaaatacaaaaaaattagccaggcgtggtggcatacgactgtagtcccagctacttgggaggctgagacaaaactgcttgaacccaggaggtgggggctgcagtgagccaacatcacaccactgcactacagcctgggcaacaaaagcgagactctgtctcaaaacaaaacaacaacaaaaacaaaaacccaccagtgatttgagaggaaattcctaccttctgtaggctgggcacagatcatgagattacgtgaaaattcaatgaaaccaatccagattatgaaagcgctggcttccatctagaatagtggtttcaaaatgtctttgctcatgcacccccatttgatatgtgatttttaaaaaatcataatttcagatagttgtaaagattatatttgaatactacataatgctttaaaaacatttttatcaaaactttggcatgtaaatatatttagcttcattaattgaaaaaaaaaacttcttttaaacttatttagctaatcagactttagatattaactcagtatttattctaagacagacaaggaataggaccatgtaactgagctcagacccatcccagccactcgaagagttagagggaaatctcttagttgcaatcttttagtggtaccctctggtttggtagatctgttgcagtctttttggagaattctaagagaagacttggttgataggagttcctgagttatctctattttatttttaaaattcaaaacttttttgcttaatacctgggagattctccttcaggtgctgagaactcttagaaatgatctctttatttgttgtccccaccatccaagacctttttttttttttttttttttttttgagacagtcttgctctgtcgcccgagctggagtgcagtggcatgatcttgactcactgcgacctctggcctccaggttcaagcgattctcctcccaaataactgggattacagacatatgccaccacgccctgctaatttttgtatttttagtagagaaggggtttcaccatgttggccaggctggtctcgaactcctgatctcatgatccgcccgtcttggcctcccaaagtgctgggattacaagcgtgagccaccacacctggtctcgaactcctgacctcaagtgatctgcctgccttggtctcccaaagtgacgggattaaagacgtgggccacgacaccgagcctcaagatttttacactctggggcaagacccatagtgggactcaatatggccaaaaggaatgctcttcttttgtcaagtgggagaggtacaggtatgggaagggaggtgggaaaggagggctgtcagacacagagatttaacagggaggcaaactttagaaagacagtacaagctaacaacgaagatttgtgcttatctacaccctgcaaagctgtcgcgttaccacataaatgccagtatgaagatattctcctagaacactgccgtccatcctacattatatcatggcacgcacagacaaaacttttttttttttttgagacagagtcttgctctgttatccaggctagagtgcaatggtgcaatcttggctcactgcaacctctgcctcccaggttcaagcaattctcctgccttagcctcccaagtagctgggattacagacaggcacaaccacgactggctaattttttatatttagtagagacggtggtttcaccatgttggtcaggctggtctagaactcctgacctcaggtgatccgtccacctcagcctcccaaagtgctgggattacaggcgtgacccaccacgcctggcccagacaaaacatttttaaagatatactaagcgtattttggaccagattactgtggctagaggcaactgagcccagatccctcctagctacttgaagagttagaaggaaatctcatattaagttgcaaccttttagtggcaccttctggtttggtggatctgttacagtctttttgcaaaattctaagagaagacttggttgacgaaagttgtaccttgaaagtatctgagttgtaactgcaccttggctgattttctttcacctagaagtctctcaagtttctttcattagactttctagtctgtggtctttcttaccatctggaaatgctagaacaggatgaacacaagagtccaactgggaaagacgttccaacagaggggcttcatagtgaatttcgggaggcatggtgttgatgctgcctgaaccacacagtgcgcaggagggattcacatcacagccagggcggattgtgctgttccggtgaacctgtgaaaaaagccaaacaaaactgacaattcagcatctgataaaaagccagctacccatttgttatccccatttgttattgagaagttagctccccatttgttattgcgaagacctttctagatacttgtgtgacactactaaaaggatgtttgattagtttgttaaaagatttccatttgtctaacacactgaccttcaaagtgggtaaggaaacttgcttccttttcattgatgaaatctaactacttgaagctctaagtgcttacctaggtatcaaacttctgacagtttaaaaagatactaaaactgtgctttctgagaacactttataaactctgcatgctttcacgaccttgatggtccgctaagacgaacagttggttcttgattcccaggtgggacattacttgctttcttcagcaaatttatccacctaggagccttcaattaccaaccacacctcttctcttcttttcacacctcttcttcaaaagactttcaggtggtctcaagccaggtggcaagcttccctgaagcttgtaacttaaaagtaacttattaactactctttaacctggcctaaaatccactgttacaaagctcatacctaagtaataaaataacattttgtacagcaaatgctcactttcatagtcttcatgttagattaattccaaagggtagaaattatttccactgaacttcctttgtgcacatgtgggcagaataattgataacctctccaggtaagtccaaagttaaatatgaactaatttaagtcttcaaaagattgaattctgtataaaaactgaacatctacaattttatactttgagcaaatttcaggtcatgctgaatgcaggatccctacattctagtgttaggatgaacaagtctggcatttgccaaagcctaactcataaagtcacctggacacacagccccagaaaaagaaacttgcatgttgaatggcactataagaaggcatcctaggtgcaagctcagtagtagaacaaagacaaaaagcatcaaaactctactagcaaaaactctaacatttactagagctccatttattttcagcagagacatctcgaaagccttttatggatttgtgtaagagaaagatatacataagaacaatgtggtctttatcaacattcccccgacattctattgtaaccacatagagaggtggcacgcaaataaagtcttttaaaggttagactgggcaaatcacacagaactagaagccactgaaagggagtgataccaactaggcatgctacttttgtgtagacaatattaactggtattgttttgggaaaaaaaaaatccctgtatctatgtaatcagagctggctttctggagaggatgacattttgaggtaaagagaaatgagtaggtagagatgaaaatgagatcacacagtgggtgagtgggaggatttaggaaaattggttaggatccaaaaattacactgaaactttcaatattcaaaagagattatctcactccagtaggtatagcaaataaaaaataaaaagagagagactagaaaccaacccatgacatcaactagctctccatatgggacatttaacaacactacattttatggctagagtgtatcacttaagtcaaagtcaatattgggaggccaaggcgggtggatcacttgaggtcaggagtttgagactagcctggccaacatggtgaaaccccgactctactgaaaatagaaacgtcagctgggtgtggtggtgggagcctgtaatctcagctactcgggaggctgaggcaggagaatcgcttgaatctgggaggcagaggttgcagtgagctgagatcacaccactgcactccagcctgggcgacagaatgagactaagtccaaagacaagcaaacaaacaaaaaaacaaaacaacaacaataaaaaaattcaatagatgtggctaggcgtggtggctcacaactgtaatcccaaaactttgaggtgggagagaggattgcttgaagccaggagtctgagactagcctgggcaacacagtaagactccatctcttaaaataaaatttaaaattaaaaaaaaaaaaaaaaaaaaaatttagcccagcatggtattgcatgcctttagtcccagctactcaggaggctgagggagaagaatcgcttaagcccaggagttcaggttatagtgagccatgattgcaccactgcactgcagcctgggaaaaagagtaagatcctgtctccaaaaaaaaaaaaaaaaaaaaaaaaggctgcgcatggtggctcacgcctgtaatcccagtactttgggaggccaaggtgggtggataacctgaggtcaggagttcgagaccagcctggccaacatggtgaaaccccgtctctactaaaaatacaaaaaactgggcatggtggtgggcacctgtaatcccagctactggagaggctggtaagagaatcacttgaacctgggaggcagaggttgcagtgagctgagattgcaccactgcactccagcctggggaacaagagcaaaactccgtctccaaaaaaatttaaaaatttaaaaaaataaaataaagggtagaaattctacttataacttgacaaaagggtaatgtgcacacatgtaacttaaacagtaatctcacttttaaattaaaaactgtaaagtactaatagaacccgaggagtatataaaaatatatttaatacttattttttttttgagacagagtcttgctctgtcacccaggctggagtgcagtggcgcaagtctgccttccaggttcacaccattctcctgcctcagcctctcaagtagctgggactacaggcgcccaccaccacacccagctaatatttttgtatttttttagtagagacagggtttcaccattgttagccaggatggtcttgatctcctgacctcgtgatctgcccgcctcggcctcccaaatgctgggattataggcatgagccaccgcacccggccaaagatatatttaatacttattaaaggatacattttggaaaatttttgaaagaaaacttgaattcatacccatgttgcacaaatccacaccaagaatctatcctgcagacaaacttaagtgtacacacgcacacgctcttccactgaaacaagatgccaaatcatctgcatgaattcatttaagttaaaaaacaacaagaacacacacaatattgtgttttacaataagaaaacaaatttttaaaaatatcacaacagatggtgtgcacgtgtagccctagctatttgggaggctgaggtggctcacttgagcccaggagtgaggagctatagtgatcatgtccactgcactccaggcctgggagacagagtgagtcagtctcttaaaagaaaaaaaaaacaaggatctcctgggctcaagagattcttctgccttagcctaccaagtagctgggattgcaggcatgcaccaccacgcccagctaatcttttatatttttagtagagacggggtttcaccacgttggccaggctggtctcaaactcctgacctcagatgatccacccgtatcagcttcccaaagtgctgggattacaggcgtgagccatcgcgaccggtcccagtcatgaaatcctattggcagaatccaaccacttcataccacctcaactacactcaatctagtccaagtcactatcttttctcaaatgggtttcttcaagcctcctaactgatcctcctcctactggttcttacttccaaatcaatcaacacagtaatcagtgtaaatcttgttttaaaatctcaatcacatcataccaacctcataatcttccaaatgacttctcatctcacgaggaatagaaaccaaacttcttgcatggttcccacaaggtcctatagtatttgtcgcctctatcccctctctctgacttcacctcatttttttgttactctcctagctgacactaccagttactctgatttccttgctatatttctccaagatagcaggcaaccttccagatcacaggcctctgcacttggctcttcaaccactaattccatggtcattctctcacatcgtgtctttttctttaaatgtcagtattcaaagtaactttttttttttttttgagatggagtctcgctgtcgcccaggctggagtgcagtggtgggatctcagctcactgcaagctacgcctcctagcttcatgccattctcctatctcagcctcccgagtagctgggactataggcgcccgccacaacacctgactaatgtttgtattttttgtagagacagggtttcacggtgttagccaggatggtctcgatctcctgacctcgtgatccgcctgcctcagcttcccaaagtgctgggattacagacgtgagccaccgtgtccggcccaaagtaagttttatttagaaatacaagtgaaaggccaggcgcggtggctcacgcctgtattcccagcactttgggaagccaaggcaggtggatcacctgaggttaggagttcaagaccagcctgaccaacatggtgaaacctcatctctactaaaaatacaaaaaattagccgggcatggtggcgggcgcctgtaatcccagctactcgggaggctgaggcagaagaatcgcttgaacccaggaggcagacgttacagtgagctgagatcgcaccactgcactccagcctgggcgacaagagcaaaactccctctcaaaaaaaaaaaaaagtgaaaaaagattatattcttgactgtaacaacaaaaaatgccctggaataagtttaacaagaaatttaagcacaaagcttaaagatattgatattctacaaattaatgcagaatcttaatagacttgaggggggaggggagacaaggcaaaggggatttaaacaaataatctaaaagatacaactgaaagaatgtaaggaaccattccccaaaatttctgataagcaaaaatacaggggagtgatctggcctattacatgttttatagttacagtaattaaaataatctgccctcggttaagaaacagaaaatttaaataaaaacaaaaattgaccaaagtatatatgacagtttattgtttaactaaaataatacttttaaatcagtttaaaaaaacaaaaggaggtattactttttcaacaaatgaatcaggaaaaccaagaggtcatacagaagaaaacggctgcatttctgcctcacaccaaaattaattctaaataaagatttattcattttcattttattttatttttttgatacagagtctcgctctgttgcccaggctagagtgcaatggtgcgatctcggctcactgcaacctccatctccgggttcaagtgattctcctgccttagcctcccaagtaggtgggattacaggcacccaccaccaagcctggctaatttctgtatttttagtagagacgggggtttcgccatgctggcaaggttggtctcaaactcctgacctcaggtaatccacccaccttggcctcccaaagtgctagaataacaagtgtgagccaccgtgcctggccccaaataaagatttaaatataaaaacaaatattatactcaaatctaaaaaaaaaaaaattgtgaagcaatatatagtggttaacagtatgagctgtggagccagactgcctgggtttgaaccttgactccgccacttactagctgtgtggccttaagacaagttactgtgtcttcatctttactaacaggagagtacctgatagagttgttttaaagataaataactcacaacagtatctggctctcgactcttaatcacttttgtaaaaccgtaagtatagctactgatagaacatttaccatcaaacttgatagaacatttaccatcaaagatcttgatttcaaaattctagcttcttaacactgtataatatgatcattgataagtcacatgacatccttaaattttctcacttgttaaaaaggactaataataccaatttcatgggagtgtaggaaagatcaaatgactctgtaactgttaaaacattacacaaatgttagctaaattagtataccgcatgatttctcaacagctggcacttctttgttgtggggcacagtcctgtgcactgtagatatctagcagcatctctgtcctcatggtgcatgtgcctccctactcccccaatttgtgaaaatgagtaattactacagatattgccaaatgtctcctgtgaggacaaaatcactgagaaccatgaggttcaaattacggtcatcccgtctagaaaaattcaaagcacaggctcccattaaatattagtggtgagtcacagtaaacataagactcagtaaaaaaggaaaacaaaaaaaataaaaattaatagtaagaacaaagctctcaaagactattgtcaagaacaagcctgaagagagcttcccctaccaaagatcagataacgttagcatcataaagaaaagactacaatggcttgaaatacctcaaatatgtttcaatcaatgactcacagccccttcatgaaaaacttcagtgactgtccttagaggatagtagaaaactaatttgttattttgaaaattggtaaataaaaaaaaacaacaaatcatgctttcttctgtacaaactgtacctcagggtaaacaaatagttgaaaaggacaattttccctttataaacatattctatctagctaataaaagaaaaacagaaatgatacaagtagaatatcaccattcttcagcttccaatttaacaatgggtccaggcaatgatcaccagtggttgataacaaacagtttagtcattacgtgtcttctgatacaagcataaggcggccaccttgtgttttctcacgaaactaaaactggacttattcacgtttctactagttttcaagaaaaacaagggacagaaaaacatcactgttttttaaatgcactaaaaataagatggattaataaatggaaggatgattgtatgctaaaatgttagtggtagaacctagggagtagctacataggtgttcactgtaaaattcattcaacttcgtatctgaataatttcataacaaaatttggaaaagaaaacagtgacaccacaggacttctgcttctagcagagtaatagtgatcagatttacctttcagtcataaaccagaaaactggacaacaggcagtataacactgagaaataaatggggtggtctctaagactgccctggttttccgtctggaagtacattctagactgcagggcagggagaggatctgaagcagagtataatagcttcactgagttgaggaagcaaattctcactagatcagaattcagagactaaggaaactgaaaattgcaaggcaaaattcttgagaggaggaagctttacagaaaaagagccccagaaatcttcataagatccccctgagtgtttgctaaatattaaaaggtgcatgtaaagggtgaaactatcaggccaggcaagagcaactaggcagctgtgagctgaaatggtttccacagctaacacaagcctgagaggcttttaaactgtgaccagccaaagttgcatagagaattcaagacagaagatcctgctttagttgtggagctagactactaaggtggccaactcctcacctgacctaacaaatgacaaggaatttacctgccagcaaaacaaagcctctttaaaggaagatggcacaatccacatgctacaagcagggaaaattattaattggattttcagcttaaaacataaataaaacattgttagatatgccaagaggcaagaaaatactactatagggataaaatttttaaaagaaagtaggctgtgggaaactaaggtatcagataaatgaagttttctcaacaaataaatcacctatatggatagtttgtatcaaaccaacactctcactaattggaaaagccagatttaaaacacacacacacacacacacactctctctctctctctctctctctctctctctcaaaacataagaaaaatgctgacataatgacaatattgaaagctaagattccagagaggaaaagaacctggccaacatggcgaaaacccatctctactaaaaacacaaaaattagctaggcatggtggcacgtgtctgtaatctcagctacttgctgaggcaggagaatcgcttgaacctgggagatggaggtttcagtgagccaaggatgtgccactgcactccagcctgggcaacagagcgagactccatctcggaaaaaaaaaaaaagaaagaaagaaaaaaaaaagagcagagcttttggtactcttgtagggctgaatggataacactagagacttgaaatgtcaaattatcaataaaaagaggacagggaactaagcatgacacacttccaagtaccaccctcccaaagaaatagctgaagttgtgaatggtaggaggctacaaagctaagtggaaagtctctgaaaagggcagagatgtttctggcagtctcgtgaggagactagaattagatctcaggatatgctaagaggaaaggaggctgggcacagtggctcacacctgtaatcccagcactttgggaggctgaggcgggcagaccacctaaggtcaggagttcgaaaccagcttggccaacatggtgaaaccccgtctctactaaaaatacaaaaattagctgggcatggtagcacgcgcctgtagtcccagctacttggaaggctgaggcaggaaggagaatcatatgaacccgggaggcagacgttgcagtgagccaagatcatgccattgcacttcagcctgggtgacagagcgaggcgaggctctgactccaaaaaaaaaaaaaaaaaaaagagagagagagagagagagagagagagaaaaggaaactgatcaacacatgttctcagctggaactaagagagagaaacagactgttatctttttgagacagagtctagctctgctgcccagactggagtgcagtagcttgatcttgactcactgcaacctctgcctcccagcttcaaaccattcacctgcctcagccacctgtgtagctgccaccacagctggcttttttatttttgagatgaagagattgcaccactgcactccagcctggcgacagagcgagactccatcttgggggaggggagggggacaaaaaacaaacaacaacaacaaaaaatcagcctgtgcaacacagtgagacctgcatctcaataaaataatgagataaaatacttgatacacgaagaaattcccacgttcccttaattaatactgcaatgctatcaattctctttgaaggaattcccaagaaatactcaatttaatacttatgaaggaattaataccaaagtaaaactctattcaccattttctgttaatcatagcatattcgtccaaaacactaaaagaattcttttggctcaaggacaggttataatcatttgcttttgctttgcatttgatattcgttatctaactcatccactgttaacatgtggaaagattttcaaaggtttggcaactctatcacaatcaagcatatcccacaactggctcttgaagatccatcagagtgaagaaacaaaacgtgtaagcttctattttatctcagtctttcaaaatttattttgtatgtgttttataatgtatatataaaacaccgtcataacagtttagaggtaactgttccaagcacagagtgatttctgagtattcttttagtagctttatgtcctaaggtacaattttctacatggcatgcttgctcctttccaaatgtctaactagtatgaaaaagttggttgggcctccaaggtctattgcactctgtcaaggaagaacgtatcaaattattaacttttaatactgactcatattctagttcattagtcctcaaccatggtgtcatgaaactggatttaaataggtggaatcaaaactaggaggcctagaatcatatattaacacctttatttaccctgatgtctacaggaaacctggtcatagccatgagagaatgccctgtacaaaaatgtcactcttcaagtgtgatacaatgggaagaagaggaggactactcggaattctatggaagccagctttaaaatttggcccagagcaatcccccctatgacaacaaggactacaaaattctaaaatgatgccagtacactgccaatttgttaggaaattgctactttttaaaaaattgaaagaaatgctattaagggcaataaaaatttcaagggtatgttagtaataaatgtagccattacctattctactggttattagtacaaaaaaacccagccttttcaaccattcatttccaaacactgatggtttccactgccagactatacacaagtttctaatggtccacagtaaattgagaatgagaacaatgcagtaaattattaataaaactacattcttttcttttttaaaaaaatactatttgtcttatggtttaattataaacataattttacttaaaaaataaaaagcaaccttatttgaaaattggctggtaccaattttattttaataactttattgatctgaaatcttagtacgtttaggttaagttataaacacctacttcacttaggcactgggccaggaaaagaacataatggcatataagaactttccactggagtgcttcttcattcacttagataattactaacatccaccatactagacccctaaagtgatgaaacacacaataaatagcaatataggctattcagtaattacaactagtaattccgtcattttataataaaattatgatttaggaagtactccatgttctccatgagccttactctgatattcacttaccacaccctagtggttattccttagattacatttaaaatattccacattcagagttgtagaggccttagactattatctcctccaggattactactgttagtctgtctttccacctccagtctcttgtgccaatccatcccaaacataatagttacagattggccgggcgcggtggctcacgcctgtaatcccagcactttgggaggccaaggcggatggatcagctgaagtcaggagttcgagaccagcctggccaacatggtgaaaccttgtctctactaaaaatacaaatattagccaggcgtcgtcgtgggtgcctgtgatcccagctactcaggaggctgaggcaggaaaattgcttgaacccgggaggcggaggctgcagtgagctgagattgtgccattgcactccagcctgggtgacagatcaagactccgactcaaaaaaaaaaaaaaaaacaaacaaacaaaaaaaaaaaaaaaaacatgttacagcagatttacctcccccaaaatagcttacaacacttctctgctcaaaaatttaaaacttatagactgaaacccaaatcatcagtttgggcattcaaggcttcctatttatttactgatagatctcatttctctttattcccaacgagtttaacttactgaacactttgttttagtcattgattttaagaagtacaagtgatataacaacagctttttttttttttttttttttttttagatggactctcactctctcaccaggctggagtgctgtggcgagatctcagctcactgcaacctctgacttcttggttcaagcgattctccagccccagcctctcgagtagctgggattacaggcacgtgccaccacgcccagctaatttttgtatttttagtagagatggggtttcatcatgttggccagggtggtcttgatctcctgacctcatgatctgccccaccttggcctcccaaagtgctgggattacaggcatgagccactgtgcctggccagcctttttaagggcaaaagagttactgcactaaacgtgcatctcaattttaagatatattccagccataattcaactaagctgatagccctttaaaaacacagtaattgggctgggtgtggtggctcacgcctgtaatcccagcactttgggaggccgaggcgggtggatcacttgaggtcaggagttcgagaccagtctggccaacacggtgaaacctcatctctactaaaaatacaaaaaatagctgggcgtggtggcgtatgcctgtaaccccagctactcgggagaatgaggcaggagaatcgcttgaacccgggaggaggaggttgcagtgagccgagatcgcaccattgcactccagcctgagcaacagagcaagactccatctcaaagaaaaaacaaaacaaaacaaaacctcaatgagttccctcaagtatgttttatttggttctggaatgcagtagagatcatttaagatgcaggtaaggaaaaaatattaatcacttgctttgtgtgttctgtactctgtactcacaataactgtgaactcactgtcatgtaacaatattagaacataatttacctgttaacttctttgctgtcattagaaagtaagctccatgaagataagggctttgttttccttaccaatgcaacctggctgccctgaataatacggtgggcattcaaaaatgctgttgaataaatctgtctggaaaaccgagcaattcaagatgacagaagacaagatgcttgctcatcagcaaataccactgaggtcatgtcatgagtgaggagccatgtgagacacagaaagcaacctagacagaaggaatggggtgtgtctctaactctggaagaactccagctttctgctagatctagtacatggtatatttcccaaagtcaactaatttctctgtcttatttttcatgcagcttacttttgtgtcaggatgattctgttttagaaagtggcattggaacaaaaggatatttagttttatgcctatctcttgcctaagctaccttttataattttatatgtacattcaaaactacattcgttcttaggcatggatcagaagaaggttggctacttcacatattaaaaaacaaaatccaggaggccaccacatacttcagaaaatttttatacgactcctgatgtcatgccatagtggctggtaaactgccaaaacagaggaagggtgctttattttcatgaggtggcggttttttttttttttttaaaatgtaaaagcattctgtgttaaattcatcaaggaattgacaaaaagctattttcctacacttgacagtaatatactgttttctgacattcctgttatcaactcctctgaaaatcttttagagatatacgactattagtaaaaaaaaaaaaaaaaaaacaaaaaaaaaactgagactgaaatgtcaatatgaaaaccctgccaaataccttattcttatctatttctgctattttgatatttcaggtagagtccgaggaatagacaggaagaaatggtatcgcctgacagtcaattctacaattcttttctttaaagagaacatggcaaacttacacagtacaactgcatactagaataaaacaaggaaagtactgaaaattcaccatgcaaatactaattgttccagcaattctctcatctcccttatttgtcattagcaaatatgttgctagtggctctcttaagaaaaattcccattctctgctctcttttacagcaacattctttgaaaatgttatctacaatggttccctcaattccttctgtggccttgtctcctgaaaccactccaaccatgctttaattcacctttctccctctaccaaaactgctcaccaatgtctgcaacaaccccaccccactaaattcaatggtctcaattctcagccttcatcttactgatcctgtctgtaacaactgacacagacaatccctcctcctcctccctctccaaaacactttctccccttgcctttcacataccacactctcttggtttttcttctactttattcgtcactcccttcccaatcctttcctcatctttcacaggaatgaggaggaatacctaagctctggaatacatcaaagggctaatccatatacctcttctttatctgagctctccagcactctctattccctcctctattgcatttctctctccaggattttttttaattaattaattttttattattattatactttaagttttagggtacatgtgcacaacgtgcaggttagttacatatgtatacgtgtgttttttttgtttgtttttttgtttttttaaaagacagagtctcaatcactctgtcatccaggctggagtgcagtggcacaaccatggttcactgcagtgtcaacctggtgggctcaaatgatcctcccgcctcagcctcctgagcaaatggactacacacgctcgcccacagcaggctttttttttttttaaagatatggggtctcactatgttgcccagactggtctcaaactcctgaacgcaagtgatcctccttcctcagcctcccaaagtgccaggattacaggtatgagccactgtgcctagcctctctccaagatttaatgctataggacacactgcagagttcatttattattttctttctcttaacaactagaatatttcatagggtaagcacttttgtctgttttgtttagtgttgtatacccagtgactagacagatttagctcgttgcaggaagccaataaatatttgttgaaagaatgaatgaacaacaacaaaagtggtaacaataacagccactttgtacgaggaacttatcaaccagacatcccaataagcatgttacatatatttcattgaaccctcaaacaaccctatgagatctctgaggctttggagaggagtggaagtcagggtggttaacatgcaccaaattaccaaactactaagtggtagtaccatgattcaaacccaaggttatcatcttcaaagataatgctcttaattcctgcacagtaccaattttactggaatattattatctcattagttttggaataaaggcaactgctatttgaagagtcagcaatctaaaattccctacagttgtgaattaatctccatttcctttgtgaagacaaacttttttttagtaatatcaatttaaaaactttagtgaagattcctttttttctcaggcagggtctcactctgtcacccaagcttaagtacagtggcacaaatacagctcaaagcagcctcaaccttatgggttcaagcaatcctgcctcggcctcctgaatagctgggactacaggtgtgcaccaccatgcttaatttttaaatactttgtagagatgaaggtctcactatattttccaggctggtattcaattcctaggctcaagcaatcctcctgccttggcctcccgaagtgttgggattacaggcatgagccactgcacatggccaagattcttttttagggcaaaggattctatactgccattttcagtgataacagtgaaggtgagagggcacactattctccttcaaagtgttaagggcagtacttaaactttcagtctctcccatttctattaaaaagctcaagacagtggttttcaaaactagctgcagagtcaccgaggagctttgtgttttctgaaaacaagattccaacatccaactccagagcaaacagggcccaggaacctagtattttataaagctccccagaagaccttggtggttagccaagtttagaaaacaccaaagttggcaagagactaactctatctgagcatctggctcactgcttgacaatgaccaactctcatctgtaccgaccttcttggaaagaggaacgatgctgttgggtcgaacaagcctccgcttcttacagctcagtacaggacgtgtccgggctgccacacaggtgccatcagatgatgaagagacgagattcagtcgttgcttcttatgtaattgttcctcagcatcagagctgtcacctggaatgtggtctgccaagacaggctgaagactatacaaggggaaggaagagtattctcagaacacacaaagaaacaaaataaataaacaacaagaaaacacaaagaaacaaagcctcttatactagttcaacctctatttgctaatgttcagacacaaagaagcattctagagcagaagcaggtctcctcttgatgtctgttaatctacctgtgtgtgcttatgtgtaaggttcttggtgcacattaactacatcatgtctgaaagataaaagtcaataaataaactcaagttctagtgattgagttctcctctacatcaaacacacgagtaaataaagtctagagaactacagttggttagaaaatgatgaattttgcaaatgttaatgggcttccttagaatcagttctatgaaacccgaattttaagggtgttgtacacatcattcacttgtacagaatctccctgaatcttttgttttctcccttgaatcttcataaatacagatttacaaacatagcccttggagatctaatctgtcctaagcagaggaggttaatataagcacttctgaggaattcctgcaagattaaaacaataataattcacagtaactgtagtgtcttttattttactccatgcccactccattttagtaggtaaaaggaaaatatacaattaattaaaatgcactgcttcattatacagtgaagattaaaaatgttactaagtgataaggcttccgcttctttaaaccagggtcagtcctggctaaagagaactaagagctccaaaacacctttacaagtctactaagtgtaggaagtagaagagctaaaacttacgtgttaataactccattgacaggtctgagtgctccacatgatttggtagacagtgactctgaaatatgaccaataataggggcaccatggttttccaatggctgagaaacagactcaatctgattaagaaaaaggaaaaaagaaattaacatgtacccaagcgcacccctgcctgaaaagcaccaccacttcatttgcacaaagcacctaaaacttctgatgatcaatttgaaaaacacaacttgaatgactgaagaaaaagaaaataagagaatcagtggtcaggtatgatggctcgcaactataattgcagcactttgggaggccaaggcaggaggatcgcttgagaccaggagttttgagaccagcctgggcaacacagcgagacctcatctctaattaaaaagagagagagagaggttgacagagagaaggagaatattatattagcttttgctttggggggaagagggatgaggaatccaaatgtacagactaaaagtaagtacctattgacaggaaaatgacctcaataattctatggaacagaagcttagcaaaacaattacacagtaacataagctttcaactaatgatcaagaaggatatactaacatcagtatcaagatgactaagaggaaatttaaatgtagttaatatctgcttaactctaacagagtatgctagaagcttgttttctaaaaactatgctttgtttaaaaatatacacacaggccggggatggtggctcatgactgtaaccccagtattttgagaggcaaaggtaggaggatctcttgagcccaggggttcaagaccagcctgggcaacatgacaaaaccccatctctacaacaaaaaaatacaaaattagccgggcatggtggtgcgtgcatgtagtcccagctactcaggaggctgaggtgggaggaggatcacctgagccaggaggcagaggctgcagtgagccatgatcatgccactgcactccagcctgggtgacagagtgagaccctgtctcaatgaataaataaataaataaacacacacacacatttttccctgacagaaaacaaagttaataaaatctcaatgaatctaattatctgatgctatcagatactaactattgtctttagagtattcaaatcaaatatgtttagaatataaaatgaaataacagatgagaaagaatagaaaaagtgtgatttgcagtattcaaaacaaattatatatttactaggctcaaaacggataggaacagtatgaatgccagtcatatagcacctctgaggtataggcaataaagcaacagatgcagctatccctcagttctagcaattgttgaactatcccagaaaggctatgggtctttgactccttactttatttttttgagatgaagtctcgctatcccgcccaagctggagtgcagtggcatgatagcagctcaccgtagcctccacctccctggttcaagcgattctcctgctttggcctcctgagtagctgggattacaggcacacactaccatgctcatgtaatttttgtatttttagtagagatggggtttcaccatgttggccaggctgttcttgaacttctgacctcaactgatctgccctcctcggcctcccaaaatgctgggattataggcgtgtgagccaccacacctaacctgtctccttacacttgaactgactctggggcacgctgaagttctctttcctataaaagctttcaaggtaaatattcctataaatgcttcctacaaatgctttcaaggtaaatattttgaggctgaaattctacttttcaatactgatttcttttgtctttatacccccaaggataaaacaccaaaggactgaacctgaaagtagtcctagacaagcatcaaaaagaacagactgaggctgggtgtggtggctcatgcctgtaatcccagcactttgggaggctgaagcaggcagatcacctgaggtcaggagttcgagaccaacctagccaacatggtaaaatcccatttctactaaaaatacaaaattagttgggcatggtggcgcctgtctgtaatcccagctcctccgggaggctgaggcacaagaatcacttgaacccaggaagtggaggttgcagtgagccaaatcacgccactgcactgcagcctgggaaagagagagagagagactgtctccaaaacaaaacaaaacaaaaaacaaacaaaaacaaaaaacagattgggaagataatctaaaagttttaatacaaattatcctaaaatacagatcaaactatatacacagacaagtcatataagtatgctacaatgagtgaacaccgagaaaaggctgtcttttttgttggatatcctgtacatctactaagatatcacaaacatcttgaacaattgtcaatgctatcaaaaattacagtaaatctggcatagacacattgccttaagctctatgcagatttcccttggaaagaaacacggtattaagcagcaagagctataaggatattcctatcttctgacaaaatattctaaccaatttttaaaaatctaccctaaaggagtaactcaacaaacacagccccaaaaatcttattcacaaaggtggtcactgcaatgatatctatcaataatctaaatgttgtaagcattataactatagttatcagttgtggtacaccaaatcaaaatattaaaaagaatcataaaggatatttcttctcttatggaagaagagatttcaagagaaaaaaataatagtttaatatagttgtagtgactaaaaatatacatacacagataacaacaagacaaagagtgttacagttgtaaaactattctgaaattttctttacattttaggtaatagttttatattaaaaagaaacccccataaaaccaaataccctcctgaatgctagtaaggatttactacacaggggaaacctcaaaaaggctaaacaaatatggtatgacaaagaacaagaaaaatcaaaagaatttaagattcaggttggtattaactaacagatgtataacttcaggcatgttataggtattctagatttcagaagttctggtttagatgaaaaagtttcctttcaatagaaaaatgctgtttaaaaatgctgtttgtttttatttcggcattaaattatggcagtgatttgatttatatatggtatatataatttatatggtatatttgatttatatatggtatatataatttatatggtagtgccttcacgtgttctagaaggtactacgtttaagtaacgggttgactgactctccatttgattaagtttttctggtagggattatgagatttaactgcaagaacacttgtcaagataaaatgttgccattctctaacaaagtctcatttcaaaacatttatctttcttatacaaagtctaaagaagaatatgtcaagtaaaatcaccagtaatgtcacgatccatatagctaactactactgctataacagcctgtcttgtttctcatgtctgcaggtgtatatatttaaatgctattcagctttaacatgaatgttattgattttcttatagaaacctgaatcttcctggagtaattcagcccccaaatcaaaattgaagtcaacaggcaacacattattaacatggaaatgttgtcaagaacatagaggtatacagaggtcaagagcataaacatcagaaagggactgtggctggcctgcattcccagccacaaaaaagaaagcactggatactcaggaaggatctacttcagatcttgggaaattctgtaatcaagctagtatccaacagcaggcatttggacatgtcctgcaacccatcatcaatgcaaagagcttaaaatattaatcccaatcacagtgttccatttggaaaaagaaaaacataacacacaaacacatgtaatttcacctagctccttaaatgcaggcactctcccttgagaaaaaatgaacatttcctatcctgcagtctaaaaggctgcaaatgcagaggataaacattaacaaacacttaagaaatattaaatccgcatactaatttcagcttattactactgcagtggtttacatcattagtgtttttagaaaactaaagcatgactgagatatctgctatccaataggcaactgcaaaaaggatgaaagaacttaagactctcctacctagaaaataaggattatcactgaagcttccatttgaattttatttgatgttgagatgaactcagggtttatgcatcccacagccagaaagaaagagtagaaaagctaaagtggtagacagagtgcctctgtaatcccctcctctccaaagcagggccctaggggattatcttttggagtaatcttacagttaaaggtagcaaggagggttgctgaattgctccccccacccctccccccgccccgattgaaagggccaggtgtacagcataaaattactaacatagcaatgagattcaaatttgttattcacataaagcaggcatctcattcattactccactctgggccagatcaagtaagcgtgacaaagaggccttgaatgaaaagctaaaactaaatagtttttacgggggtcgttttttctagggtctaagaaccaatgtctactagatttgtttcaccaaaaagtagagagggttaaggggtaaaaacagagagccacacacttaaaagcacacaataaaattaaactctacctgcaaatatgtatttttactttattcaattaatgccatgtcacacctgcttgcaatgtcattttttaaatgtatcacattcgtttggctagaaaagtcaacagttcagttttggttagttattccctttctgacaaacattaaaatggaaagaaaatgctaactgggtgacaggaatttaacttattcctgggttaaaatagtttttgactttgtatgattgatttcatgtctcaagcccaccccacccccatttcaatgatactgagcatagtttcgcttaaattcaccaaaatattgctggcctataaatagtatactagccatttccattagctagcaccatggccataaaattgtactaaacaagaagtggaatgttctgaaaattccattttcactaagttattgcctaggctttaatttctgcctatgtggggctatgtgcctcactttccggcttctgcaggttgaggataaaagaaaatctataaaattacattataacaattttgaactcatttttttaaagttttgattagcataatgctgttactaatccaatggttcctaagcctaagatttatgtttaccaacacttgaaaataactatctagaatttaaagaaatatagcaaatgcaaaaatgcatcttaaattcttattgttcaacttatttatccatagcccaatttattataaaagacctaacttgtcagtgttttctaacactgtgggtcaaatatttcttggccaatatctgtccctttaccttctatcccaaaacccttgtcaggccaatgaactactcactgtccctagagactgcaaaacttcaaagaaaggaagagtattcctacttacaccaatggaatgaagatgtatcttggactgtgtaaaaagaaacagcaatagcttacatttttagcatgcctttcttctgagaaagcattagctcttcacttaatagtacacttgtttttctcatcacttctgtaaagtaggatgagcaaggaaagggtaaaggagcaggatcattttacaaacagaaactaacacacaaataatgtgttacttgttaattgccatagaagcaatgtttttcgctaaacaaaaccctccttaacgtcaaatctagtattttaaaaaatatttatccaagaaggagattttaaaaaatatatacatgtgtctgctcatcggtgcaaaaaaatacaggaaagataagccaaaacgtactgaaattgctaacctacaggacgttgagtgagaaaaggatataaagaagaatgtatagcttttttagaaccacagtaatgtttcccatacaaaaataaaaattaacaatgcggggtggggaaaacagggaaggctagaattgaatactgtagtaacaaatgaacctaactgtattacaaaacaacataaccatactgaaagatttggtggaaggaaataactaacctacgtaacttcagaaaactgtattttgactgcataacagttaacatactgtacaaaaatattgtactctagttagcaaatgtgtttttcacaggggtactagatgacaactgtgagactatacgggtactaggattaaacgagtatcaataaggaagggggaaggctgctgtgttgaactggtatgaacttacggttttttatatatatatacaggttaagtagatacagaaatatagatgtgtgtgtatgcacctgtgagcatagatacatatgtttccttgctttgccttttgagacatcctagaagcagtgacacttacgaagtaacaatgagcacaactagtactcagattttagttcctaataaaaggaacctgagctgaagtaggcaaaatacaagaggaacctggaacatctagtattagaaagtatttcaaaatataagcggtacatgctaaaaggacacaggagccaatctgaaagagcgcccaatacccaaagttgagataactggagcaactgtataaacagtaataggttataatccattaaataaaataaatatccatgggaccatcctgatattcacaactgagtcaatgaatgagtaaataaatgaggggggaagacacctcttcctaacagaattccatttaatgcaggtaggaagtagaacaaccaccctttagtaaacaacacagcaataattgctgtaggaaaaagtcatcagtgaacaataaaattatgagtaaaaatataatgagcaacagaatatttacatagtgtctccctataagacagtcatttattccagccagggcaaaatggcaaaaccttgtcactacaaaaaacataaaaatgtgccaggcatggtggcacatgcctgtgatcccagctacttgggaggctgagagatgggaggatagctgagccagggaggtgaaggctggagtggtgattgcgacactgcactccagcctgggtgacaaagtgagaccctatctctaaataaataaataaataaataaataaataaataaataaatattgtcagttattacaaagggaaaaatgctaattttacagaggagaaagctgtcaggcaccaccttaaccaagggaacaaacctatcatcactattagaaagacaagtcaaaatcatgaaccccctgtggtgtagagaagggtacagtatcttctgtggcattcctgtaaaacaatgcgtaacctctaataatgagaaaacaccaatttgtggaacgctatacaaaataactgaccagaaatcttgtatccaagtaatgaaatacaaaaactgagaactctcacatattgaaggacatttagagatgcaaaaactaaaagcaatgatagattctggacaacagaaaggacattaataagaaaactaataatacagaaattcaaataaagtatgtctattactttgtataagttcaatgttaatttcaatgttaatttcgtggttctgataattaacgattattgtgacaagatgtgttaagattagagaaagctccgtacggagactctgtactactatttcaacacacacacactctctctttctttctgacacaatctcgctgttgaccaggctggaatgcagtggcacaatcttggctcattgcaacctctgcctcctgggttcaagtgattcttgtgcctcagcctcccgagtagctgggattacaggcgcacaccaccacacctggctaatttttgtatttttagtagagacggggtttcaccatgttggccaggctggtctcaaatttctgtcctcaggtgatctgcccacctctgcctcccaaagtgctgggattttaggtcaccgtgcccagcctaaaatcatattttaaaagaatgaagaaaaaatgtatctagcattaataaaacaaacttcattcatacataaatctgtacagtctacaggttcctatcagttacagtactcacttaagataaatatagaatccattctgaattggccaaaatatccaacactccatcacagaaaagtatttgcagttacctgataatgccaggctctttcaagcctatgctgcattacacattactccctacaccatgcttcagcaagtccataagactcagaaaaaagtccatccttccctaggaaactacctttactgactccctccagcactcccattttatgcttgttggaagaacaagaagcactcaagaaaagatagatacctggttctacttagtctttcagacacaaagtgcagtctggaacaatgacaattagcttttactaactttcattatctatcaaacattgttaaaagcaaattataaattttaaattaactttgtaagaaggctagaaatcaggtagtaggaggagagtgtgactcctccaatttggttcttgtttttaaaaattgttttggctactggccaggtgcagtggctcacgcctgtaatcccagcactttgggaggccgaggcaggcggatcacttgaggtcaggagttcaagactagcctggccaacatggtgaaacccccgtctccactaaaaatacaaaaactagctgggtgtggtggcacacgcctgtaatcccagctactcgggaggctgaggcagaagaatcacttgaacccaggaggtggaggttgcagtgagcccagatcacaccacagaactccagcccgagtgacagggagagacttcatctcaaaaaaaaaaaaaaaaaaaattgttttggctcttgaaaatacttaacatttccatacatacttgaaaatcaatgttcaattgttaccaaaaacaacacaacataaaccaaaaaatcttgctgggatttttcactgggtttgcattgaatcattgtgtctaacattgactcttctaacacataaatacagcatacatctccgttcacttatgtaatctttttcagaagttttatggtttcagcaataaagtcattaacgtcttttgttagatttattcctaagtattttatgtttcttgatactaccgcaaatggaactgtttctccgggttatttttcagttgtttgctctaataaataaaaatagaattgacttttatatattgaccccgtacctggagaccttggctaaatctctaattctcacaggtttagggaattccatggggtttctaagtatcatatcttcaaatacaagcagttttgccctaccttttccaatttccatgcctttaattgcttttttcttgcaatattgcattagccaagacagagtacaatgtttttgtttgtttgaggcagggtctcaccccgtcgcccaggctcaagtacagtagcatgatctcagctcagtgcaacctccaccacctgggctcaagcaattctcccacctcagcttccagagtagtgaggactacaggtgcacgcccccacaccaggctcatttttgtatttttttgtagagatggggtttcgtcaggttgctggagctggtcttgaactctgaggctcaagcgacccgcccaccttggcctcccagagtgctgggattacaggcatgagccactgtgcccagcttacaatatttttaggatatatttttttcctaattgtagaccaacaaaacaagcactttcaccaagtagtgtgatgttaggcgttaggtttttttcctaatttttaaacagcatcacagctcaggaataaggtcttcacctttgattttcacgatttttactacaatgttgtgattctcatggttattattcttgaagtttcatgatttttttattttatttttgagacggagtctcactctgttgcccaggctgcagtgcagtgccatgatctcggctcactgcaacctctgtctcctgagttcaagcgattctcctgcttcagcctcccgagtagctgggattacaggtgtctgccaccacgcttggataatttttgtatttttagtagagatagggtttcaccatgttggccagactggtctcaaacttctgacctcaggtgatccacccacctcggcctcccaaagtactgggattacaggcatgagccaccgtgctcggcctaaagtttcatacatttgtaaactgactgtttaaattcaaaaatccagtcattaagttcctcaatttttttccatctttttttttctttttcctcatgactaagaatcatattctcatgtttattcatatgtatggtaattttctattatatacagacaatgtatgcaatacattatagagactctgaatttagttagcttttcctaaagagtgttgatttttgttctagcaggcatactactactacctggttaccttcattttgtggagctagttttgtttttataaaagcatagtggagtctattttggttccctccttaatcctatggtgaatgccttcgtcctgggaaacattctttaactctttaagtgtgagcctttattggtttcaatcaaagccctcaggtttttgccaagtctagttggaattcgaactccaaattctgccttccctgcattaggcaatgatgatcttctctgctcagctctttcagccttccaattactgctttccactatgccctataaaatcttccctaaacatgtgcaggtcaggggtgagcacaaagatctgaaaggggctcaaatagattgtgggcctatgcccctccccatctcccatagctccctctttgccactattcccctccttcaatttctacctaacttggcagccctgaactccatcctctgataatatacaaacaagcccatgaagcagtgactattgaattctagaagctctggggcacatggactgagaatgctctcatctcttcctggcaatactttctgtctgaaattttgctgacattgttgagtaatttacctagtaatatgcacaggttccaagcttgcccttctttgctcattactttttcttaagcaggggaaagcaagcttctatttgaagagagagaatgagaaggtggggaagataagaggcatgtttcaatacactagagaacaactctcaaccgctttttacatgctctctttccaagggcacaccctctttgttcaaaaggagtcttaaatttcacagaagcatttatctgtacacacgacttatcggcagctaccaagctagaggcccgttaagttttctctccctcagctagccttacacctttaaaactgcctttgagtcagaagtcagaatgaagaggttaaaataaaaaaagaggcatttttctaggcattcctccttaggtcttccctttctctaacccactactctgtggtataaaaacagtacccacttccctaacccagaaaatattccttgatttgctccatgactcaaaaaaggttcacccatgaattcagtctccagttcttttgctcataggttgggtccttttagaacaacttagttcaataatatctgtactgtattcaagacccaagcagatatatactggttctgtcaataaacaatcatcctgtttggaaataaagcaaaaagactatgtatccttgcagtgtaccactgggacattacctaacaagcccacccaggaaacatctgactctccataaattatttaactttgttttacctactatctataattgattagggcccagaagtcttactggatgtttattttagaacgctgacaagttaaagttggtttgcatcttgttgaaaacaatgtccaaagttacagctttattgttctataggatattaataacttttgtatgctactgagtaatcatattcctgcattcttcctttttatctggtattaaaatactgttaacagtttggccaccatcatgattcccttgttattcagtaaatcactatatatttaggaattatgtctaggctggtgcagtggttcacacctgtaatcccagcagttttggaggccaaggccagcggattgcttgtgctgaggagtttgagaccagcctgggcaacttggtaaaaccccatctctacaaacaatacaaaaattagccagacatggtggcacatgcctgtagtcccagctacttgggaagctgaggtgggaggatcacttgaacctgagaggtagaggctgcagtgagccaaggtcgcaccactgcactccagcctgggtgacagaataagaccctgtctaaaaagatggaaagaaagagagaaaaagaagagagaggggagagagagacagagagagagagaaagaaaaagaaaagaattatatctaatgttttgaaactatattttgacaattctaaagacgctgatttttttgttaattccagctgagtttcagaaatgagaataaaaaaattaaacataacagaaaatacctctgacattattatttttaaactacaagtcttcaaatatatttttgggtaataaacaagcacagtccaggagtttgaggctgaagtgagctatgattgtgcgattacactccagcctgggtgacagagcaagagcctgtcttaaaaaaaaaaaaaaaaaaaaaaaaggaataaatacacctacctccatttggggaaaaaattaacaaaatggaaaacaggctggttacatgtgggtatgaaaacctacagttgccctctgtcccgggcaacctaatttttttttttaagcaaaactgagaaaagtcactttcctaaaatttaaaacaaaacaaaacaaaaaaacctggggaacaaacaagcaaagttaaatactgccttcttatacagaaaaactttgcctggcaattgacatacgcacagctttgcaaatatttggcattttaaaaatttaagtcaatagcttttaagaaacatatgctctgcgcccattctactaataataaacaatggaaatgtattgtccctgctccccccaccccaccccccaacccctgtcttctcttaatactttctgaacgcttttcagaaagcatggatatattcataaagggtagataattcacgaaaacagggaaggggtaatctctccttgacaaaatagtgacagtgtatacttagttgttttcattatttattttactcaatccaaaaagcattctattgcacaatgttgaaactagtatggccaacacaaagggaaagatggtcttgaccttcaagaatcttacaatttaatacacacacaggaatcttacaatttaacacacaagtaaatgaatgaagggtagggaaaggaccaagctcctaaagagtgtgtgtgtacaagtgaatctgtataaactgtctcacaatcactgtggattttttaagacaatgaggattagtaacacaatggaggactgttatgccctgtccttcagaagtgctgaggtaagagaaaacatgactacagggagattactcaaaaaagtttggaatccctaaattctatatacaaatatataagtatctacatagaacttactcccctatcacatatgcctcatgtttcatgtttcctgtacccataccaccaatgtatctatgtttcctttctcacttaacaatttttaccctgattagaccattcactaaaagtttcattaataacttaaaaaagatctgtaaacagcatgcaatgaacttatattatagacttaaatagtggcaaaacttggcattctgctctttaatttattcaaaactactttccagttaagaactatcaatcttctagtgtcttcacatttatctctagcaacagtggctggctttcaaaattaggtgagagatctttccaagatctaaacatctccaatatctgcctcagagaaaatttagtttccaccacatcatgcgttcctgctaacaatgattaaaataaataaaagaactataaggttggtttatttgcggatacaagaacagcttgcttaactcaccatttaaaaagccatcacttcacactagctttattatctgaagcataatcaaaataataaactacggttgtgggactttggaatttctaattaagttatggagacttaaatcaagaaatatgaatattcataaaacccagtaaccttttaggcaaagtaaaaaagtgaaaagaacaagtgctcttggaattcagaaagaaaattaactatggtattgagagaaaccaggaaagagaaggaatcacagtagagctaggatacagaaggaaacagaaaatgacagtttaatgctcattatagaataacagtgaatcacccacagagaccattttcagtgttcttgtgaatttaacctctagtctaaccttttaatgaaaaggctataatatattagagtggcccagaaaggtgaccttatgtctcaggtgtcagagccacacccaggtctcctgattcccaatgatactccctaaagccttacttgctctggctgtagtgttttgagaattggagctgcttttaatcctatggtcagctacacagctgcaggatgggccctagattccctattcaggaattcagatcttaaaacaccaaaagtgataaaagtagatacagttccccttcttcagccaatgcaaggatcctagttacagagaaaaaacggtgtgccaagacaacacccttaattctcacgcatttccccctttctatcttttatacttaccaatttatcagtcccatgatctgtcttcacctcagaactaagtggaagaaataagtctgttgtatgctctgggggaggtacctccccaagaactatcaacccctgcaggatagagaggagaaaaatagcataagtgagcagtataaacttcaaatttaatttaggagttaagtctcaaaaggactgttggtgtactagaggccccctcttcctcaccctatggttcagaaacaaactacagcagcagcagctttgttttcccaaagagctatttcaacaagcagcagacccaggctcccctctctgccacttgactgctctgacctacatggctcatcagccatttagcatctttattcatatctttcagatatgaaatctttaccagattatggcatttataccatattactagactccactagattaacagcagcaatgcagtttttgtagccaacaaatgcagtttatgacttactaagctgaaaatgctactattcttaatcatgtactccaccaactatacctgcacaaacaaaactgaatgaaacaaatgtggaacagtcccctacaatttatgagaaaccaagagcttcttaaaagctggcccaaaggaacctgcttttttcataagcataaatattacttcagattaagttcctgcttgacaatttcaaattcagacctttggaaattcattccaggaaacaatttacataaaaagaaattaaaaatgaacccacaagtcctccccattgtacatataatgagccaggatgggtaaaggcagaaggtatcttattattaaaaaaacaaaatactacatatgaatcccaccatgtataccagaagaggtgacaaaaataaggctatgacactatataaccgaaagactgggatgcaagtgatcagggttcccaatctctttctctggtctaaaaaatagagatctaactagattaagaagctcttaatggaaatttattatcagaatcacctggggaaccttatcaaactatactggcttaggtccaacatctactcagtacctctgggggtggggccaggtagtctacctttttatgggggaagggaggcaggacatggtgggtacatggaggtgggtgtctctctcctcccccaccccgccaaccccactatgttaccgaggctgatctcaaactcctgggctccagcaatcctcccacctcagcctctggagtagctgggatgacaggtgcctaccaccatgcccagaggtggatattctactattctttaaaagctcccctggtaagtcctaaacttgtaaagttgaaaaacactagacttgattagtttgggctcaaagaacatcctaaagtatagatttgggggactagggattgtgactattagtcttagctctctaggccatacgacagactcttatgagccactaaaccagatgatccatccctggggtccttgtaactaaaaaaccaatatgaaatacaagctgcagaaaaggggaaaacattaagaaagaaaaatggaattttatttcagtttttaaaaaagaagtatgtatctctttttctcttgaagcaaaagaagcactgcctccctattctggaatatgactacacttagcctgtatcaaaaatgaattggagggtcccggaatggcggctcacacctgtaatcccagcactttgggaagctgaggcgggtggatcacctgaggtcgtcaggagttcaagatcagcctggccaacatggtgaaaccccatctctactaaaaatacaaaaattgcccaggcgtcgtggcacatgcccatagtcccagctactcggaaggctgaagaaggagaatcgcttgaactcaggaggcagaggttgcaatgagccaagatcacaccattgcacaccagcctgggcgacagaccaaggctctatctccaacaacaacaacaacaacaacaaaaatgaattggaggctgggtgtggtagatcacacctgtaatcctagcacttggggaggttgaggttaggagtgcgagaccagcctggccgacacagtgaaacaacgtctccagtaaaaatacaaaaaatagctgggcgtggtggtgagcccctgtaatcccagctacttgggaggctgaggcaggagaatcgcttgaacctgggaggtgtaggttgcagtgagccaagactgtgccattgcactccagtctgggcaacgagagcgaaactccacctcaaaattttaaaaattaaaaaaaaaaaaaaaaaaaaaaaaaagaattggagtctcctcagaaacaagagaaaggccattaactagtaagcaagaaacattaaccctagcctttaaaatgaggtttctctggttaaagaacttctgcttcaaaatattttcttccctaaatcaaaagcataaaatataccttacaaactttatcacatccaaataaaaactatttgcaaaagacagttatcttgtacaccactgccttctcaaaacgttgtattcaacagatattccctacttaagggcccaaactgtcttcctgcttcctgtacaaagcatgccaaaaatcattttattattcaaattttcccataaccggttcctaagaacttttttaaagatcaatttccaactactttccccaaatatttgttagtgttataccaatctcatcatctcctagacaaatgtttcaatgaatgtgaagctgttgctgctgctggaggtaagggttattagtcagtagaaggttaaaaaaaactgaattaaaggttaacacatgagctgttcatctttatttatactcatttttatattttatcagtccaaattgccgttcgtccttccaaagagattttcaacaagtcccacctccttccaagaaaatgtcccgggttaatgagttcctacttgctttatccacactgccagacctcctaaagcacggtgattgtatcttactttctgtgtatttaaatctcatttccagagcattcataatcttatgccacattatttatttcacttattattgcctcagtttcttgtttgttgagacagggtcaagctctgtcacctgtgctggagtgcagtggtgtggtcacgaatcactgtaacctccccctcccgggctcaagtgatcctcccacctcaaccccataaatagctgggataacaggtgcatgccaccacatccagctaatttttgtatttttttggtagagatggggtttcaccaagttgctcaggctggtctcgaactcttggactcaagtaatgcacttgcctcaaactcccaaagtgctgggataacaggtgcaagccaccacacccagctaattgttctattttttggtagagatggactttcaccatgttgccaaggctcgtctcaaactcctagactcaagcaatccacctgcctcggcctctcaaagtgctgggattacatgtgcaagccgctgcacccagcctttaattgttaactaatgttagtttattgaagatgtggacaaaatacaaatatatttaaatgacccatgtcccttagcagagtcatacaccaagaaaataaatgcatagcaaatatttgttgagttgtataatttttttcctaacaggaaaatattaactttataataattatagccagaagataaataaatctaacaattagatataaaattactccttcaatttttctttttcagttatatgaaagtaaggacgcagtcagtattttccaaagggaagaatttttccttaaactacagaataatttctaaatacaaccctcagatagattatgaagacatctcctaagagagtataataaaacttggtagggaccatctattcatcgacataattttatagacccacagaggatgtaggtcaaagcttatgtctctacaggccaatacatggcagaactggggcaaaagtctgcatctaactaatatttcattcctcttttgttcagttaattcaatcatttatccgctcatcagcatttgttaggtactaaggatacaagaaaaaatgagagacctatccctctcccctaacccatccttcaaagtgcttattacgttctaatactgcggcaaagaaaaacaatgtaaataggtaaatgttatgtactacattagaaggtattaaatgctagagagaacaaaatataggatagtgaggggattaagaagtggaaatggtggggttggtcgtgacggctcatgcctgtaattccagcactttgggaagccaatggaggaggactgcttgaggccaggagttcaggaccagcctgggcgacgtggcaaaaccctgtctccacaaaaacaataataataaaaattagcctggtgtaatatcacacctgtagttccagatattcaggaggatcacttaagcccaggagagagagagagatacaagtgggagggggtactacaggcgcataccaccacgcctggctagttttttgtatttttagtagagaaggggtttcaccatgttgccaaggctggttgcaaactcttggggccaagagatctacccgccctggcctcccaaagtgccgggttgcaggcatgagccactgtgcccctgcttgaatgtttatttgaagacagaatcaaccagctatgccaatgtgcttacaagataggagggaaaagagtcagagacactgccaaggtttctagcttccacaaccagaagaatggaactcttcttcatttgttcagaggacatttgaatacacattagttttaattaaacctatttttgaaaatatgtgctcaagtgttacactgaagcaaccaacaatcatccatacactgtccattgcccccaagatatgtaagttcactatggcattcaaaaccaaacactggatcctctaatttaatactgtacctcacaccaaaaaggatgaaaacagctaaaaagaggctgagcaaataaaaagcatccaagtaggtaagagtcattcatgcaggtagcatctattgagtggctaccacgtgcaaggtagtgtgaaaacacagtaataaaataaaaacagattctaccataaggagcttatgttcatctagccttgaacagacaaagagacaaagtattatgacagtactataacagaagttgagagaaggtgatgtcagagcagaaaagagcctaactgaagagactgatgaaagtgaggctttacagaggaggtctacataattacttaacattccccaaaatatatttaatatattttgagctatacttattcattaactatacacttaatgactttgcccttttctgtatacaatgtttcatatgccacaataacacttatttcggataaagtttactcatgtttaataaccatgaaaagaaaggttagcattagctgagaaaacttcataatgttctactccacacctgtcatgctaccccaacatgggcttccctaacattccaggtttaaactgggtcagtgttgaatagctgtgccattagcctggtggcaataaacttagggctgctgtactatgaaatagcaaccggtagaagccgaagaaaaaggtcaagagtctccttttccttcgccatgtcccgagtcagagccaggatcatgcttaggctgcacaggcctagaaaactccaagagtgaagcaagcttctgctttacacaaggaccaaaggaactggaatgggtcacagttacatgcagccttaatacctcctaagtgactcctctgtggatgaaccctctctcaactgtatttgcaatacagctaacaggcaatttcacatacttccttacatcactctatcaggtcaatcttccctatgcatctcaagacaaaccagtgaccccactgcagaccagttccacaagaatcaccctgggctacctggaaaagataagttgtctaaagtgctttaaaaaaccctattaagatgagaacttcaacagctttatgaaaattttgaagagaaaggtgttataagcttctgcagttcccattcaactccttccctattcaaaagtttcaatgctcttccacctcccatcctcaataacatttccatcctcagctacagctgtgtaatctcaaagagtagtcagaagaggagattttaaaaaacaacgtaagagtcaagccagtgcttctgggaggccaaggcaaggaggatcacttgaggtcaagagtttgagaccagcctggacaacacagcgagaccccatcctttaaaataaaaaaaaccctttaacaattagctaagcatggtgggacttgcctatggtcccagctacttgtacttgcaaggctaaggtaggaggatagcttgagcccaggagtttcaggttacaaagaactatgatctggccattgcacctcagcctgggcaacagagcaagaccctgcctcttaaaaactgcttagtccctattctttcccctcatttaccaggtgtgaaatttcaacaaacatgtttcagtgaaatgatgaaaaggacacaacagcaaagtatgttagaaaaaaaatgctttggaatcagataaaaagtcctgagtttaaatttagctctgccttttacaagcctctgaagatttattctgatcattaaacgaacatacatgagtaaacctttaattagtatacactcaaggtacgtatattgttttcgtttctccttctaaagcatggaagagtttctttttaaaaaacaagctgacaaactatgaaaattaaaagagtacaacagcatgcagaagtagtacagaggagttcctagaagttatattctttctccagagagcaatattattcccaaaagggactctactcacttcacagcttggaaggtaatacctaccttctgacagaacagaaactggtgtctggatcctagaatcacctagcagtagtcacaaatactttttttttttttggtaatacgccacttaaataaaattaatgttaataagcaacaaagtaaatccttaaaaagaaaagccccaccatccctccaatctcccacccgaagacaaattataactcaacagcctatcaccaagattcagcctatcacctaggttcatctcaaaaaaaaaaaaaagacctgtgcaacccaggaagtgctgggaaatcttggtgcagcatggaaaatatgaacaccaacccacttaaccaaaacacataggaaaaactttcttccatttcagtaactaaaaaaaaaacccaagcacttaaagtgattactaacttgagcaatagctctgcactcacttggatgtgtaaccatgaacaaactacttgactgctctgatcttccattgtttatcttgaaaatcgtgaatgagagtaaaatgcttagcacagtgcctgacatatcacaagtgctcaaaaacttctattaattatagtgttacataaagactaaatgcatgtgaatatatcattgggggaaaattccatggcttgttagagcaagttgaatattgtctcttccaaatttatgttcacccagaacctgtgactatgaccttgtttagaaaaagggtctttgcagatgtaatcaagttatgaagagccatttagtgtgggctctaaattcaatatgactggtgtcctcctgacatggaaatctacacagatgcaaagagaaagatggtcatatgaagatggaggcagcaactgcagtgatgtagctacaggccaagaacaccaaggactagcacaatatcagaagctggaaaaagacaaggaaggattcttccctagagcctccatagagaccatggcccttttgacaccataatttcagacttctggcctccagaacggtgagagaacacatttctgattttttaagccatcccatttgtgatagtttgttatgacagtctaggaaactaatccatttgttgaaaaagaaatgtataaatacgacacgtaaagctgtgaattttcttgatgcattacttattggaactatcaacctagttttattcttcctatcggaactctgagaagtaaaagattatctatgatgttgtattttacagaccaagaatctgaagctcagaaatgttaagtgacttttcttctcaaggttcatgtaagcagctggtagcaaagccacgattagaaacaaaaatttaccaagtccaagtatggtgcttaatacaatacgctttgaatgatgaaactcttggataagcaacatacattcatgtgccaaatagcattatggtcaatgacagaccacatatacaatgatggtcttataagattttaatacagctgaagaatacctgttttagcacaaagcactactcctgtgtttgtggtgatgctggtgtaaagaaacctacagtgctgctattagaagtataccacatacaattatgtacactaagaatataatagctgataataaaagctatgttactgttacacttatttcttatgataataaaaagtgttatgtatttactatactatacttttaatcgttattttagagagtacttctactcattaaaagaagtgaactgtgaaacagcctccagcaggtccttctgttggcactgtcacaggcaatgaaagctccgtgtgtgttgttggccctgaaaacctaacagtgtaacaagatgtgaaggtggaagacagtaataccgacaaacctgaccccatgtgggcctacgttcatgtgtgtgtttgtgtcttagtttttagcaaaacagtttaaaaaataaaactttcattttaaaatggaaagttttaaagatagaaaaaagcttgtagaataaggtgtgaagaaaatatttttgtacaattacaatgtatttgtgttttaggctaagtgttattacaaaagagtcaaaaagttttaaaaacttaaaagtttataaagcaaaaagttatagtaagctaaggttaatttattattgaaaaaaatatttaaaataaatgtagtgtagcctcggtgtacagtatttataaagtttatagtagtgtacagtcatgtcccaggcttttcaatttcagttacccttcacccaccgactcacccagagcaacttccagtcctgcaagctccattcatggtaagtgccctatacaggtgtaccatttttatcttttctactacatttttactgtattttttctatgtttaggtatgtttaaatacataaatctttaccactaattgcctacagtattcagtatagtagcatgatgtactggtttataccctaggagcaataggctatataccatattgtctaagtgaatagcaggccataccacctcagcttgtatgtattaagtatgtatatatgtaagtatgtatgtatgtatgtatatgagacagagactcgctctgctttgcccaggctggagtgcagtgtcgcgatctcagctcactgcaccctgtctcccaggttcaagtgattctcctgtctcagcctcccgagtagctgggattacaggcacccgccaccacacctggctaatttttttgtatttttcatagagacaggggtttcaccatgttggccaggctagtctcgaactcctcacctcaggtgacccacccaccttggactcccatgcctcggcctcccaaagtgctgagattacaggcgtgagccactgcgcacggccctcagcttgaatttaagtgcactttatgatgttcacgcaccaatgaaatcacctaacaacacatttctcagtttcccttttgttaagcaatgtgtgatggtatatacaaaactccagattattttccagatatttagaaatacttttcagatattttgatattttgaaagtttctgaaaattgctctgtcattacttctgagtgatgagctgaagaataaagcatgaaccaaatgaggtgagtatcttcttatacacagctagtgagactataaactgacactgccaaaatacttctctgaagaatgcattaagaacataaaagagcattcatacctttgactgagataaagatatttatcatggcatatttaatttaaataacaaatgtaacttaaatagtcaacaaagaaagccaatagcatgcagccattaaaaatgttttccaaaaaccaactgggaaatattcagggcacatacgtaacatgactgtatttgaacaaattacttatgtgctaggaaaatgtaccataatgttggtagcgagataattttgagctgttgggttgttttttttttttttggggggggggggagggtgggtgtcttttatacttctatgtcatttcagtttcctgagaattgatacacagtatttcatcaattctaagaggtactctccccacatgtcaacaacttttaaatcaagatgcattttacaatttctgttatgccctggtttaactgaaataatttctttgtcgtacttaaaacaatggtacatcttacaatcaatagcatcttaagttctatgaaatgtagcagttttataacaaggaactaagatgatataacatatacacatatataaacccacatatatatttatgaatgtatataaaaagatgaagcagcacttatgactactattatactaatctcagttgttactaagagactctagttctcaaatatagaaaatcccacttaactactggctataaaaacctagaaacagacactgaagaggtgtctctgatagagaaagactgtgtttttctcctcagtacaggcatatccagtcacctcctagttattcttagtcatcattccagttcaagttctacaaatctcactttaaaatttcctttgtgaagacttgggaaagcaaaatatgcaccaaatctagaatgtttattagttttgttccagctaatttttaaataagtaaatcaggatttaatttgtatgctaccctaagggaacaaactagtaagaataaaaaagtgagccctctggactgtgtcctcaattaaagtatgctctattgaacttttagggggagggggaatatatatatatatatgtatctccaatctggaaagaagctataagtccgcagtgacatttttagaataaaagtttaaatgattagatagcccacagaactttcacttcaaaccctgatcattctgttcattttatcagttgatcaaccttcaacttttggcctactaatttaatggatactgttcacaggaaagccattttcttaaggctttgactagtactaaggtcaaaaaggcattttgacccttatttttagtagcaatagactttttctagacatgggtctacataaagatagagctcagccacaccaagctaatataaaaaatactttgcaagaatgtaagcttcatgaaggtaggatttttgagaacactgctgagacacagtaagcacttaaaataatggtacatcttaccatcagtagcatcttaagttctatgaaatgtggcagttttataacagggaactaacaaatataaatctaacaaatatgacagttaacatcaatggcttgcttgcattattcagtctgttttccttgtttcctgttagctcagatacccacacagttttgttctaaatacacgttcagttaaacattatattctaatagtgttttcctttttatgagacaggcctttcttagttgtccaggctggagtgtggtggcacaatcttggctcactgcaacctccacttcgtgggctcaagcgatactcccacttcagcctcctaagtagctgggactacaggcacatgctatcatgctcaactaatttttgtaatttttgtaaagacaaggtctcactatgttgcccaggctggtctcgaactcctgagctcaaatgatcctcctgccttggcctcccaaagtgctgggatcacaagagtgagccaccacgcgcagccacatcaggttcttaaattaaaccactatatcaggtcattaaaccatttactttgcaatagttaagaagagggttatgggggttacgaggtgggaggggatgtgagaaaagcgatattgatagttttcggcagcatttaaaaacatcagatacttatcccttaccttattagcacgtatctgtttgtaaatgtctgtttgctgacgaattcgatattccaagtcagaaacatgagcctgaagccagttccagcggctgacaatagctgcccggtctgcagcccatttccattctgacctgcgtctcctaaaaggaaataaactgagtgaaatccaagagtagcagtaatatctataccagattggggggtggggagtggaatttaacttttaaaggcccttgcagagactaactctagtgtcaagaaaaacccaagagagagacaagacacctcccgctcatcaggatgcacatggatataaacttccaaataggtatttcccaaattaagtggaactgcgttctagcatcctgatcctgtggcacacagtttctctgaaatccctttaatttctctgggacaataaaattattgtccatgccaaaataaaacatacattaagaataatctatacaggaaatccaactgacactaagaattattaaaactaataaagaattcagcaaaagtgttcagtaaagaatatttaaaaactaataaagtagaaaatatcattaagtaccattcataacaccaacaaaactaatgatatattaaatatctttacagagaaaataacgcctgaaagcatgaagatctatacaaatggtaggacacatttttttaggatggcgattctcatgaacatctataaattcaaagaaattccaatcaaattgcctacagtatttttaataaaagctgagaaacagatctaaaagttcacatggaataaaggaccaacagcaagaaatttgcaagaaggcatgatgcaaatacacattaccagacagccagatttgctgcaaaactatagagagcctcaaaacgtagaactagatacataaaagataacgggaaatttttaaaaaatcagatcagtgcagaaacgatcaaactactcaataaatagtactaaactggccagttctttaaaggaaaaagtaaaattagttcccttcttcatgatataattacaaaattttggcatttcaaattgctaaatatgaacagccaaacttaaaagaatatcttcgggacttagagcagggagcatttcttagataatacacaaagatttcacctacttttcaacatacaatagaaaatctaataaagttaaaaggccaactacattttggtggaagatatctaacacatataactgacgattaaacatcagaatatgtaacagaactctcagaaataggataaaagaaaaaaagacaatcttaacagaaataggaaattcacataaaaggcaaataataaatatataaaaatgtgtcatctcgttaaaatttggttaaaatataaatattaggtaaaacattaagatgctgtttgaaatctggatgggaaaacgcacagtctcataaagccaacaggtggtgagaaatggaaaagagcaattaatatattgctggtaacagttaaaattggaaccaccatttttgaaaaataatttgaaaatacttagcgaggtgtaaaatgtgcatacccaaccatcatgatactgtattttttttttttttttcctgagaggcagggtctcacactctatcattgaggctggattgtggtggtgcaatcacagctcactgtaacctagagttcctttgcttaagctatcctcccacctcagtctcccaagcagctaggatcaggagcatactacatacctggcttttttttctttttttttttttttttgagatggagtttctttcactctggttgcccaggctggagtgcaatggcgcaatcttggctcaccaccaaccttcgcctcccaggttcaagcgattctcctgcctcagcctcccgagcagctgggattacaggcatgcgccaccatgcccggctaattttgtatttttagtagacacggggtttctccatgttggtcaggctggtctcaaactcccaacctcaggggatccgcccacctcgacctcccaaagtgctgggattacaggcacgagccactgcacccagccctgactaacttttttttgagacggagtcttgctctgtcgcccgggctggagtccagtggcatgatctcggctcactgcaagctccgcctcccgggtttacgccattctcctgcctcagcctccggagtaactgggactacaggcgcccaccaccacgcctggctaatttttgtatttttagtagagacggggtttcactgtgttagccaggatggtctcgatctcctgacctcatgatccacccacctcagcctcccaaagtgctgggattacaggcgtgagccactgagcctagccccactggctaatttttaataaaaaatgttgtggagatggggtcttgctatggtgtccaggttgttctctaactcctgacctttagcctcccaaagacacgagccactatgcccagccatgaaattctgtttctgagaacataaactacacattcctctgcataaggaaacaggttcactggaggagagtctgtaatagataaaaactaattatattctaattctgctgaacttggtaaataaactataatttattcatttaatagttctatagtaataaaaataaacgacatctgtatgtatcaacatgattaaatctaagaacacaatgttgaatgaaacaactacaaaaaaactaaacaagattaagtacacacaagtagtgaaggaatttgatgaaatactatctagcaatttatttactgtatgtatcaacatgacctaatctcaacaatggggaatgcaaaagctgcacaaaaataaacaaataaacattaataaggattgttaccaatacagataactgatgaatatattttaaaatgcctaaaactgacatacaacaaatttacaatcaagctcctcattatctctggaaaggggatggagaagttggattttagctctacctataatgtttgacttctcatgtaaaaaaacaaagatggaaatgtgacaacattaacattgtttaaatattacactggggatacatggtgtctactatattctgtaatctaaatatttcataatctaccacaaaactattttcccagaaagcagcagcagtcacacagccctcagccccacttcccatcaggatacacacactcactgctaaaacttatgactataggtgaacttgaacacagtctcccataggggcaaaatacaaaatgtcaaaaataaaaaagaacaaatctgaccacgacagagtaagacatgaattaatacttaatcataccataataattaagaccaagggtagtaatggtattttaacttttgtatggaccaaacataaaccattcaaaccaaccactgtgataattatcaattatgtctcttcttttagaaagaaaacattttacagttccctaattttgatggaaccacttcaagataaaaagatacttttaaagtacagttatctgcttcaatgttggctgcaggtctagctctaccctaaatccaggaaatgatctcaagagatcaataagaaactagggatcattcttgaacaacaaaaatgccccctacccacaaagagacaaaactagttaaccctcgtattttattcccacctttccttacttttcaaggcttaccacctttctatcctgcaaaatcttttggatttatagattcctttcattcctaaaactaccaccacaccaggtccccatctatcaccactgggcaaccccaacagcctccttagctgctcttcccaacaccagtcaatcatactacttttcctcaatcaactcccctcacacctttttcatcctggcattctaatgtttaaggaaccatgcagctcctttgaaaatacaaaaggaaaagaaaattacttaaaacattttagttcgcaagaactttgataaatacactttttcttggatattaatgaaggtcttatgtcccctacacaggtatttacctaaataacaatacaaagcgagcctcctgataatatgttttggataatatggttaataaactaattaaagaaaggcaagacagcactaaggaatactaacaattcccaatttatgaacaagtttcattttacaagtgtatctgtgatgtgatggtttagaactcgaagtgatttccaggagaaagttgttacaacattattcttccataatgctgctcaaactctcatcatctccaatgaaaaatggaaaaccacaactcaagcgtccaagaagtatcttgtgttcaaaataccagcaatatgagcagaaagctaaactgttattaagcatgagaggtgtacagttaacaagtctggataagatatgaagatgttaccatactccagtggcagagcagagcaccactaaacagtaacacaagaataagagcttcacatcttttgttccttaacaaatacaagcggccgggcgcggtggctcacgcttgtaatcccagcactttgggaggccgaggcaggcggatcacgaggtcaggagatcgagaccatcctggctaacacggtgaaaccccgtctctactaaaaatacaaaaaaattagccgggcgtgatggcgggcgcctgtagtcccagctactcgggaggctgaggcaggagaatggcgtgaacccggaaggcggagcttgcagtgagccgagattgcgccactgcactctcgcctgggccacagagcgagactccgtctcaaaaaaaaaaaaaacaaaacaaaaaaaaaacaaatacaagctatataaactcagcttatcagaggtaaagatagacttcctcctcaatattcgaagtgtaaatttatcactctgacaatttacagctcaaaacaagggacacacattgaacattagggacatgtttaatgttataccatacagacttcaggaaagaacacaggactaaggttgcagaataatactttaaatacaatgaggacttggtttctaatatagtcattatcaataatgaagaaaatcacgtggattctaacactgatgagtcaactcattcctgatgcttgtttctgtgctattagtgaaataactgttttaactatgtgcctgagtaggacactagaatgccttagaacgtttgattttaccgtgtgctttatcctagtccatacaaaaacatgtactatatatactgtagttatcacctgagtgggaattcttttcaactcgtattttgctcattgcttttataaactttttattggtaaaaatggctttgtcaccatgtgctatacaaaaattcattaaaatgttacatgatgaattactttttggttacctaaatgcagtatcaatatttgcttttgtgacaccacatgaatagtacaccttaatgttaaccagctatgtgctagtattggtttacataagaaatatttgttgtatataaatatttcattagctatgaacttgtactttaatcgttctttttacacagttagactattaccacagagaattgagaatgctctgttgactctaagaacatagatctttcctgtgtttgtttcacactgcttttgagctaggtagtgagtacctgtgaatggttttttgttgttttcttcatgtgactcaacaattttaagacttctcattggtgaaatctatggtgaaaccccatctctactaaaaataaaaaaaattagccagacgtagtcgcgcacgcctgtaatcccagctacataggaggctgaggcaggagaattgcttgaatccaggaggtgacggaggctgccgtgggcccagaccacacgccactgcccttcagcctgtacaacagagtgagactccctctccccaaaaaaaaaaaaaaaaagcgccctctataaacacacttaaaccatacagtaaaagtaattaatttttttccttgcaaattcagggttcagcttacatgttggctaaaaattaatttttgtttttagttctttaaagttattaatagtcaatgggtttaaaagggattatcaatagatcaactcttttgtatttattagataagtagcaccaaaagctagacattgaaccacatggaacaccacatgttgactaccaggcctagtgcctctaattaagtcacctaattctattctaagatgggaaatttgtatgtcaatccagtagaacagggctggtggattatgcttctcttccctgatgtattaacataaatttttttaaatctcattaaggcaacaaacatgccagaaaaacccgaatggtggtaatttcaactttgattctgatttcagtcccatctcgattctttccttttaatgaaacaaaggttctattagccaactaaagtaaaatgactgttcacagtgagctacacagtgctacattcacactggtagataaattgacaaaggattatgtgctacttccaagtgtgcaggaaatcctgagacatctaagttctgaaatctccaggttatttagataacttttaaaaaccaaaagattcaaataaaactgagatcatcccagagcgtacaattgccagattaacagttttcagggtaagagttagggtcactgtggggcaggaatgagaaatcttgaaattgctgagtcacatgaaaaaaacaaaaacaaaaaaccactcacaagtactcactacctagctcaaaagcagtgtgaaacagagggaagatcaggagacaagttctcacttttacttactttatgtgatcctaaacatataaattgacctctgcaaataagaacaacatctgcttcacaaagttgtgatagccatacaatgatgtaatcctaactgcaacctaaaatgtatgtattagataagaataacaatttagtcagctgggcacggtggctcaggcctgtaatcccagcactttgggaggccgaggcaggcagatcacaagataaggagtctgagatcagcctgactaacatagtgaaaccccgtctctactaaaaatacaaaaaaaaattagccgggcttagtagcacgcgcctgtaatcccagctactcaggaggctgaggcaggagaatcgcttgaacccgggaggcagaggttacagtgagtcgagatcgtgccactgctctccagcctgggggacagagcaagactctgtctacaaaaaaaaaaaaaaaaaaaaaaaagaaataacaatttagtcattataaccatggatttaaattccgtatcaaaaaggtacaaaaaaggaagaaaaacagaataagattaaagaaaaacctctcagataaattcaggaaacaagtgttttcagttagcaacaagccatattctgagagtttcttgagctttgaactttagagtcatctaaaagttccactctaaacagaaaaatcaaagtagtctattagaatagacattgcattatcagtgacattaccaccaaatttaaaaagatggaggggataaagcacaaggagaaaaagaagagaaccaaactgtccagagttaaatatcccacattttagttgtaaagtaaaacccaggaaaaaactcggatacatacttcgtcttaacccattctcatctgtcacatgacctaggttgtgtcagctttctacagatatctgtagtaatgtggaacaaatgtaccagagccaatacttttttttttgagatggaatctcgctctgtcacccaggctggagtgcagaggcacgatctcagctcactgcaacctctgcctctcgggttcaagtgattttcctgcctcagcctcctgagtagctgggattacaggtgcctgtcaccatgcctggctaatttttgtgtttttagtagagatggggttttgccgtgttggccaggctggtctcgaactcctgacctcaaatgatccgtctgcctcagcctcccaaagtgctgcagttacaggtgtgagccacagcacccagccccagagccaattctacctaaactgccaattcatcctgacagacccttgaaattgaacacagcacttttgtcttactacttcaactagattacctctaatatttaaatgaaatttgtgtagttttggtagtttatttcagccaagcatttagcccaccatgaactcactctatccttcttccttccatttaacaaatatttaagcaactattagttaccaagaattagactaggttagggatgcaaaaacaagaactgtggctaaagtttacaatttaatggggcagatagatgttaataatcaaataatcatataaaatatacgataagagatcctaactatgtcagatttagactgggggatctagaaagacttgtgatataaatatttaaacagacctccaaagcataaaataggacttggatgcacaaactggtagggcttggggatgtggagcagaagacattaggtggaactgtggtgtgtcacaaagaaacgacatgtatacaatggttatgtggttagaactccaacagtgaacaacgaaaagaattcattcaacttgacaatggatacaggtaggcagggccaggtcacacagaacctggcaatccatgttaatcttataaaacaatataagcaatcctcatctttcctcatgctcttttatttatctcagaccctgtttgaatgaaaatttacaaatacaagctaaaagataataaactcccacaaaaccatcaaccaatttcaactatcaacttttggcgaatcctacctcatctataacatctatctcccatccctatgaattatttttaagccaattcccaacatcacatcatcacctctaaatatttcggtatgtttccaaaatgtaaggtcttttaagaatatataccagtatattttataatctaaaaaacaataattccttaatgttaaatatccagttactggttaaatttcctggattgtctcagttttctccaaatcagagtcaaataagatccacacaattcatttacttaatacatcacaagctcgtaacacgctcctcctcattttctttcctcacaatctgtggaagagacagcactatctgtcctttagaatttcctccattgtggattttactgactgtgcctttaacacaaagcccatacttctaaacttgataatttgacacctctaggctggccgtgctggctcatgcctgtaatctcagcactttgggaggctgaggtgggtagagcatttgagatcaggagttcaagaccagcctgaccaacatggtgaaacactgtctctactaaaaatacaaaaaaattggccaggcgtggtggcctgggcctgtagttccagctgcacgggaggctgaggcaggagaattgcttgaacccaggaggcagaggttgcagtgagccaagatcacgccactgcactctagcctgggcgacagagtgagactctgtctcaaaaataaacaaacaaacaaacaacctttagtagtttgatacatttcattttctgtaggtcagctgataaattttttttgtacattaaatttttacatgtttaagattgagatatgttttaaaatacactcaatcttttaaaaatcatttaaggtactttaaactcctttcaatacccgtcagtcagatttttcatcaaacatggtaaacatatacatattatatactctgcctagcacaataaaagaaatgtaattgtttgtcataccctatgcaaatttccaaccagaaaatacccagaagcatcttctaacactaaaacccacgtctctccaggaaagtttttccttgtgcatcgtacctcacaattcactctttgtcctcttcaagcttagttggatcctcttattttgttatttgtatgtgctattatttccaagtcatgtcatatatataactggtctccaactagattatccatgcctccttatgggaactaccatgtgttttaactgtaagacaatttttaatgatgtctgtgcacatgtagtttacaagtaaatttgcaaaaaatataaacaatatgagagagttttagctgatgccttatcctgtttaattctcaaatgtttatattttaaaaacacttaactgaagtattctaatggaggaaaaaatggcatgacaaagaagtatggaaatggcttacagttcttgactggctgtaggactgaacatggaatttgagcatgaagattttgagcaaaatactaggctacttactgtgtcttttttcttttttttttagacaaagttttgttcttatcgcctaggctggagtgcaatggtgcgatctcggctcactgcaacctccgcttcccaggttcaagcgaatctcctgcctcagcctcccaagtagctgggattacaggtgcccgtcaccacgcctcgctaattttttgtatttttagtagaaacaaggtttcacttggacaggctggtctcaaactcctgacctcaggtgatccacccacctcggcttcccaaagtgctggaattacaggcgtgagcaaccgcacatggcctactgtgtcttctttagagaataagactgttatgtttcaagaataaagcaaatgacaaatagtgaaaggctctcagttattcaaagtactgccattccagagcagctcctccagagtgaattaattttctgtctacttttcttcctttcaaaagttaaactgaggttagaatgttcaaattctgtatgtgatactaatttctctttcaaagagattgcttgaggccgagcatggtggctcaggcctgtaatcccagcactttgggaggctgaggcgggcagatgacttgaggtcaggagttcaagaccagcctgaccaacatggtgaaaccccgtctctactaaaaatacgaaaattagtagggaatgtggtgggtgcctgtaattccagctacttgggaggctgaggcagaagaattacttgaaccctagagacagacgctgcagtgagtgagatcacgccattgcactccagaccaggtgacaagagtgaaaccctgtctcaaaaaaacaaaaacaaaaaaccccaaaatgatcactcgagctcaggacttcgagaccagcctgggcaacaggtgaaaccccatgtctctacaaaaaaatacaaaaattagccgggaatggtggtgcaagcctaaggtcccagctactcagtaggctgaggagggaggatcgcttgagcctgggaggtcaaggctgcagtgagtcgagactgcgccactgtactccagcctgggcagcacagcaagaccttcacacacacacacacacacacacacacacacacacacacacacacacacacacacaccccagaagggtgaaggagcagaaaagtacagtgtattgaggcagggtccccctttcatccctactaccccagtcccacatattccacagggagaacttgcctccggctatctctagaagaatgagagaattttaatactaaatccaacagaaaaacatcttctttctcactttgaaaatacggtttattggaaaagagtatggtgtctggagtcagtgaacactgagttccaaatcctggccccaccacttagctagctattatcattgagcccccagtcagctactgagaaatcaaacaagttccaacgcacaatctccaggaataatgctccaactttagtaagtctaagaattgcctgagagagttaagtctcacgtacctttatgaagaaaaagcctcttagttattatgtaagatatctatgagaccatactttttttgttttgttttgtttttgagatggagtctcgctctttcgcccaggctggagtacagtggtgcgatctcggctcactgcaacctctgcctcacgggttcaagcaattctcctgcctcagcctcccgagtagctgggattacaggcgtccaccaccacacctggctaatttttgtatttttagtagagacggggtttcaccatgttggccaggctggtctcaaactcctgacctcaggtgatctacccacctcggtctcccaaagtgctgggaatacaggtgtgagccaatgcgcccagctgagaccatattttcagaaatagtccttaaagacactgaggtttagcaacagaacccatcttcaagaaaatgagttgaaccaaaaattaatttgttaataaacttaccagttcttaaaaataaatgtggtaaaaaggaacaaaacaaacaaaaaagtgaataaatagaagaaaccctggtacaggcaaggtggtgtagactctattctttctcccagctcatccctgttctaagcacaattataaatcctgcaaataacacaagaggcaatcaaaggaaaactctgaaagatagaaaagggaaggcaaactagttaaaggccccaggactaaaggaacaacacagtgacaaaagcatctaataaacactatccaaccgaaagaaggtaacccaagtttggcatttcctggcttccaagagagcaacaaagagcatctcagacaggctcattccctgcctccatataagggaagtatttccttcaataccagggaagcactgcagcaacagcaagggggatggatcaggaggtctgctaataataggaagccagaggaaacgttattgccccatttctctatttctttttacggcaaatactcattattctaatttgtctcttctcactgtttctttaacacagggtttcaacccactattgcaccaaagctgctggtcaaggtcaccaatgacctccactgtactaaatccaatttccacatttcagtccttaccacccttgatccatcaccagtatccaacaaaggtgattactccctccttcaaatactttctccacttctctttcaagacatactaacctggcttttctattgtctttttgaattccttgtaagactgcatatgcgaaatcactaaatcttctttcctatacttcctttctaggtgatcttacccaaactcatggctttaagtatccaactatgtttctgactcccaaattcctacctcgagctgaaatcgctcccctcaactccagattcctgtttctacctgcctactcaacacttctatttgaatgtctaaaaagtgtctcaaactttacatgatcaaaatgaagttgatactttcccctccccaactcctatatgccatcccaaacctgcttcaactagatggatctgttcaggtcaaaaacctccatgtaatccttaatttcaaccccccaccacctctatctctctcataaacacactcaattggcaaatcttattggcactgtcttcaaatatatccagtattcagccacttcttgccacttcattgttagtactttggttgaatctttctagatgagtccaagagcctctaaatgggcttctagctctcacccttgaccactttcaggatattatcatgaacatagcagccagcctaatattgtataaaaggataagttcgatcatgtcactcctctacccaaaacctagcctagttgtttaccatctctaaaaacccaagtcctgacaacgaccctgtaaggcctcaaacagagagcctctatcacccaatccctgctacctctctggcctcatctcctgttctcctcctggctcattccattccagtcactgctgtttgctgaacatgttaggcaagctgtcacccacaggaccttttatttgctattcctaaagcagatatcctcactttcttcaggtcatttccttacatgacactttattaaggctttcccttaactgtcctataaaattgcaacccctctccaaataccccctacacacctttctttcccgcttcctggctttattaatagaaccttcatgaaaattatttttaattatctatctttcttactgtctgtttcccccactagaatcatatccggaaaacagagatttttgtcttgttcaccataatatctctgggtgcttggaacaatgcctagcaaatggcaggtactcaaatatttgttcaaagggaaggaaggaagcaggaagagagagggaatgagggtaacaggctggaactatgatcctaacttttccttacaaaagattaaaaccaaagtaattccagactgaagctaaccccttttctcatctggtgccaacagacctcataaaactaactctggcctcctcataaaactaactctggcctctaatgctgaaagcgagtcaagcaattatagtccacactcttagtccaagtatacacaaaccagagaaaataaagctatattacaaagtgaaaactactaacaagatatttgagagctcttctttttttggagataggatcttgcactgtcacccgggctgaagggcagtgatgcaatcatagctcactatagcctcaatcacctgagctcaagcaaccactctcacctcagtctctgcagtagctgggacctcagatgtgcaccaccacgcccagctaattttattttttcatagaaatggagcctcacgatgttgcccaggctggtctcaaactcctaggctcaggtgattctcctgcctcagccttccaaaatgttgggattacaggtgtgagccactgcacccagtctaatcccaaccatacacaacttgaatggaaacttgctgagggtactatagatgttccagagtaaaaacgtttccgcttttacacatggtaaaatacaaaattctcacatctcaatttctatgcttttgcaaaccacttactaacagaatcgtgaattatatgatacgtgtaagatagttaagttttattggcagatttcgattctgccacatcaaattgaaaaatattctgtcatgttcatcattatatattatataaatttgcctccctcaaaaaccacacccccaccaaaaaaaaacccttaagaaataatttttaatgacatagacctcaaaggtcgagctagttttcagttaaagaatgactgagggcacaaaggtggacatttttaccatcctaaaaattggaagatatcactcccagggtggctgtgtgatttcaatgacataacatttttaaagtctagcattccattataagtgctcagtaaatgggaagttgctgctgctcttacaagcttctgactaccatacctggttgaactaactcagttaccacaaggtactctatgcccttacatctaatgacaaatatttgttttgaaaaacgtatactccttaaacacacttgagaaacaggaaccagagacccaagtacattttgttctgaatcaaattccagcatgcacagcaaagtgcatgtagaggggtgagagggtgactagggagactgcttcaatgggagattattctgcagtagtgccttaactgtagaacagtgatgatgataaactcatcctaaatttaggactactgacaggaacaagtgaccacagtaactgttcatcttaagtcgtaaaaagctttctggcaatactcatcttcaaaaaaacctagcatgtaggaaaaatcttttatgtgtttgaataagggtaatatagttaaagctaaaggcttagatttttaactggtctaatgagagaaagcacagtagtcatataataagaaggtttatgttttacttcattttactagtgtttcctcatgagaattaagtaacagaaattataggaatcacaaatgaagtgcttactccatgcaaaacactggtctggcacattacagatattaattcacgaaatcctcattaaaaccctgtcaagtgggtattatgatcatcactgccccatttttataataaggaaactaagacaataaggctaagtaacttgtctaaggtcacaccactaacaagcagagccaagacttgacataggtgctctgggccagagtttttgttaacagttggaatatacaaatttacaagtattactgccaaatcaattttctcaaaaataagtcaaagtggaggaaggggggagatgaccctctgaattcactaaggttctgtgaaaagatgctgaaacaaataaaaagagtatttgattgtcaaatatatgctatttagaaatactaatggaaaagaatactgtgggcaagaaaagaatcacaagtatttgtgctgagttctgaaaggagagaaataaggttggggtgggaggtggggaaagcaggtcaagcatggaatagagcatgaataaaaatgcacagtcagaaaagtaaaaagctatgtcctagatacaaagcagtagtaataggtagaaatagtattacaaaaacagcagtgtcactaggtatcaggcactcaatgcataactaaagagaacataaaaataattaaaactatagtgaaacaaataacaagaacatgtcatattcctggttgtgataactacctatcataattgtagtttttttcccttaaattattaagttggagcagttattttacgtctgatgcatttcttaagcggttttaaagaagggcatagaatatgtgatgataaatttgacacaataatttgagttcatgtgaatgagtgttcaaacattgccaagaaaacactgaaagataatttttaaagatggagtttcgctctgtcgtccaggctggagtgcgatggcgtgatctcggcttactgcaacctccgcctcccgggcaagccattctcctgcctcagcctcgcaggtagctaggactacaggcatgtgctgccaagcccagctaattttttgtatttttagtagagatagggtttcaccatgttggccaggctggtctcaaactcctgacctcagatgatccccctgcctccacctcccaaagtgctgggattacaggcatgatccaccgtgcccaaccgaaagagaatattaaggaagactctgcccaaccaattattaaaattgccattatacaacaagtataatcaatagatacggatggtatttgaactagactagacaaagagatcagcagaccacaaaatacaacatatacatccaagtatacatggcaacgtaatatgcaaagatgacatctcaattctcagaggaaagaacattgtatttaattgttgatattgatataaccaactacacatttgggaagaaaggagagggaattcctatcttacactacacacaaaaataaatctaaagtgtgttaaagactttagcataatcactgcattgggaggcattcttaaagaacagaagaaaagcagaaaccagaaaagtttattttttggaaaattaattaaaaattctcatgctctctgatccacttttcaagattcgatcccacagaaacgagagcaccaatacaataatgtttactatcaaggtaactgaaagcaactgtatttcccaaaggagaatggctgagtatattattgtacacctctatagggagtgttatataatcattaagaatgaagacaggcacggtggctcacacctataatcccagggctttgggagcccaaggtgggtggattgcctgaggtcaggagttcaagaccagcctgaccaacatggtgaaaccccatctctactaaaaaataaaaaaattagccaggcatggtggggtgcacctgtagtcctagctactcaggaggctgaggtaagaaaatcgcttgaacccaggaggtgaaggttgcagtgagccaagatcaagtcattgcactccagcctgggtgaaaagagtgaaactctgtctcaaaaaaaaaaaaaaaaaaaaaaaaaagaatccagaccgggagtggtggctcacgcttgtaatctcagccctttgggaggctgaggcgagcggatcacctgaggtcaggaattcgagaccggcgtggccaacatggtgaaaccccatctctactaaaaatacaaaaattagccggacatggtggtgtgtgcctgtagtatcagctactcaggaggctgaggtgggagaatcgcttgaacctgggaggcagaggttgtagtgagccaagatcacactactgcattccatcctgggtgagagtgagacattgtctccaaaaaacaaaacaaaacaaaacaaaaaactgggcagataaattttttttttttttgagatggagtgtcactcttgttgcccaggctggagtgcaatggcacaatcttggctcactacaacctccgcctcccaagttcaagtgattctcctgccttagcctctcgagtaggtgggattacaggcatgcgccatcacgccgggctaattttgtatttttggtagagacagggtttctccatgttggtcagggtggtcttgaactcccgacctcaggtgacccgcccaccttggcctcccaaagtgttgggattacaggcgtgagccaccaggcccggccgggacagataattttagacatcaatttaagtgggaagaagactacaaagaatacaaagaaactagcaatgcctgaagacattttttgttgtcacaactgggggtggggggatggtacttggtagaggccagagatgccgctaaccatactacaacacaggacagtttcctacaagaaaatgtcagtagagctgacactaagaaaccttgctgtatatgaaccactgataagaataaaatcttagctttccaaggtcaatcttgccttttagccccatcatggccccacgtgtttgcaggttctttggctaagccaccaaatagctgttatggtctgttaacaatcaaatgaatggcaagggagaagtttaagccatgacccagcatttaaaaaataatggaaaagaatacaacagaaaactaagagtatgcagcatgcagagtatgtggggaaagtaatttttgttaaagttaggcatatgcaagcctttgtgtctctcaaatttacctgtaggtataagtggggcaaactgtttatcgcacggtagatcatgctcaaagaaagtcattcaagatactcctcagttctctcatccaaaaaactcatgagttggactaaaaaaaaaaacaaaaaaacctacgaggcactttctttataaaatgttaatgaatttatgatcatctgcatgaagtctaccctgtatgtacagatgtaacctacatgggagggggtacagtccttataggtagacacctgaaaggctcaattcatttcagatgtttcaagaaaattccttagtcaataacattcacatagactttgtaagatcttgattaagccatgaggccaaatctaaatctaaatcacccactcagaaagtgccaaaaaccttaaaaccaaaagaaacattagagattatctatctctaagcatctcaatttttaaatgagtaaaatgagcccaaaatggggcccaaaggattaaatgatttgcccagagtcataagccaagtcagactgtcaaaccgttaaagcaaactgataagaaaaagatgctcagggccaggcatgttggctcacgcctgtaatcccagcacaatgggaggccgagtagggcagatcacaaggtcacgagttctagaccagcgtggccaatacggtgaaaccccgtctctactaaaaatacaaaaattagctgggcatggtggcaggcgcctgttgtcccagctactcgggaggctgaggcaggagaatcgcttgaacccaggaggcggaggttgcagtgagccaagatcgcgccattgcactccagcctgggcaacagcgagactccctctcaaacaaaaacaaaaaaactaaaacatctaactgaatcaggctgcttaagtatcaaaataatcttaaatatctgaagaggaagaaggataaagattccctaacatgcagaactaaaactagaaaaactttattctaatgttcttagactactatcaaattctccctaggacttctacattgctgataacagcttacaatatttttcccagtttagttaagaccacatgtcagtattttattacaatctttcaagcaagaaagaaggtctctgatatactaatttaaagacatatacactcttgatagagctatattaggaaatggcaatggctaattcgtaaactagatttttaaaaaatgacaatatcttgtttaaagttattagactatgacagtcatctgagtggggaggtaactagttccccagcagaagccttaatcccattaaggtttatcagacaagtgtataacagaaatgttcatttcttctcagaaggaggttatgaattatatcacacggattctgtttagatgaggtttagaacaatttttctttttaacagtttctccttttgatttagacactctctaaagatctgtccagatttaggtccatttcactgaaattttgtactaaagtccacgaatttttttcattttttctttggcaaacaggtatttttgtaaacccaagttttatttatttatttattttgagatggagtttcgctcttgtcatgcaggcaggagtgcaatgcacaatcttggctcactgcaacctccacctcctgagttcaagcgattctcctgcctcagcctcccgtgtagctgggattacacgcgcctgccaccacacccagctaatttttttatttttagtagagatgggattttgccatgttggccaggctggtctcacactgctgacctcaggtgatccacccatctcagcctcccatagtactgggactacagacgtgagccaccgtgtccagcctgtaaagcaagaatttttaaagagcaaaaagaaagtgcagattttctgtctccttactacagatgagaaaatagtataaagctatcgagagtgtcaacagttctatattacccccgtccccacccccactgtactgctcctgaaagctaaacagaaatcccaaggaaagtatacattcaaggaacgaagataactttagatatgtattacatgatgcatatacgggttttcagtgaactatatgtgatttcaaactaaattaaaaacaaggctttactatgacattatgaatgaaaaacagtttatttataggatactttgactctactcaaaaagtatgcttaaacaatccaacaactttaggaaagccaaccgataaatctttgcaatcaggcagaaatactaaggcatttaaaaaacatacccagaccgcttttaacatttaccccagagatctctaggctcatcacagagggtaaccacaaaatgcttaagctgcatacagacatcaggcaaatgccacataactgctggacagtaagttatcaccacagtagttaccaatgtgacaaagcagaggataaggagcattcagagttggaaactacggtggaaacgtttccatttatggcacattttctgattggttttataactcatgttactaactatagaatcatagacgagaagaatccccggaaccaagcctcttataaataagtcaactgacctgaaaaacttacgacagagtgaaaactagacccaacttcaaactgagataggattttatacttcacaaaaattaaagttagttatttagattttattagaaatagctcagcacgtaaagtcctcaaaggaaacagacatacagtcaaaaaaaaccattactgcggggcgcagtggctcacgcctgtaatcccagcactttgggaggccaaggcaggcggatcacgaggtcagaggatcaagaccatcctggctaacacggtgaaaccccgtctctactaaaaacacaaaaaattagccgggcgtggtggtgcgtgcctgtactcccatctactaggcatgctgaggcaggagaatggtgtgaactcgggacacggagcttgcagtgagccgagatggcaccaatgcactccagcctgggcaacagagcgcgactccgtctcaaaaaacaaaaaccaacaacaacaaaacattattaaactataataatgttttctatcaagacacaaaatattaaaagtagatcaggaaggaataataagtcaattcattatcaaccttgtgactcttctgtccagcctcttccagaggttccctttacttttaagtgcaatgcaatctttaaccttaactctaaaaactcatttagagtcctccaatttcttatcagttttccaatacagctcaagaacttttccatcagtgaataaaagttgcattacttttccctttcacagcttgttggcagggaattattttaaatgtacaacaaaaatctataaatctgtagcttccaaaagagtgtttgaaaatatattttaaatggcaaaataatctcagtaatcaacagtaatactgaagtaatgtttgaaaattacatttttagaaagtataaagttacatttattacaagtgaagaaaaaaatttttatgagggaatgtttttaaaaagggttacaaattctttgacacttctcccaatgagaggcagatttctgtcaattccccctcaaatctgagggagcttgtgaccactttggtcaacagaatatggtggatgtggtactagatgactttccaggacaggttataaatgggtatgcagcttcaactgagcacagagacttcatgttaagagatattataaccctgagaattccatgctgaacagccatgtgcacacagtacttgacgaagcaacccagccaagcaaagctttctagccattccttaaaagctgccagacttatgggtgaagaaactatctcacaaatttgtgtatggactctccttccagtaacgtaaattccaagagagtaggaattcgtctttgttttattcactgatgtatccacaccattttaatagtttccttttatgtatgcagtaagcattcaataaaggtctgttaaatagatattagtgatggtggcagtggcaggtggagaaggggatatcctattcatgaatagttcacagcagtaaccatgtgcatgcctcgcaaagcagccaaagattttcagagagtctatctaattccaatgaaaagcccaggcttttaaaacggtattttacaaagactgatggatctgactaaagaaatttaaaacttctatcattcaaaaaccataaaaattaaaacataaataaataaaaagctagggaaaacaatttgcattttaattatgcttttaaaatgcaaaaaaaccctttcaaataactcaaaaagacacaaagatttacagatttctttatataaaaaagtgacaaataaatacaaaagaaatacactactaaatcaaccaaataaaataatccaagaatgtcttttttgtttattaaattggaaattctttaaaaactactatctgttaggcttcagaacactgctgacaaaacagcagtttcattctggagaacataacatttctcaaaagccttaaaactgtcattatcccatgaccactccccactacccccaccccagaaaaagtccacatctagaaatttaacctaaggtaataatctgtgatatgaagcaagctttacacacaatgtttttaaactcttagataaaagagcactaactgagggtcatgttcccgacgttagttttatttgcttgtagttgggttttctttggccttcacaagtgtgtcaaaaaaaattcagtaagttgccagcattttaaaatctattgcacacaaacacaagatctgccagcactgggtctgcaagcctcttaatgactattagctaaacagtagccaatcccttcagatgtggcacatgatacacagttcaaaatcatccctaatctgaaagcttggttcatttacattagatgctttatcttctaaagttatctcagttggaagccctacactagagatcaaactttaagcatgcagggcttgctaaacgctgattggtgggccccacccccagagtttccgactcaggacatctgaaatggggtcccagaatttacatttctagcagatttctaggtgatggtccaaagactacactttgatggtctagagaccacattttgatgaactttccttgctgaagccagagagaggcctagcatcctttgaattacacaattacaggatacttaaacaatattggagattccattaatgggggagggaggcaaggaagagtagaaaagccgacggataaacaaccaatagtcagtgcactgcttccctctatcagaggtggaaaaccattgccctacactaaatttaagaataatcctagattaagttgctagtccaaattttctattctacattctttctcatgggccttatccatttctcaaggtttaatgacctcttctacacttcatggataaaataacaggggtaaacaaaaattgtggtaaaagatcccacgtagctccaatattttatgactaacaaatgtgtatcaccagccttaatattttctactgaatttgctttctccagctggatcctatacatagcagcttttgctgaatgcttcctttgttccgggcattgtgctacaacattacatgacttttcatcatttcatcataataacaactctatgaaacggtgcctactatccccatactacagatggagaaaaagaggtcatttgtcaaggggttaggtcatttgtcagagaagcaagcacaggtaaaatctacatctgtatacgggtaatctggctccagagtcctcaattttctttttctttttttttttttgagatggggagtctcgctcagttgcccaggcgcaatcttggttcactgcaacctccgcttcccaggttcaactgatctcgtacctcagcctcccgggtagctggaattacaggtgcacgccaccacgtccagctaatttttgtatttttagtaaagacgaggtttcaccatgttggccaggctgctctcaaactcctgacctcaagagagctgcccacctcggcctcccaaagcgctggggatacaggcgtgagccaccacacccggcccagagtcctgaattttaaccactacacttcatctaaaattcaacttgtacaaattccaatctttcatctaaaactagctcttcctctaaacttgcctactgtcaatgttttcaccttcctgctcaggctgccaggctccaaatcactaagttcctaccataattaagtccttctacatttcacatctgtctttttctttttatttcaattgacctaaatgtccttattcacccttcacctggcctctaaaatgcctagtatttctgcttctagtcttacacccaacggtgctcctcactcattgcctatgggtcaaaggccagcttatttaacatcaaattcaatttaagaccttacctacctcttggatccatttctgtggttccacaaacagattaaaaattatacttaaaacacaccaacacacatgcagagctttatttctgaagaagaagagagaggggtggaaaggaaaaaacttaagaaacaatgttcaatctgaaagtatcacttctaagtggaaggctacaagggataattaatagctaccaaaactgaacactgaaacatcacatccctctttcatggagccatgtaagttaaaaaagaatcttaaactgttgaggtatatcaacatagacaaaatctgaatgccaaagtgagtttcactctaggatcaggttatctggcagctcctgaaacaggacagtttcaggaaccctgtacaaacctcagtgaaatgaaataacttcaagctgtttgttacaggggactcttgtgtcttttagtctaagtaaaagcagcaattttctacaatatatttatataagctgtgcatttccatgaaagaaaggaggtctactgtggatatatgcttggtatgaaattatgtcagaaacaagtgggagcgaggggcaagtcaacatgctgtcactaaataaaagacagacccccagaaatgacctcaacaatcaaagaaaacatgatagtgtaagttaacatgattaattttttaaattaatagactatattttaaagtaatttgaggtttaatgaactgagtagacagcagagtacccatataccctcccttccatttcctttgcacatttattatacttaatgagccaatacttgcatattcttattaaccaaagtccatttacatcaaggttcgctttgttttgaattttgacaaatgtaaaacatgtacttaccacgaaattttacaatatgcaataccaaaaaatacagctagattcaaagagagaatgtttcagcatctcattatctttatcacagtaacataaactgaactccgatcttctcccctgctcccacctagttttcccagtcttcccatctcagtaaagagcaataccttccatccacttgctcagaccaaaaattccttcctcttttataacccatacatccagcccatcagcaaatcctacctgctctaacttcaaaatatatccagaattgaaccttaattctcacactttaccaccaccactggaacccaagacaccattctctcactaggttattatagtagccccctaactcttttttttttttttgcttctgtccacaaactaatcagatcatgtcactcctctactcaaagcaggaactggcattctaccttagagcaagagctacaatcctcacaacaggcctactaggttccacacaacctgtctccacctacctcagttcccttttctgtctatgacttcacctcctgtgtcctcttcaccacttgctgttgaagctacactggtttgcttgccggattacttcaggcagtctctgtccttaaagttttggcactggctgttctttttgtccaaaatatcttccacaaatgctcacacagctgacttcacatcctgacacaaatatcactttcatagttaggcctttttccctgatgaccctatttatcactgcattgttttcccctgtactccttatccctcttacctgctttatttttttctgcatagcatttgctgcaaccaaatatatattctactttgttattttattgacccccccaccccactagaaaataaatgcagcaactgaggtttctggccttaaaaagcacttagtaattatttgttgaatgaataaactatggtgtacagattctcctcaacttacaatgggggttttgtcccaataaacccatcataatttgaaaatatcataagatgaaaatgcatttaacgcacctaacctactgaacatcaaagcttagctgggcctaccttaacgtgctcagaacacatacattatcctacagctgggcaaaatcatctaacacaaagcctattttataacaaagcatgaataactcatttactgaagactgtactgaaagtgaaaacaacggctgtgggtactcaaagtacagtttccagttttcacacgataataaagttgaaaaaccataatttgaactatagtaagttggggaccatctgtcaaggttcctaaaggtgacatacaggtgctagcaactacagtctaaaaaaataaagccccaattctcaacaaatcagtaactgattctggaaacacagaagttcctttgactctcttaaaggcttcaagcccctctatcagaaaaaaatgtctacagtttgaggagactagcctgctgccttcgggatgtccccatctgttttctagccactaacacagccacaaagcataccacacttaggaacagatctatgggtaggacacaagcatatttaggctgctatcataaagataaagatgcattcagccataaatacttaaacaagtattcatactggaaatatgaaacacttttaatcatattcctaacaaaagtaccacgagattaactggctgagaaataatgggggtgatctcctatcgactacaaaagtgggttagaaactgaagtaatctaacctcatcaagcaagtaaagcttcactttactgcactttgcagatgctgttttaaaaaaaaacaaattcaatgtttatggcaaccctgcatcaaacaagtctattagcgtcattcttccaacagcgtgcactcacttcatgtccatgtgacacatttgggtaattctcacaatatttcaaatgttttcattatctgttatgatgatctgtgatcagtgatctctgacactgccattgtaatttctggaggtaccacgaaccgcgcccataaaagatggaaaacttaactgataaaaatgtgtgttctcactactccactgaatggccattcccctgtctctctccctctcctcttgtttccctattccctgaaacacaacaatattgaaattaggccaattagtaactcctcaatggcctttaagtgttcaagtggaagagtctacagctctcgctttaaatcaaaagctagaaatagacacttgcggatgttttctggtaaaatagctgaaagaaaagaattttttttagagacggggcgcagtggctcatgcctgtaatcccaacactttgggaggcggcggcaggcggatcacctgaggtcaagagtttgagaccagcctggccaacatggcgaaaccccctctctactaaaaatacaaaaattatgtgggtgtggcattgcgcacttgtagtcccagctactcaggaggctgaggcaggagaatcacttgagcccgggaggcagaggttgcagtgagccaagatcgtgccaccacactccagcctgggcggcagagcgagactccatctcaaaaaagaaaaagaatatatattttttaaaagctagaagtgattaagcttctgagaaaggtatgttgaaagccaacataggctgaaagtaaggcctcttgtaccagttagcaaacttgtaaatgcaaaagttcttggagaaaatttaaaaagtgctactccagtgaacacacaaatcgtaagcaagagaagcagctttattgctgatatggacaaagttttagtggtctgtatagatcaaaccagccacaacattccattaaactgaaagcctaatccagaacaagaccctaatcctcttcaattccatgaagactgagagaggtgaggaagctgcagaagcaaagtctgaagatgacggaggctgctttacgaagtttaaggaaataagccatctccaataacctaaaagtgcaaggtgaagcaacaagtgctgatggagaagctgtggcaagttatccagaagatctagctaagatcatcgatgaagatggctccattaaacaacatgtcagcaatgtagaaaaaacagcattctattggaagacacaatccaaaacttttgtggctagagagtagaaaggagaaatcctgtcttcaaagagaggagaatgcttgacttcaaagcttcaaaggacagcctctcttgttaggagctaatgcagctggtgattttaaggtgaaggccaatgctccttgaccattctgaaaatctaaggcccttaagaattacactacatcagccaggtgcagtggctcatgcctgtaatcccagcactctgggaggccaaggagggagaactgcttgagcccagtagttggagaccagcctgggcaacacggcaagaccccgtctctataaaataaaataaaaacaaattatgctacatttactctgcctatgctctataaatgaaacaacaaagccaggatgtcagaacatctgttgacagcatgttttactgaatattttaagtccaccattgagacctcatgctcagaaagattcctttcaaaatactgctgctcactgacaatgcaccattgccggagaggtctgaaagagatgtacaaggatataaatcctgttatcatgcctgttaacacaacatccattgtgcagcccacagatcaagcaataatttccacttctaagccttataatttaaaaaatacattctgtaaggctatagctgccatagatagtgattcttctgatgaatctgggcaaagtaaattgaaaattattctggaaaggattcaccattctattgagtcactcatgattcatgggaggagttcaaaatatcaaccccaacaggagtttggaagaagttgactccgactctcatggataatcgagaggttcaagacattgctcgaaaaagtaactgcagatgtgaaaaacacagcaagataaccagaattagaaatagagcctgaagatgtgactgaactgcaatctcgtgataaaactgaaacagatgcaaagttaagttgactctgactctcatggataactgagaggttcaagacacaggtcgaaaaagtaactgcagatgaggaagaaacagcaagataactagaattagaaatcgagaattagaaggaaagaaagggaaggaaagaaagggaagggaagggaagggaggggaggtagggagggagggaggagggagggaggagggagggaggagggagggagggagagagggagggagggagagagggagggagggagggagggaaagaaattgccacagcttccctaaccttcagcagccactaccctggctagtcagcagccatcaacatggagataggaccttccaccagcaaaaaagattatgactcacttcatgaaggctcaggtgatcgctggtatttcttttagcaataaatattttaaaattaaggtagtccactatttattatgacataagcctaccgcatacttaacagactacagtatagtgtaaatgtaacttttatatgcaataggaaacagaaaaagcccatgtctctcactttagtgtgatattcactttattgcagtactgtggtcatctggaaatgaacctgtgatatctctgaggtatggctgtattttcatacaaataaaggcactccccctaaatctagagtctagatcccaaatacatctgtccatatagggggtaccactcccaagaccaaaggggtgtatggctcctatctccagccgtaccaaatcatatatacagtgtaatatctggttactctttattcaggacagctacattcaaaggaaacataaaatgggcagaataaggactccttgctcattaacaaaacaaagccaactcttatgtcagagtacccttttgatcaattagtgtgattatgttcactagtaacagattctaccatcattgttgtccatttcatttccattctcaagctttaaaaccccaaaaggacagaaagagatactacaggctagtattagtaatactaaaaatagttacctcttattgaaacctgaagggcctggtacttgacatatatcattttctaatctttatatgaactcaataaagcaaatattgttatttcaacactattacatattagagactgagcaatctggacaaagtcacacagcttatcagtaccagtaggaattcaaactcaggtctgactcaacagtctgcattcttaaatatacctcaataaagctgttgaaaaagtaaaagtcggccgggcacagtgtaatcccagcacacctcaataaagctgctgaaaaagtaaaagtcggccgggcacagtgtaatcccagcactttgggaggccgagtcaggcggatcacctgaggtcaggagttcgagaccagcctggccaacgtggtgaaatctggtctctactaaaaatacaaaaattagctgggcgtggtgatgggcgcctgtaatcccagctactcgggaagctgagacaggagaatcactcgaacccaggaggcggaggttgcagtgagtcgagatcgcgccattgcactccagcctgggtgacaagagtaactacgtctcaaaaaaaaagtaaaagtctccatctttccactagaccacactgcttttctcaatctttatgacaaacatgtaaggcatattgggttctggataatatgtcaaggagatatactattttggaatattttggcaaataaaggggggctttaaaacatgaaatttttttttcttaataagaactgtaatctatttccccaacttcattattaagtgagttttaggcctaggtcttccagaacagtttcctccaaaacatacagtgtaatatctggttactctttatgtgtgcataagaaatgtcactgtgacaaatgttataaagaaaaaatttgattaccctaaaaacaaatacataaacagcccgcaagtttagctcctaaagtaggaaagaataatgtgaaaatgtttctggctgtaccactcaacaaaaatttgcccgccaataaggaatcctttcttcaaaaattggtcatgatcattagccaaactgtaaccagtaacatccagctggattatggagctaataaagaacaacagaggggatccacaggaaattcaacaggtaacttacaactggctctctcatcagactggcagactgggtctaatccgaggtcagatgacatgggggattatggaagccaataacaatcatatttaaataaatgtcctttacagaacaccaccactttcctcataaaaagttcaaaggactattttcacccctcacaattacagtaaggataagaagcccaagcacagcttgaagcagcaaaattttctgaaaaggaattgaattctgtgttctcttcaggatcttcctttcccaataatgggggtattaaatttcacttataaatcaaactgaaagggaaaaaaagaacaataaaaaatgagctggaaaacctacattcatcatcttcaaaacaacatcaagttagaaacagttttaaagcaatgttacaactcctttagaatctggcaggttttctggtttttaccagatcccgctccggcaacaacaaaaaaagaaacagttttaaacagttttatgggcgtggtggctcacacctgcaatcccaacactttgggaggccaaggcggacagattgcttttcagcacaagagtctgagaccagcctgggcaacatggtaaaattttgcctctataaaaaaataccaaaaaataccaggcatggtggtggcacactcctgtagtcccagctacttgggaggctgaggtgggaggactgcttgagcccaggacagcaagggtgcagtgagccgagattgcaccaatgcactccagcctgggcaacagagccagaccctgtctcaaaaaaaaaaaaagttaaatgctgatgactgaatagaacacaattctctgtaaattcttcaatgtgataaagcatttcctacaccagttaccagtggcagcacctaataagacttgagagcaacttaatacttcaccctcatgtatgtatgaatttaaaatagaacatcacaataactacgaagatacccaaacaccccttccctaatttttttttttggtacaaacaaagtctcgctatattgcccaggtggatctcaaactcctgggctcaagtgatgctcctgcctgggctttccaaagtgctggggttacaagcgtgaaccactgtgcctggtcgcttccctaattcttaacatgtcccacaaaagattctgcttgatcttggcccccactatatcatcactatctctagtaaatagactcaaagcctctgctttctctgtggctctagccacactggcagagaccaaaggagagttcaatgataggccctctcacagaaccttgtgccttaccatacttgtcagttacaattttattcactcgattcaagcattttttggatgcctcatatgtttcaaggtacctttgttacagcagtgaacaaggcaaagcccctaacaggaggaaattcacattccagaggtaagaagagaattaaaaagccaaaaaaaagtgtgtgtatgcatatatatgtgcataagaaatgtcactgtgacaagtgttataaagaaaaaaaacacagtaagaggacagagagtgaagttgtccttgtacagttgacagtcaataacacctcttttaacagtagtagagacctgaacagggtgaagaacagagccaagctgacaggagatctggattaaagctttccaggcagaaggaatcgaaaataggcgggaatatacttagcttgttgagcaaggcaaacagcatggctggagcacagagagccaaaagagaggtgataaagacaacaccaatgaggtaaataaaagcagacagaacttggatcctctagagcctgcagctcacgatatggagtttgaattttagtctacgtgtgacaggaagcctttgaagaactttgaggagggacacggatgtgttatcgacacactataaatgaccagtaacttcagaagcaaggaggccaactgggaggctgcgaaggttgtccaggcaaaggatgataatagcttagactagggtgatggtagcagtcaaatgaggaatgttatttattttcagaatgtaatctgaaggtggagccaagatttgccaatggaatagaatgtagagatgaaaagaaaaaaaaatctattcatctctgcatcccctcagagaatgtacctgaccaccatgaaagcaagggccatgtttgtcctattcaggtccttgaacaaaggaacagtgcagtatgttctagttgaattaataaatgacctgcttctttccctacagaatcacaatattggcatttattttggctggcaaatactggtacgatgtcaagcatagaaattaagcaccttaggagaagaaaagggagttaaataaaaaagagatccatgtttcactgaacttgcaaattcaactcaaagcaccacctgtctgaaaatggaacgtatatatataaaaaaactgctcattaaggaaaataaatcacagtatctcagcaacagtgctttgtcgtgagttacaagattggctacaccatctgacaggattacttaaattgacaaagacctgcctcaccaaacacagctagaggtccttgggtccttgtggtactggtatcaggaatctgataaatcagtcagagtgtggagtgtttttaaaacacagacaaaatatatttagcaagcaaagtctgttaaagggaagattggagatcactttaaaaataattcaaagcctactctaagtatttgcaaaattgtaagattatatttctgtgcttttgaataagattcagattggacagtctcaactctcccttgtgggagagggtaggggtgggggtggacctgttttctactaagaaatttataggactctccaaaaacagaacttagggcagtactccttaatagtgaccatacattagaatcatctagggagggctgggcacagtggctcacacctgtaattctagcactttgggaggccgacacaggcagatcatttgagcccaggacatcaagaccagcccgggcaacatggtgaaatcccatctctactaaaaatacaaaaattagccaggtatggtggcatgtgcctgtagtcccagatgctcaggaggctgagacgggagaatcacttgtgcccagaaaggtagagggtgcagtgagctgagatggtgccactgaactcatgcctgggcaaaagaatgagatcctgtctccaaaaaaaaaaaaaaaaaaaaggaatcaactagggaggcttttaaaacatgaatgctggagacccacaccagataaattaaatcaaaatttaatcgggggtgggtcctgggattttccctttaagtgtttcccacgtgatctgaatgtgcagcccaagttgagaatcaccaatttacagcaataaagtttaaagtagaggatttaaataaaagtcttttaaagaaacaacactttcagaagtcaacaaacttgagccttcatgttaacacgtgggggtcacagtgggcattttggagcacagataaaaggacctgctttggaattgtaaaaggctgtttcatacatacaaacagttcaggaaaggatagaacgaaaacaaaaacaagaaaccttgattaaccccaccacattccttcccaagggcttgaattttttaaccgaacactacaatagcaacaaacctagagagtcagttcaagacggcttctccctgtaatgctgccttagaactctacagaacagcagtcactgctgcacagctaaatacatctccagccaaggaaatctagacatagaagatagaaaataacatcccagtttgtccctcctctttcccctccctcatcacatatcaacagctaactttgaacacatctgtggttcactgtaccacttacaggggtacagaggaatgaaattaccagtcctcactgtaaaataaacacatttctttaagaaattctataaagcacaagaggaaagcaaaaccttagtaaactgacaaatgttcccattctcccagcacatgaagaagactgccacagtctttttcaattacactttgaaaccctctgtcctggttttcaagcacaagctgatcttcacctcattatagatactcaaactgccacccgtcttatttttaaatatcagagaagtgacaaaattctatctatgatcaaggatgtattataaaagagaagaaattttgcctggtttttacatttatttaagtcccttctacaatgaataaaaatggttgttcaaatcaatgggtgaatgggaatacaaataaaatatgggtagcattttaaggcatggtattaaggctaacatgatgtccatctaacatccagtttctgaaaatctgaaatcagaacacaggaccttttcatttcaaatttacattaaagttcagctcactgattaagcatttccctcaataaaattacatttgtcataccttaattgtgcaaaagctgcaaactggtaaaaaacttgaatgccatggcatgattattcaaaaataactggtacaccctatgcctgaaacctgagtgcctactgtgaacctgccaaaatgattacaatgacaacccatcatcttcatcacatgaattactgcaatgtgaacagtattctgctgagcactatacagtaatcaaaagacaagctccacatcctcaagaagcttataaatttgactgaggagatagggctgataggcaagatagcaataaaacacataataagggcctaaatcatgcagtacaaactaagttttgaataccagttcccagcttgcagtctcagacatagatagcaacaccaccaccaccacccttgccaagccaagtaagtaaaaagtaaaatgagtaggctaggcacggcggctcatgcctgtaatcccagcactttgggaggccgaggcaggtggatcacaaactcaagagattgagaccatcctggacaacatggtgaaactctgtctctactaaaaatacaaaaattaactgggcatgacggcgcgtgcctgtaatcccaactactcgggaggctgaggtaggagaatcacttgaacctggaaggcagaggttgcagtgagtcaagatcgtgccattgcactcctgcctgggccaaaacagcaaaactccatctcaaaaaaaaaaaagtaaaatgagtatacaggagtcctaaaaacttgagaaaccaaaggaagcaattcatttggtcaagagaaaggtcagggcagtttcaaccttcccatttatttagctgtgtgactttcaacaatttacccaaccctttaaaggaagatagtacctactaattaccatgagaaccaaatgagatagtgtatataatgcgctttgcacaatgcctggcacatagtctcaaatactgcctattatcattactgttagaaacagtaaaatcctagtgttggcaggggcctttcaataatccaattttccagtcgaatagttctcagggtgtagttaccatcagcatcatttgggaaattgttagaagcccatactctagggctccactccagacccactgaatcataaattatcaaatctgcgcccagtaatctgtgttttaacagcactccaggtaattgtgatgaccattaatgttagagaattgctgccctaattaaaccctctaattttacgtataaagaacatggaggccaggttcagtggctcttgcctgcaatcccgacattttgggaggccgaggtgggagaaccacttgagtccaggagtttgagaccacgtaatatagttagaccctgtctctgaaaagaatacaagaattagctaggcatggtggcatgtgcctatagtcctagctgctcgggaggctgaggcagaaggatcacttgagcctgggaggtcgaggctgcagtgagccatcatcataccactggacttccagcttgggcgacacagcaagaccgtgtctcgaaaaaaacaaaagtaagcagatggaaacctgaagagataaaataacctgctcaaaaccacaatcatggagactgtttgtttagggtccattatatgccaagtaccagggtgaccactttttacatttttaacatcaggtcctcacaacagcccagctgggccccaattaacagaagaaaaactgaggttcaggtgtgagatggatggagtaatttgtcaaaggcggctcaatttttaatgggcaaaattaacattcaaatccaagttgtatgtgatcccaaacccttactgaaaccaggaccactgagtgttctgagggaacgataccaagcacacgcccagacttccccacccaagggcatcgttcttttcattctatcataccaccttagctgcaatgattttaccatgaaacataaccagaaattagcactttaaagcaactctcagaagacaggtggtaaacgattcttcactccaactagaaaggaaaaaatgacaacatactatgaaaaaagctatgaggcaggaaaaagcacacgtcaaggcatggagatacggatatagactaggtaattttgcaaccacataagtgaaagaaaatttgctatccaatcttcctattctctactcccaagagcctagtgcttttgtatagttttcagctcagtaaagtgcctccagatttataaaagctcaatgacaataacaaggtatctttattacaaaatagttgttaaaagtttgattcgaaaaattttaaggaaacctttcaggtaactgaaagtggagggtaggggcgcgactcatgaaggagttttttaaccaaagaaatgatatgatacatttttaaatgaccacttcagttgcaatataaaataacagattttggaggaaaatgtcaatacaaggatatcaattatcaattattaggttactatattggttcaaggagagatgatggtggctgtggagatgagtgaaatcaacagatccaagatatattttagagagtattgtagaagactaggaatgggagtgaccagacaggaatgaagacttctagacttactgcacactgtcatgaggaaggatggggatggaagggtacagtggaataagctgggttttagcagaaggaatcaagagccccattacaaacacattaaatggcctggcgtggtggctcacgcctgtactcccagcactttgggaggctgaggcaggcggatcacctgaggtcaggagtttgagaccagcctgaccaacattgagaaaccttgtctctactaaaaatacaaaactagctgagcgtggtggcaggtgcctgtaatcccagctactggggaggctgaggtgggagaatcgcttggaccctggaggtggaagttgcagtgagctgaggtcgcgccactgcactacagcctgggcaacaagaacaaaactccatctcaaaaaataaaaaataaataaaaataaacacattaaacgtttataatgtatttacaagactaacaatcagataaagtctgaacttcagaaaggagatagagctgacctgaaaatataaattacgaactattgttatatgaatgttacttaaaagacgaggaggccaggtgtggtggctcatgcctgtaatcccagcactttgggaggccgaggcaggtggatcacttgaggtcaggagttcaagaccagcctggccaacatggcgaaaccccacctctaccaaaaaaaaaatacaaaaattaatcgagcacggtggcatgcacctgtcagcccagctactcaggaggctgaggcaggagaatcacttcaatctggaaggcggaagctgcagtgagctaaggtggtgccactgcactccagcctgggcaacagagtgagactcggtctccaaaaaaaaaagggcagaagatggggcggaagaatagagataggaaagaggaggatgttgagaactaaaccctgaggtacttttagtattcaaagtgtaggggggtctggaaatcttgtagagaccagtaggggttggagtatgacatcttccaataatgaattctcgttgctgtccccttatgggtctgggtctacctgatagtctcttctggaagtcggtatcacttgtgcttaatttctactcttttgtgccctctatacagcctctactacaaatcttttttgaagaagcacagggagaaataacttggggaaaaaaaaaagcctatcttttagaaatagattctgaaatatttacagatgaaataatatgttgtacagaattggcttcaaaatagtccaagtaaggggtggtctagataaaaaaaaaaagaacagctctgagtagatgcctgttacagttgggcaatgcacacatgggaaggttcactgcactggtctctctgaatatttcacaataaaacataaaacatagtatggaaggttggcaaacacaagtccatgagaaatctctccatcttacccagattaacgagagatacaaccaaggatccacaggtttgatgcagacattctaaaagattcaattataccaagactttaaaggtgacagatttttttcccctcaactatacatttttttttttttttttttgagacagagtctcaactctgttgcccagactggagtacggagccataatcatggctcatttcagccttgactttactggctcaagcgagcctcccaagtagctgggactacaggcatgccccaccatgcctggcttttttttttttttttttttttttttggtagcgacaggggcctgctatgttgcccaggctggtctcaacctcctgggctcaagcctcagcctcccaaaagtgctggattataggtgtgagccactgcacctggcctatattgctatcttaaaatgtctcagtgacccaacaatttgccaaagagcatgtagagcaaactaggctctattcagcatttccatttcttaatgtatctatttgatttcaataaaatttcatcattttgaagatctctcccattagcttgggaaactacagaaacatgcacataactactgagaaggtatcaagtgttcctacactagtttaaaaaaatcattcaacacccacataaattctgatatgcactaggctgaacagctgttaaccactgagaagctgggcactgcatcctctccctgggtcaaaactctatatgctaatcaaacagggtcatgtatttgggaaaataataatccatggtaaaagtcacaaaaagaccttaattttaaaatgagaattcctaatctatacattctttaaaaaatctagggtatataggttgatgtaccttccttgatcaaaactcttacttctctgaagcctgtcagagtattttcaccacaaggcttggattaggtttcattttacatatgcatgcacatgttcacatacccataatcatccttcttagtagtatatagagacggaccatatcgttaccctcttctgctcaaataaatgtcttcccctacaaatgctaaggagtaaaatgatccagaaaaagtagaaatttggcataatcagcactgacttcctcaacggtaacatacatgacataaacacattaggtagactggatgcccaaaggccaatccaacctcatgtcttcctggcatttctcaggcctttctcgtcacccaccccacctaggttccacgtttccaaaaaagttccatgaagattcaggaaaaaacaaaaagggaggaaaactcattttattaaatttacatcatatccttcttcccagggttcaaaattaaataaaaccaaaagaagaaaaccagaaagacaaaagcacttttgtccaaggtggcaaaacacaagagcaatttaactgccattatgaaccaacttatactaaaatagtatttcctggaatgtgtataaattaaaaaacaaaacaaaatgttcatggttacttttactttcagggttgggaactgaatcccacaaacagcagctaaacctcaaaaaaattgtaattccctaattatttccagattaaaacacttctcttgaacacatgtttctgctgttctttggggtgagtgtagggcacagctggagtacagtataacacagaaacagcaagtgcactaagagcatcaaatccttccccccaaaattgtttatctcttccagactcctattcacacttattcccctgacttaattttaattctgcctcttggccctcttaccttgtccctttctaccctactcacttattctctattcatcctcattctctgaaatgatagtcaaaataatacttcatgctaaagcattttcttaaatatttccagatattccaacttgttatgatctcccacttctttaaaccagaagctattactacttttagagtgcatacctatttctgccccatatttatcacatacaacttacgtatgatttagttagcatcctcaaacttagaaaatgattctcgcagcccagcaaaaatccttactatagcagccaatcaatatctattgaaaaatacatgtaccccctcgatacaattgtcataaaagttttcagtgtgcacttaatttgataatgtcacttccatctttctgttttgaaaactgtttcgccgggcgcggtagctcatgcctgtaatcccagcactttgggaggccaaggcaggctgatcacaaggtcaggagatcgagatcatggtgaaaccccgtctctactaaaaaaaaatacaaaaaattggccaggcgtggtggcgggcgcctgtagtcccagctactcaggaggctgaggcaggagaatggcgtgaacccaggaggtggagcttgcagtgagccaaaatcacgccactgcactcaggtctgggcgacacagcgagactctgtctcaaaaaaaaaaaaaaaagaaaattgtttcataagaatgactcatccttcaaaggaaaaattcagatgaaaaggtgtctgcactatgtagtgtgttaaaatttgttctcaagcctctccagctaccctcaggagtgaacagtggcaaactgcagcttaggctagtgaagtgatctgccctacaccatcaagttagccaagaatagaagccacatttcctgactcctgccttgactcctgatctctttccacacatgcaaatacaagttcagcatcccaaacccaagatccaaaaagttcccaaaataggaaactttctgagtgtcaacatgacactcaaaggtaatgtttattgaagcattttgggtttccagatttgggatgttcaactggtaagtacagctgaccctctgtattcatggattcaatcaatcaaacagcaaaaatatttaaaaaacaatgtctgtactgaatatgtacagactttttcttctcattattccctaagcaatacagtgtaacaactatttacatagcatttacactgtattaggtgttataagtaatctagagatgacaaagcatacaggaggatgtgcataggttatacacaaatactatcccatcttatatcagggatttgagcactgtcagatttggtatccacggaagttcgtggaacaagtcatccaagaatactgaaggataactgtataatgcaaagattccaaaatccaaaacacctctggtcccaaacatttcacatcagagagactccacctgtaatggctttcagttctgtaaatcaacagcacatctagttgtgtgaatacatacgtggctaaggttcaaagtactttaaaagtattaagtccaagacaaagatgagatagtattcctcacctgatccaagggtcacacctgacagtaagaactggagtcaaaggatcatcactgtaacccatcaacataggtacagttcacaatattaggagaagtcatgaagtaacatacatacaggacacacataaatttcacctctaaccaggaatcctgtgatagaattcattaaacctattctcactcaactacccccagtggcttatgaatcaatcctaaaggcatcagacacaagactattaccattacaaatttctaatctgctaagaagtcttgagttttaaggaagaaactagtgccaattcattaaaaaggaaggcagaaaaatggaaaaccagaagtctttcattgctgctctatccccataatctaaaacaatacctaggacatcacaggaaaccaatgtctatttactaatgtctatttacctcttagcctttattaaagtgaactcatagtattgacattattttctcatcctcacagggcatttgaccacattttggaaccaagtttaaaatctttcataggccaaaaaaaaaaaaaaagtatataatgactaacatgctttaaataccatgacaaatataattaaatacttgctctcactgaattcaaaatttttagttccctcaaggtgaagttactcattttccattatttctctctaacatcaatttctccaccagatttcctccacctgtgccactactcacccatctaaatgtgcacatgtgtactcaagcattcaatgaattgcttattatgtactactcagcacgaagaagcagaggaaacccagcctttggagtgatatgaacctgactctacttcttgttttaaccaattactaagccttgtgacctcgggaagtcaatcattatgtctagtactcctgttgcctaactgtaaaaatgtgaaggattattacgtacataaaagcataataccaaaaataggcactaactgattgttagtttccgtccctctcctacaacagcaccctgactttggaaactaaccctccacgaactgaaagcattctcagaatatactgtccttaaaaaaagaggaaggaatgaagggaaagaaaagaaaagaaaaaggagagagggaagggaaaaggcaaaaatttttaaaaatacttttggtcctggtttacaggccaccacaataattcaagtaaattagcataatccagagagacaaaaactttttctattttttactacaccaaaaaagctcataataaaatttcaaagtattaaaaaataaatgaaagtaatcccttcccttcctccatcccaacccatcccatccctcagaaataatcactgttagcactctggtgtgcacatatacacatacacatacatacatatatatttttgttgccaaaattttactgcagatatctggaaaataaagagtagcataaagaagaaaaatatgtaatctatacaaccggaaaaaattttaagctgcaaataagtttccacaactaaatttacattgtaaaacacatgatggggaaaaaaaggtctttacaataaatatggtacaaggacaactgaatatccactatccacaggcaaaataaaattggattcctacctcacaccatacagaaaactaacttaaagtcgatcaaagccctacttaaatgtaagcattgaaactcctggaaaaaagcataggagtaaattcttcatgaacttgggttaggcaatgatttcttatgctgtgacacaaaaagcaaaagaaacaaaaaaaaaacataaattggactatatcaaaatttaaaacttctgtaaataataatcaagaaaatgagaatacaatccacagaatggaagaaaatatctgaaaatcatctatttgacaagacactggtctccagaatatatacaaaaaacacaattcaacaatttttaaaaaccaaataactttagaaatgagcaaaggatctccaaagaagatatacaaatgaccaattaagcacctgaaacgattatcagcatcattagccattagagaaattaaaatcaaaaccacaatgagataccacttcacattgactagcatggctataattaaaaagacaattagaagcattggcaagaatgtggagagaatggaacccacaaatatcgctcatggtaatacaaaatggtaatataaaatggaaaacaggcagttcctcaaaaagttatacacagggctactttatgtgttaaatgctgaggatgcataaaggatcagaaattcagataaagcattcccagaacagtgattgatcctgtttgtttaaaaaaaaaaaaagacaatgtactcaacaattaactaaagtacttgtatttctctttacaaaactaagttatgtaagaactaaacattttaaattgaaaattgtttatctggttctttgaactgaaaatccttttatattcccacctgtgagtgtacacaacaaggtgaagcaaatgcattaaacccagtaggtctcaggacaggaagcatttacactcagaggctatcccacagagcaaaatccacactgaagactaaatcatttcacagaaccctagatttagataaacttggagacaggagagcagctgaagagcccttctctttcctcaaggttgtctacacatctaaatcaacttcactgggggagcataggggctgcttaagggtctaagacaaataaattcttctatgcaatactttacatttatttacaaacggtctatcttacactaagctcaaaatattccactgagctactgcagaaaatctgggtgcgaaataagaaaagacaatcagagagtgtatactcataaaaggaattaaaaagaacaaaatgcccaagaatacagtatcctcacaaaaaataccctaaatgaatctagtaaaaatttggcaacccatattctggaaagatattctttacaagttaacctgtatgtcttatgcaacttccaaagtcccaaagaaagtaatacaaaattaagtggttttgagatactagtcagctttttcggaaagagggttagagaggacttacttccttgtattatgaaacaaaaaacgctctgatgaattaaaagggtagtttctttctttatttctctttttttcagacaagtctcactctgcgtgcccaggctggagtgcagtggcatgaccttggctcactgcaacctccacctaccaggttcaagcgattctccagcctcagcctcccgagcagctgggattacaggtgtgtgccatcacacctggctaatttttttgtattttagtagagccaaggtttcactatattggtaaaagggtagtttccaaaaataaaaacatgtacaaggaaatttaaaattctcctattagtgtctggaaggatgaagaatttctactattttaggttgagaaagaaagctaaaggcaaaagatcaacagacaaaaatttaaacaatttataatttctaacttatccaagtttgactccaatatttttaccaaaggataaatatctctgcttcaaagaatcataaaaacattacaacagcctggcacagtggctcatgcctgtaatcacagcactttgggaggccaaggcaggaggactgcttgagtccaggagtttgagaccagcctgggcaacagagcaaaaccccatctctacaaagaaaaaaaaattttttaataaggggggcataagggtgcactcctgtggtcccagctacttgtgaggaccacttgagtcctggaggttgaagctgcagcaagctacgactatgccactgcactctagcctgggcaacagagcaagactgcagactgtatcaaaacaaaacaaaacaaaacattacaacatatgagaatgttcaacttcactaatactttcccaatgcaaatttaagtaaagatagtattttttatttatcagtttagcaaatatttttaaaggatcctccatgctaattggagtgtggttaaacaaaaaacctgcttgttacactgctggtatgactacaactgggaaccttttggaaagcaacctaacaagatatatctgtagtcttctgaattgttcacactctcttttattcttagattcatacaatataaataaatacaaaaagcaaagcctatgtgcacaaacagcaagcatcagaaagtccatgaaaagaatagtacaagtatatagtaaaggaattaacttatactttgcttttcaaactatgttcaatccaatagatttctaaatatggcaagtttctaaaaatccaactccttaagtacactgtaaagacatttatgcacacagctaaaatatactcaaactaagaagtcctcaaaggccgtaagatacactaaaaatataatacctcccagtgaaataaagggaaaagcagaagtcaggtgagaatatttacatatatgtacccattcagcagttctgtagaagtcattatcttctttgggaggccgaggcaggtggatcacctgaagtcaggagttcaagaccagcctggccaacatggtgaaaccccgtctctactaaatacaccaaaattagccaggtgtggtggcaggcgcctataatcccagctactcagaaagctgaggcaggaaaatcgcttgaacccgcgagacagaggttgcagtgagctgagatcacgccattgtgctccagcctgggcaacaagagcaaaacttcgtctcaaaaaataaataaataaataaataaaaaggccgggcacagtggctcacgcctgtaatcccagcactttgggaggccgagacgggtagatcacgaggtcaggagattgaggccatcctggttaacacggtgaaaccctgtctctagtaaaaatacaaaaaattagccgggcgttgtggcgggcgcctgtagtcccagctactcaggaggctgaggcaggagaatggcgtgaacccaggaggcagagcttgcagtgagccgagatcacgccactgccctccagcctgggcgacagagcgagactccatctcaaaaaaaaaaaaaaaaaaaaaaaaagaagttgttatcttcccagtagaagagatgagaaaatttgaggtccagattggttgagtgatatccgaggaccacagagctagtaaaattatggagctagaacttgaagtctgattccaaatcacatgtttcctatgctaccccaaacaaagggagtattttctacagtggcattacaacagaccaagtaacagcagaggtaaaacaagtttcacatgtctgtggctctttgttttttacaagtttttattactttgtcatgggggggaaaacgaaaaattataattaggtcaaggaaagatataactatactactactatcattctgaaggaagggaaggtataccttctaagtcctgcatagtttaaaaattcccattacttgcgagaccaggtgagactgcacagttctagacttcctatcgtgtgccaaaactctagggataatcaaaaaatgtttgttgaatgaacgctaatttaaaatagaaaaagaaattccagatttcctcctcagtacaagaggcctgcaacaacaaacttctgaaataccagcagtctactaattgcatattcaaatttaaaccacagaaagttgaatcaactctgccaatttctgggactctctaaatgaactcttaatacaaaaatacatactcaggctcagcattttttctaatcatttacaaaagtaaaaggacgtcaggacaagttctggtgaaattttataaacagccatgaattgcagctgtagactgccagatacataacctgtatatgacagggggtaccacgtggaaattagagacatcccccttcaccaaaaagattatatccaggggatactacataataaaaaaaaaatctgaaaaatgtaatgggattaagatcctttagaataggctagtagtgatgattttgctttttcagtcccctcctcacaaacaaatgatgatgacactgcccttagctttctatgtgcaaagacagtattaaccttcccaggccaaacttacgactacaccttttccacacgaaatgcaaggcatttctaactccccagattacctcacattcgttggatgccacacaatagattataaagtatcaagatatatattaatttttaaaagttcaccaggagttggatattctaaactgggtttctgattcttaacagtgagaatgaagtcaagctccttatttggtggttagaggagaggatttggccagaaataattcttttaggattgacagacaagtactacttaagttctatcatctcatccaaaaacttgcttcttatattctgcttttaacccgatctacacaatgaaaagccacggagactagttttgcatgaaagcaaaggacttttctaatatgacttcagagcatgccatgctttaaagtccatgttcaaccacttactatcattttccaactcactctctatgggcccatcccatatttcaactacaggtatacctcctggccctttctatttcataagcttctttggaagacaaatctactgatttatgcaataaactttctacctctacttaaccaatttgataatttaatagctggagataattctaaattccccaaaccttaatcaagaattttggaaaaaaagagctatctagaacagttatcttcctgaaaacactgttgtgctaaactgaaacacagccttttctcaagagctaagcagctacttgggtctacattttaatgcactaaataattttataagatcatgtttgaaaccaaaaaacccaaaaaggattgtcaagctaggtcagcttacaaaaccccttctgttatgaactaggaaatcaaacaacaaaacataagctctaggaaatgagcatggaggtgctccatccatactagcttttccttgtttttttcttgagaggagtgactctctgtcacccaggctggagtgtagtgatgcaatcctggttcactccaacctccacctcctgagttcaagggattctcctgcctcagcctcccgagtagctgggattacaggcgtcgaccatgacactcagctattttttgtatttttagtagagacagggtttcaccatgttggctaggctggtctcaaattcctgacctcaagtgatcctcccaccttggccccctcaaagtgctgggattacaggtgtgagccaccgtgccagcccatactagcttttctgaagcctctttactcattcttttgttctctactctagcagctaaagacatctcctaaagaaacaactagtgtgcctccatacaacccctcagtaagcactcagtattgagactaaactgtgaaaagcactaaaataaatgcatcattcatctatgaccttctgagaataccaccacctcatatttgaatagacgtctagttttcatgagaactttcacgcactcatttgatcctctttaaaaaccacaggaaacagggcaagccatcttatcagctctatttacagagagggaaatcaatttgaaaaggttacatagcttaatcaaggtcacaaagtgactgactggccaagctggtactcagtcttatgatagtccagggctctttcctctacactgatcctaaattgaaaaaaaaaattttttttggactgctcctgcaaggtagggctaccccataggcagagagtagctgaaaaattctgtatgtgtctatcacaagaagttgaggccgggcgcggtggctcacgcctgtaatcccagcactttgggaggccgaagccggcggatcacgaggtcaggagatcgagaccatcccagctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaagaagttgacaggcctaaaaggtttcacatttagatgtttctttttttggaaaaggtgaagatctggctgggcacagtggtgcacatccttaggtagttccagctacacaggaggctgaggcagaagaactgcttgagcccagcctgagcaacacagtgagactccatcactaaaaataagtaaataaataaatcacataaaaaataaaaaattttaaaagggggtaaagagccaatgaattgactaagaaatgtgttgtttcaaatcagaatgaccttgaaaagccatagtacttgcatgcaaaaatatgatccgatttaaaaagtcaatatgcttaaaatacaacagaaaaatcaaccaatatatgtatttcgtattactggtttaaaatttctgaatatgctgtaaagagaaggaggtgaaaaacgtcaaccagactggggtggtggctcatgcctgtaaacccagcactttggaaggccaaggtgggtggatcacttgagttcaggagttcacgaccagtgtgggcaaggtggcaagatcctgtctctacaaaaaatacaaaaattagccagatgtggtagcatgcgcctgtagtgccagctactcgggaggctgagatagaagaattgcttgagactaggaggcagagggtgtagtgggcagagatcataccactaacccctccagcctgggtgacagagtgagactctttaaaaaaaaaaaaaaaaaaaaaaaagagagcgagagagaaagaggcagagagagagagaaagatctcaactgataagatactacataatcacattatctcttgcttgaccaacttaacaaatatttcaaaatgtttataaaaatcaaaatgggtcagcattggaagaagttgtaagtaaaattcaggtgttctccacatgaggcaactgctgttaatagaagactatatgacggtattttctcgaagtttggtacaaagatcaaaaatagaatcacaggcaaaacccttgaaaggcttaggaatctgaatttttaagtactaggttgttgatgaatataaaatttaaagatgtgtatttagggtagaaataaccttgaccttggtagctgtggaacttgtgtggttactcgttctgggccctggttttcccaatggtaaaacagaggaggtagggacacaaacgtcctacttcatagaaaagttataagactttaaaggcgatggtttataaaaagtaattagcacacagttttgacacacactaaataataattagctactatggtggaaattttatttctatttaacacttctgacattagcaaatagtgtaccaaacagacatgctttttacatagttacatgattcttctcaacaaccgctcccccgaaagaaagcagtttttaagagggtcactctcatgatttgaagagaactgggagaggaggaacataaatcagttctgtcacattttaaggattagaatttaaacattaaaaacaattttaatatgttcacatatataactatcacctggttggaccatgacaaaaacccacccctaaccataaacaagggtaacctatcatttatcaaaaacaggaaacgttcctatctctcaagatcagcgctctgaactaattatttaacataaggtcatttttacgagttcacatgctgaatggcttacaattaaaagcctcttctaacccaaatcaccatcctccttcacttacctttttttttttttgagatgggagtctccctctgtcgcccaggctgaagtatagtggcacaatctcagatcactgcaacctctacctcctgggttcaattgattctcctgcctcagcctcctgaacagctgggtacaagcacccaccatgccttgctaatttttttttgtatttttagtagcgacagggtttaaccatgttggccaggctggtctggaacgcctgatctcaagtaatctgcccacctcggtttcccaaagtgctgggattacaagcatgaaccaccgtacctggcctgttgcttacacttaaaaaaaaaaaaaaaaattcctcccctctccctagactcctaacctaatcaagttaccaaattcaaaaaattattttatctcacccattcttgcctctttttttcttttttttttttttttgagacggagtctcgctctatcgcccaggctggagtgcagtggcatgatcttggctcactgcaagctccacctcccgggttcacgccattctcctgcctcagcctcccaagtagctgggactacaggcgcccaccactgcgcccagctgattttttgtatttttagtagagacggtgtttcacgtgttagccaggatggtctcgatctcctgaccttgtgatccgcccgtctcggcctcccaaagtgctgggattacaggcgtaagccactgcgcccagcctgcctctttttttctactagggctatcacaattctggccttcatttcatttgacaggaaggcatgggtttataccctaaccagaacaacaatgaacaggatttctgcctccactcctctaatccaggggttggcaaactttttctgtaaagggccagatggcaaatatttaggctttgcaggccacacagtctccgtctcaactacacaactcttgccattatagtactaaagcagccacagacaatattcaagtgaatgagtatgactgtgttccaataaaactttacttacaaaaacttgccttagactgcatttggcatacagggcatagtctgttgattgtgctaatccaaccaactaatatcaactttcctaaattccatcacagatcatgtgatttctgatttaaaagtcactttccttggctgggcacggtggctcacgcctgtaatgccagcactttgggaggccatggcgggtggatcacgaggtcaggagatcgagaccatcctggctagtagtagagatgatgaaaccccgtctctactaaaaatacaaaaaaaaaaaaaattagccgggtgtggtggcgggcgcctgtaatcccagctactcgggaggctgaggcaggagaatggtgtgaacccaggaggtggagcttgcagtgagctgagatcgcaccactgcaccccagcctgggcaacagtgcgagactccatctcaaaaataaataaataaataaaaaataaaagtcactttccttaccaaaaaaaaaaaaaaaatagaacttaacattccttggcctgatactcaaaggcttcctccatgagtataatcttcattaaccttggtcatttcctttttctcatactagattccaaattgtattccatgattgtggctgcttatactgctctaattccaaacctttgctcaatttgtatacagaatgtcctttcttctttccctctaaacacctacatctcccttgcttcccacactaccacctagaactaaaatccatctatcctctaagaagtctccttccctttacccagaaattcttcttcagcagaacttctatggcacttaatctgtatcttttctgacaatgattgctttgtatcttttaccacagtgaattatatcttagatcccctaagcctgtgggcagaatttatttacaagtcatctctgtatttcccacagcactttacaatcaagagataaaaaaacaggtattattgtttcaaagaaaatattcctacaactaaattcctttacataacatagcactgttaataagaccaagacacacttattctgtattaaaatgttacctaaaaactaatgacactggctcaacaaattaagccttcaaaaattagtctccatcttattacccagagggcagcatggcaaagtgggaaaaggaaaaaaggacaagattgacatcctgattctgccattgttgttaaatttctgcttccttatcttgtgaaacagatgttaccactgcctacctgggaaaactaggaataacgactacagtaaattattatgcattatggcttttataaacagaaatttaagaacagctaagttaactgcaagatccctattctgtcaaaaaaaaaaaaaaaaaacacgagtatcttgtgttcagcattatgaatataaagaataaagacatgagcagtctcataacatagacaagttcagtctactgtagatcctttcacagagaagtaatacaacatactgagtgctaaccttccagctatttctaaaaagatggaagtccaaggttatttctaaattattttaagcataaagctaaatatttaagaatgagttataactgagtttctaccaaattaaaacaacgatgcttacaacagcttacagggctcctgatctcaccttctaccactcattctatacctggatcagcatgcatgctcctgccaccccgggcttactgatgaaaatccaacaaaccgggctcagtcccatcttagggcctttgcaagtgttctctacaccttgaatgctcttcctcaagatcttcacaggtcttgctcacacacttcatacagatctcattcaaactgtcacctcctcagagaggctttccctgaccaccctattaatatagacatctctctcccataaccatcactttcaatctccttaggctctttcctttttatatctctttatagcacttgttaactagccttcggtcattatttacttatctgtcttccctagtaggataaaactccctgaaaactgtaatatcttattggctgctgtactccttgtaactaaaatcatgcctggaacacactgagtacttgatacatattaatttttaaattgatgaataacatttgtgagtgacgaggaatattcatcattgcaacttacataatttcttaaaccagctgcttacaattaaatctagcatgttgaggctactcctagaacaggggttcttaatttggggctttagggaatcattaatacccatgtttctggaaggaaaatctacagcttttctttaaatggtccctaatctgaaaaacatcctagaccagtgatttatgactctggctacatcatggaatctcctggtgaattttaaacatacagatgcttggatcccatcccagagggtgtattttttctcatctgtggtacaaccacaggacttctaaaaaattacccaggtgattctagtgtatagcaaaagttgagaaccatgcaatttgaacacaacaaatgttaactgggtgagagtcctcaaaggtacttacagtgggaagaaaacaaaaattgaaaactatgaattttgagggaattggcattgctggcaaacagatcaatacacaagttcctgaataattctgtatcataaaaacattttaaacaaaaactagtagctctacctccacttaaatactaacctgacattgagattctagagcttactcccagaacacaaataacacctttcacttaaaacaacgtatttcagacaaacattcacttcttaataacttacttataaaaacctaaaactatcaagaaaacaacagaatactttttgaagacgaatcagctatattacaactatgaagctctttgtagttttattcctaaaaatgcctttgaagcaacacatttccaccaattaatgtcctcatttagcctcaactgttacacaggatgacaggccctgaatttaggtgaaactaatactgacaatagacacaaaggggggggggggatttcagagatttatttagatcatgtcaaaagggtttgaaaagagcaggtgtcagactgacacaggtggtaaattgttttctttttgaagtcaaacaagcaaacattgagtaataagcgaattcactgataccaaccgagggtttcataagttactggtttttataccttcatccaagtagcccttttaaaaaagggattagcaagatagagagcaaaacaacaaaatgttaagtatttgtaaaataaataaatccagatgcttaaatccacagtgataaataattttaaattattcctggatacttagaatcacgatgaaactcattccatctatccctttctttctttattcttggctgtatggagatacctgctgacacagaagcaccaggtcatgagcacatctgacataaaacattacaaacttaaagcagtattttttaaaatctaaagggcttagggaagacagccatgctcctagctatgaagcctctgtggcttgacttcctggtcatatcacaaggatttttttttaaagtattattcagttcccttgttgagtaagttaatttactaggaaagtgcaaacaaagacatacatgcaggtacgcagctcatcaacgcattttagttgtggggaaagatcaggcttaggagacacgaataattataaaactattagagctggaagagccctctttaaatttcccttctagaaagatgggcacaaggaaatccttagctttctatgtcgttttactcggtaaaatagtacactcttattagtaactttatcttttatcaaaagcctgtggaaataaatgttctgggattaactagtaaatatataaataaagccacagaaacatattcccaaaatgtgggctggaaatgaaaacagaacagcatgggatacaaaaccccactggctgtttacaaaatgtttcgtgtacatgacttttatgtaataggaacagaacactagtataggaaatgaagactacatggaagggctggctacttggaggtgacggagttaaagatttcatgaaccatcaaaagaccaggtcatttatacactagattatcaaaccagaaaaagtctgagtcccctcattccattacatttgaagaaatgagaagcaccaaaaaaataaagtatcaatacaaagaagagagagaaactaagacaatctgaccctgaaggaatcgcaatgtggagggaaaacccagccctaggagttaattgtctaagtcaggtaagaaaagagtgaaaaagttgaacagcacaacagactatttcatgaacaccagatgcctcgatatgtaagggctttaaataaagagaaaacactctcctcatgagctgctgcttcagtgcctagttcttcactcaactatacccccctctaaatcagatgcagcattttgaaatcgacctcactcccttaaccacacttaatttttggagtagaggttaatgaacacaccaggataaaacgatgtctagtttggcaggagtgggagtacaaaagtaaggggaaaaagacaagaaagaacaaagcactggttcgcacacctctctccaccccagttaagctgtggaaagctgactggcatatccacatgcttaaattatacgttactggcaatgagggaagtggggaaatgctaacattctgatttgtcccttgacaaatgagggaggatattcccccctcagggttgcactttaagaatttctacttgcaatgctcactgcagcctcgacctcccaggctcaagtgatcctcccatctcagcttcccgagtagctgggactacaggtgtgaaccacaacatctagctcatttcttgtggtttattgtacagatgggcgtcaccacgttgcccaggctggtctcgaactccttgagctcaagtgatccccctgcctcagcatcccaaagcactgggattacaggcctaagccaccgtgcccgggctctcaccacaattataaaaagagagagaatgaagggaagggtagaatttcctctttaaaagtggtctgactcaccaaaccatcttcactgcaaagccttaaacagtaccagaatacaggaaaaggatattgtatgcttttcttagagctgggacaaagaaatgagagggtgtggtggggggaaggagtaaacaatcagagcataagtaacccatattatacatggtttatatgatgccatctccaggtttaatctttcccttttattattttatgattattttaatggagatggggtcttgctatgttgaccacactggcctcaaagtcctggcctcctaaagtactgggattacaaggtataagccaccacgagcagcctaatctctcaattttagtttccttaccataaaacagacacaatgcttactatacaattaaaatatgctataaaatagtaagtgaaataactatactaaaaggcattcctggcattcagaaaagttgatggtagcatcctttccccctcaaagataggtacaggaggccctaatccaatagttctcagccagggatttttttttttttttttttttttttgagatggagtcttgctctattgcccaggctgtagtgttgccatctcggctcacagcaacctccacctcccgggttcaagcgattctcctgcctcaacttcccaagtagctgggactacaggcgtgtgcgaccatgcccagctaatttttctatttttagtagagacaggatttcgccatgttggccaggctggtctcgaactcccggcctcaaatgattcgcccacctcggcctcccaaagtgctgagattacaggtgtgaaccgctgctcccagccttggggattattttgaccttaccccaacccccaaaagggcacatataataaagtctggaaaaattttgttgtctcaactagggtgagggaaggtcctactggcatttagggggtagaggccagagacgccatcaggcattcttacagtgcacagaatagcttcccatgacaaataattattagtcccaaaaggttaatggtgcctctgttaagaaaacctgcctaaaaaacattcatttttggaaaaaccacataaacacagaagaggagcataacactctagttcctacagtctattaaaaaaaaaaactatttaaaagatattacaggctaagtgcagtggctcacacctataataccaacactttgggaggctgacacaggaggattacttaagcccaggagtcttcggctgtagtaagctatgatcacgccactgcaccccaacctgggtgatagagtgaaaccctatctctcaaaagaaaacatactctaagaacaatcctttcttgtgatagctattactcaaatgacaaaagctgggggaaataccttgtaaatatcagaaaaaaacttctcctcctaagtagtttaaaaatatgcagataggcgggcacagtggctcacacttgtaatcccaacacttttgggaggccaaggtgggcggatcacctgaggtcaaaagttcaagaccagcctgaccaacatggtgaaaccccatctctactagaaatacaaaattagccgggcatggtagttcatgcctgtaatcccagccacttggaaggctgaggcaagagaatcccttgaacccaggaggcagaggttgcagtgagccgagatggcaccactgtactccagcctgggcgacagaccgagattctgtctcaaaaaaacattaacaaagaatactccagatcatccagaaagtcagtatctgatagtgtttatatggagaactcctgcactggaatgtaaactcctaaccctagatccatctcttctcaggtcttcctatcacctcagcctacagcagtcaatccttccctctaaccactccctcctcctaagatttcagcatttaatgcctgtaccatgtatctaatacttagtacacaatgcctaattcttgttttttaatttttatttaaaatactaaaacgaaacagagacggggtctcgctatgatgcctattctggtctagaactcccgggctcaagggatcctcccaaggaactcggcccacaatgtctaattctaatgcttcctcttttacttgaaagtggaggggaaggctgggagcagtggctcacacctgaaatcccagctactcaggaggctgaggcaggagaatcgcttgaaccagggaggtggaggttgcactgagctgagatcacaccactgtacgccagcctgggtgacagagtgagactctatctccaaaaaaaaaaaaaaaaatcagtcacataaattactcattgaagacaggaaccaagttttcaattcttcttaagtgttttcatcattcctgatctaaccaccagagaagtgtttccttgccctttggtggcaaggttaatcttggtgataaatgatcctgaaaggctagtctccaaataattagaaccttgaaaatgtttatatttttctctgctcggaaaattctggaaccccttttctaggactgccacaaggacacttctgactatcctcaatgatgacacattttagtttccattcagattaccaattatggtaactcccctgatcactgtttaagtactacttattaaaggaacaaacattaagctattgctcttggaaggccagcctgctaggaaacacccaagagcaattctgtaccttatccttccctaaattagtcagccaatcttaccattcaaggatgaaattaaaggcatttatctcatctagtaataccatcagtaaaccatggaagcttaaataatctaacattgctttggacattatggaaatgacaacctcagcacctaataaaatgtaaaaccaaatatatacatatcatgtcaatgtcttgaatgtacaattaccttgaaaatttcaaagtcacctcacatttctcaactcttggacctgagacctgcttactatcaagttatcattgagaacaaattaagaattctcaattgagaggtcacctgttgcactaagcaaaccgcctgcaaatactaaattagcttttctacttacactatcaagtcaaattacttctggtaatgcttgagtgtatttgcatgagatcaatttcatatacagttgggcagaagcaaaatgagtcttaagcaagcttcattctgttttcatcttacaaagaaaagactggcctgtcctcccagccttttgaataaggatcttgaaaaattcactacgcacagggtgtgcccaaagaatacttgctggaaaaatatgctgggagagtgccaatttaaaaagaaaaacattttcgcccagttggaaatctagagaaagaatagttgtagcaattcagctaaaaactctcaagacctgaagaaaattttagaaaaaccccagatctttttgttattggagtaaaattctatgaaaggcaactaaatgaatcaatgaagtattcaactatgctaattttatgcacctaaaaagcagtaactgaaattctgcctttgacatttgacggtgcaaaaagcactaagtaccttatttgttctacataaatgaactttataatctgcaatagtttttaaatcaactgtttctgggaaataatgaaagcattttattttcctttttaaaaaagcaagaataacaaaacttctttattgttttgctttttgggaggaggggttgggggaattgggataaatttttgttttccattagagacttttttttttttttttgagacagtctcgctcagtcgcccagctggagtgcggtggcacgatcgatctcggctcactgcaacatctgcctcccaggttcaagtgattcttgcacctcagccttccaagtagctgggattacgggcatgtgtcaccatgcccagccaatttttgtattttttgttttgtttgtttttgagactgagtctcgctctatcgcccaggctggagtgcagtggagcaatctcagctcactgtaacctccaccacctgggttcaagtgattctcctgcctcagcgtcccgagtagctgggattacaggtgcccgccaccacacccggttcatttttgtatttttagtagagacgaggtttcaccatgttggcaaggctggtctcaaactcctgacctcaagcgatctgcctgccttggcctcacaaagtgctgggattacaggcataagccaccacacccggccaagagacttatttctgaagcataacactccagcaatagcttgattaagctaaaaagatacccatctgttacaggcctttgtcttcagtctctcactacaacacccacccctttccaggtccactcagaaccttacgctcagatttttttttcactgcaataagtgaacacaacaaaaaattacagttactacagggacacactggtcccaggttgcctcatgagaaaagcaggtgagtaggcctgctggagctttgcactaactctatggaccctgtggaaactgcatgcaatgcaggctacatggagggtcaccgggctgctcactatacctcagcaaagcaaaaggcctgcctatgcctatgacaacagcctttcccatcacagcctggtcccaccacaaaacaacaagcaatattcttccaaaaagtacagtcctaattttaaaagtgaggaactcgagcctaggtagacaaaatgtaacaattcttaacagttgtccagaattctttctactctcttactccccttttagtactaataccacaaatgctaagaaaaataacctctagttcatccttcaagttttctggtacttgccaaatcaataaaaataacatgtgaaatgttaatcacaaaccacctactcagacactgaaatgacacaaatacagactaagtagatgaaaaccaatcaggatagtcctcaactattctttcaatatcctttcaagttctatggtaactagatttaccagcaagagttttcttgaggaaaatactaaacacaaagcacatgcttacaattcacctgtaagcacaagttaagaataatggagaaagaacataaaataccttcataactcaaaagagctccttttccagcaactggggaaatagttgtttggggcttttccacataagatataaatcatccctttcgaatgtcaaaaatgtttaatttagccatttgatggggaaaaacctttaatagttcacttctctagagtgtttattacagtaaaggaaaactatttaaacttcccaccatccctcctggtcaatgctggtgtccacccacgtactgtgtggtcagagagctgtctaaaggagttacagcaaacagcaaagctatgtgccttcaggttgctccatttctcaaaatagaatcttttttctgccctctctctatcagttccaggagttatcttctattcagaagatagaacatgtatgaccacaagcaaattatttaacatatctatagtcttgggtctcaactgtaaaacagggtatcatcatcatatggaagatttaaagacaacaaacctaaaccacctaacatacagaaaggtgtgatcaataaatactaattcctttcttttcttccttttttaaaaaaaataacttcaaccacttcctagatgttagtctgccctagcaaaatgtccctcctctacccatccaactttttttaagacaaggtctcactctgctgctcacgctggagtgcggtggtgcaatctcgactcactgcaacctctacctcccaggctcaaagcaatcctcctacctcagcctcccgtgtaagctgggactataggcgcatgccaccacgcctggctacttttttttgtagagaaggggtttcgccatgttacccaggctgctctagaactcctgggctcaagagatctgcccgccttggcctccccaagtgctggaattacaggagagaggcatcacgcccatataacccatccaacttctactccacaaaagaaaatgagtaattttcttttactcatattgtaggcttaaggatgtatctggttaagatacatatggccattatacctttcctcaaaaaatacgtattaccaaattaatgtataatagtcttctgaatataaacataaatgccattattttacatgatggttggtagacctcttttcatcaaccaaatctaatgaacaatttgattctgtttacactaaaaaagctagtgcttatgcccaggagataggtaaagagcctagattattatcttgatctcttattagctgtttgacattaagttacttaaactttccattctgcagtttgagtctgtaaaattaaaattatctatctcattgtactgttggaggattacataaattaatttgtaaaaagctctttataactaaagagctaaaaacaattcaacaaatgtgggctattatttctctaccagaatgtctcaactctgttgtctgcttaggcaaagttggttaaaaacgttgttcccagcagggcacagtggctcacacctgtaatcccagcactttgggaggccgaggtgggctgatcacgaggtcagcagatcgagaccatcctggctaacatgatgaaaccccacctctactaaaaaaaaaaaaaaaaaaaaaaaaaaatacaaaaaattagccgggtgtggtggcagacgcctgcagtcccagctacttgggaggctgaggcaggagaatggcgtgaacctggaagttggagcttgcagtgagcccaggtcatgccactgcactccagcctgggcgacagagcgagactctgtctcaaaaaaaaaaaaaccttgtttcctagctcacccaaatcagttcggtcaaaatcctcctgggttctcaggtttaagactaattcagtcccaaaggccctaaactctgccaccctgtttcttcccaggatacatctcttgtaagtacctgagaaacaaaccggaaatagcaattaaagggagagcaaggaaatggcactacatatacaagggtattcaattccctggcacatgccctctattcttttaggcctaagtaaaacaacttataagaacatgattttaaatgaactatgacacctctctctagttgccattccccaatctccccatttcccccgcccccaaaacaattttctctacaattcctcttacctgagttctgaatataatctacatgattactacaatgctactaaataggctgctagagcaaaccacaacattcacaatttaatagcaaattttcagtatattctgcttgcagagcagaccctacaactttcatcaggcttaaaataatttcaaagcaattttgtctaccatggtacaagaaacctttcttcacacttatagaaatataaaatcaaacaggacacagttgccacaaagccttaactaatgagaatcaaaactggtaagatttattcttatgtttactatatactaaacccccttggtttcaaatctatataaactcaatgttttctttacattggatatgtaagcataattttcccagatgcacaatagaaaattggagaaagataattcactggtaaacatgaaagggcatgaccttaggcatgaatttctacccagcttgcaaaataatctagtccactttggtccatgtttagggaggtggggaaatgaattaaagtaccatccatttataacagaatgtggacccatgctttcccttttctagttaaaactatttgttttatcacactgacagagcctaatcgggggctctacaaaggacactccaggtatacccaacaaaggaaaatatttaaataaaaattaatgaatgcctacctcatctgctccttctccatcttgacatatccatccaatgtagttacccctgccaaacaaaaatctgggaatcacccatggcacctcttcccttttgctcaccacatgcaatcagccacaagccctcatcacccctacttccaataaccaattctcttaaatctttcctgccaaaggctgagtccaccattcagctaactggttagcctaaattcacctctattccccttctccacacaagcggggtctgaaaaatacaaatcatgtaagccatgtcaatggcttcacaataaaaattttaactttatataatcaacaaggccatctgtatgatctggcaactagctacctctctggtctcatttctcactacttgtaaaatacactatactttgctctgttctttgagagtcaagcaccttccatttccaggaccttagcatgtcttgtttcctcaatgagcagcaaagccccttctcacccaccaattccttcttatccttcaggtctcagcttacatgtcacttccttcagaagactcaccatcacatccccatcacatgctgcctagatatatccaatatgcaccctcagatcactctgaactttgttcctgtagcacccacaacaatcataaatatatcatctatgtaattacccgcttaaatattaatctctctctaatctatattccccatgagggcaagacaaggattgtatctttcttaaccactggatccctagcatcccagcatgtagcaggcattcaatgtagagttaatgaatgaattaatcaaatccaaactcctccaatgaaggttttcaggtctctacagagcaactcctcccccatttatagaagattatttggaagcttatttcctcactgttttttattttttcagacacagggtctcactttgtcgcccatgctggagtttagtggcacaatcatagcttacccaagccttgaactcctaggctcaacccatcttcctgtctcaacttcctgagagctgggattacaggctcaagctactgcacccagccatttcctcatttttaacacttgctggaacttgtaaggaatacagaaaccttcatttttaagactctagtaaagaacctggactctcatgagctcttaagattattttgcaaactgagtactgaaatgcttctggtaaccatctattgctgtagtcagccaggcttaaaacttcaatcacctatgatgatccctcccgtcattgcccccacacatcacagttattaagtcccattcaatttacctctacatcatttctggaattatctctttttcttctcacattacatttaccatctgtacctataatactatgtcttcaacatatcccattcccatggtgccaccaaagccctatacctttcaacttgtcttctctgtgtgccctgtgctttctgcctatactgacctctcagtaggtcacaatcaaaagaaaactgtctatcaaaatctttgccaaccttcaaggttcatttctaacatcactaagtgccaggcactgttctaaacattcatctttgtcttactaagttcttcactcccttcactctttaaacttcttgaggatacaaacttagcttattcatctgttatctcttgtgtcttacacatttacttactccataagtacttattatatgactttaacactaccataaaagagtacgttcacttcagagaacaaaaacaacaatcacaaggtggcagaaaacactatagcaactatatctacggtaaatgggtaacacccaaattcctgatgcctaagttcctttcttcagaatcccacaacaagcactaagaatgattttcactacctacgtttcttctcaggaaaaaaatgagaagagaatagaagaaaaaaacacaagttcctacttctgccacttgacgtcatgtgcagattaggagaaaagccaaggggcattaaatcaaaggtgttcaacaaatgaaagtttactcagctctgaagtaaattctgtaagaatacaatgaaattattcccacatttctatcccatacatcaagaaataagataatcactttaatggactatgaaaagtaaatcaaccaaagaaatgaatgaaggcattagaagaaccaaagctttaagtcacaagtcaagaaacctgttttgtttcaacttataccagtgctttgctgggttctttgcctcagcttcccccaatgcaaaaaaatggtgatgagaatagtttcattcatgttatttaaagataaacagtcacatttcaaagtagtttgagacctaaaggtcacgtagggtcagctccctcactttaattagaaaaatggttacattagtcctatagctagtttttagcagaagaagggtttagctgagaagacttgggtatcctggctgatgttcctcccaacccaccactttatgaaatgataaagagtagaaaaatgatagccgggtgtttggtgcatgcctgtagtcccagttactcctgaggctgaggcaggaagatcacttgaacctgggaagcagagactgcaatgagctgacatcacgccactgcactccagcctgagtgacagaacaagactctctctcaaatatatacatacatacaaacatacataaaaagtaaaaaatgacaaagcaatttgattgccactttggcaacatcatctgtgtattcttaataaattcaagtaagagttacttttttttatttttatttttacttatttatttgaaatggagtctcgctctgtcgcccaggctggagtgcagtggtgcgatctcggctcactgcaagctccacctcctgggttctggccattctcctgcctcagcctcccgagtagctgggactacaggggaccgccaccacgcccggctaattttttgaatttttagtagagacggcgtttcaccgtgttagccaggatggtctcaatctcctgaactcgtgatccacccacctcagcctcccaaagtgctgggattacaggtatttttattttttttttgagacacagtttcactctgccacccaggatggagtgcagagctgagatttcagctcactgcaactcctgcctcctgggttcaagtgattctcgtgcttcaacctcccaagtagctgggattaaaggcgtgcaccaccacgcctggctaatttttgaatttttggtagagacggggtttcaccatgttggccaggctggtctccaactcctgacctcaagtgatccacccaccttggcctcccaaagtgctgggattacagacatgagccaccaagccagaccaaaagcaacaatatagaacattccaaagtatctaaaaagcaaaacctataaacacactagtaattcattttaccatgaggtcttcataaactccaagaggataaaattccccaggaggggctaggcacagtggctctcgcctgtaatcccagcacttcggtaggccaaggtgggtggattacctgaggtcgggagttctgagaccagcctgggccacatggtgaaaccccgtctctactaaaaatacaaaaattagccaggcatggtggtgggcgcctgtaatcccagcttactcaggaggctgaggcagaagaattgcttgagcctgggaggtggagattgcagtgagccgagatcatgccactgtaactctagcctgggcgacagagtgagactctgtctcaaaaaaaaaaaaaaagggctgggcacagtgacttacacctgtaatcccagcactgtgggaggccaaggcgggtagatcacctgaggtcaggagttcgagaccagcctgagcaacatggcaaaaccctgcctctactaaaagtacaaaaattagccgggcgtggtgacaggcacctgtaattccagctactcagaaggctgaggcagcagaatcacttgaacccgggagccagaggttgcagtgagccaagatcgcgccactgcactccagcctgggcaacaagagcaacattcggtctccaaaaaaaaaaaaaattcctgagggtgagaaaactcactgcaatcaagaccatccaaaattcaaataagcgctttagtgtcactgaactgcatccatagtctatttttacccaaccctgatctgaaacagacttcaggagactattagacaaaacacaggttagcataaattcaaccagaaataaaaacatgaaaatagggaaacaaaatgaagctattaaaaaggtacaagcttagctctaaatttccagatgtcaataggaaaaaagaaacctagtgaacaattacagcacccaggtaataaaaacagactaaaagcttagacaaacatacaattattcttggctgcacatctttctccctgaggtctttataaagaaggcattgcagaatacagagaatatcctcaacaatatttcagtaatcacaatgaaatgttttatgaggttatttttatactgaacttcaagataagcctagagtaacggttgggagaaaaaaaagaaaaaaaaaatttcggggacagagagaaaaaaagaaaggaaaaaaaaaaaaacttaggagagagagacctacataatgtggtccaggtacccagaacactgctgatttaagagcacaattaagagaatttctggaaaaaaaatattattttaacaagtagttactatatagaagtttataagcacaggacccagaaaatgaaaagcaaatttagcaaaatgtggaatgggtccaggaattaaacaaaattgcagggaaaaaaaaacaactctaagagggaaaaacaaagaatataaaagaaagaagagcaagcacaactcagcaagtacattacatacatatgataattaaatgcttttatttctacatctacaattaagaattaaacattaagatatttacggaagcatgcagcttccttcttaatcccataatcaaggagataaaatttaaattcctgtaccttccacagtgatgaaatatcattgtttagtgacatcatatcaaacacaacgtactgcagaattttcaaagcagttatatttccactgtaccaagaaaggaagatatgtgaaatatttcatgaaaattttccaagaagagtttaaaacaaaaagggtaagagtttttaaaccagacataaaatcagtcaaccataaaaattaatttaaaaaactctctctaaagtctcatttagcaatatagtttactgtcaagcataatacaatgataaacatacaatttgctaaacattcaacaacatagaaaaattaatcattctatagctagcatgtaccaacgacacagaatggatcactgtttctcctctgggaggtgggaaagaaaaaaacaattgaattcttagtgaagaaagggattataatttccacagaactatccacttgtaatttaagcaacatcatttaaaaacagctcattccaacagtctcctctactaaatattttcatcagggctgcctagacgaaacctagcccaccactctatcttgggcaaaagagtaaaatacagaccagctactggaagggtggggggagccaaaattcaccagctgggtcaagttcctgaagaattaactaactacattctaggattcatttctcagcatcaaagaacaactttttcttcttctttttaaattaaagcaatgcctccattctcattgtctggtcaactgctgaaaacctttaaaacactcagaagatcaacaaacacttggctaaataaataccagccttaagagtcaacccggtgatcttgctcaacaagaactttaaagtatttatgctttactggtggttttagtttaaatacaatttttttttttttttgagacggagtttcgctcgttgcctaggctggagggcaatggtgcgatctcagctcaccgcaacctccgcctctcacgttcaagcgattctcctgcctcagcctccagagcagctggatgtagaggcgtgtgccaccacgcccaactaattttgtatttttagtagagacggggtttctccatgttggtcaaactggtctcgaactctcaacctcaagtgatccgcccgcctcagcctcccaaagtgctgggtgggattacaggagtgagccaccgtgcccggccctaaatacaattacaatgtgcaaaaagagcatgtacttcagagtactttcagtacccaaatatgatctaacgcatgaaaattcaactttttaaagtatcagttgatttaattgcaagaggattcaactgatcccaaaatgtttcctaaaagccatcctttggctgttcttatacacttcacacccttccaaaccataaaccattatgtgagaagaatgctcagaactaagtagtgaatgaatggccttaaggtttttccaagtcattaaactatcctacagaataagaaaaattctcaggtacttttatttcattggtttgtaacgcttacctacaacagtaccaaaactcagaaatgttttcaatgcaacgtatcctgaaaacaatacgcttatagtgtctaggtgcttttctgttactcaaaataagtgcatgcaatttaaaatcctttaactacagtgtttattatacctctaagcacaaaatatttaacgttaaccaagatatttttaaagcggtgatttaaacagcaaagttagtggggataatgccatgaatattagcaagctgaattaagctactaatccatttaaagaaagatgggttacggaagaagcaagcctctgaagcatttgctttaaatctaaatacagaagtggacttgagcacagtgaactaacaaatgataatagaactaggtctacaaggaagaaattcagcaaaaattatccatttcttccttcaaaatagaaaaaaaaagtttcatttcagatacaatatccatgcagataatataaacaaaattgggaaaccagaaaatttacttttaaaaatcatagctgtctcaacaaccaaacactccagtgaaaatcttcatcaccttttaatacagtcaaggaaacaccaattcttcccacatattcatctttttcagccttctctagtaagccagcctctagcaaagagaaaatgaaagatctgctagtcaattatcctgcccctcttttccaactcctcatgctctctctcaaatctgatattcctaaggagataaatgcacttatttaacatgtatctttaagtatgttataatatagtactgctttatttaattaagtacatagatgctgaattgggagtgacaggaatgaaacgtctctgtctccaccatgccaatttggagtgccacccataaaaagcttatgtaaaattttctcaaaccaacagatttagaaaaaccagtaagatgaggtgggcggatcacgaggtcaggagtttgaggccagcctggtcgacacggtgaaactcagtctctacttaagaaaagaaaaaagaaaaaaattagcctgacttggtggcgggtacctgtaatcccagctacttagggaggctgaggcccgagaatcacctgaacccaggagccagaggcttcagtgagctgagatcgcactactgcactcctgcactccagcctgggcgacagagcggaactgtctcaaaacaaaacaaaacaaaaaacaacaaaaaaaacaacccagtaagaatttattccaaatacatcaatacatttaactcagcttaacaaatctgcttaaaatgggcttttttttttttttaataggaagagagtcaggttgtgaaactagactgtgcttggaggcgatgtattaaatattctgaagcattttctaattgtcagtccttaaaatgtaagaaaatctcaagtgttaaaattgaagactgggtgtgctctctgctgaaagttcaatcaaaagcaactgtaatttcctacaaaggtaactaggtcaactcagcatttgtccctgcttactggaaacaacaaaatctcaacaatcaggccattaacttatcatgtcctatatatagtttcaaaagaaatctaaattcactcttaaagaggtactagtacaattttacacataagatgtctcctagttatttttcttagacttcaaaaggaaattaccaccatttagactacaacaatacaaccctacagcaaaagtatcttccccttcttcactagcatgtatatgcactcatctacccaacatcagggaaaaaacaaacagaacctagacacctatgtacaaagaatcacattctctccataatggcgattcattcattcttccttgtgccaacatttctcaagaatgctatcatgcatgaggtctactcacaggggtacatgacgctgctcgggatcagctctggtcagttcttcctcttcaatatcagactcccctcctgaactactgtcagtgacatctgaatcaaatgcctgttcactgcacctcaagttggctatgccactagctgtaaatctctccaattcttctgaaattgaattgcttttcagaaagttgctaagtccctctgaagtggtggtctcactggcagcttttctcaaggcagcttcagcctttcgagtcagcatcaactggctccgtggtctcaaggattccaagtttggcagtttgctcaaagtcttctccaaaaatccacccagctgatgttgtatatgcctctcaacctgcttggcttgcacaacctgtaagcgcttttgtaatctgcgggcacggctctcaatgtcagcctgtcgccgcagtaaagctgttatccttgtgtcagaatctaaagcactgaaaagaatggaagacaggggagactttttaccctccaatttgacaccccccaagttagagctggagtctgtaccaggtgataatctactgcttccttgaagtgccggctgttccatggaattgacagaggatttgtttgcagtgctattattgctatacaaagttgtgtgttctacatcaaggcttctatgtggaagagtgcaattggtcataccccccttcaagtccccagattcagatcctcccatttcacccccatgaagagcagatgaagtgagagcccgttttcccccattgagggaagtggaattgtcatgatcagaatgtgttgaacttttagtcaatttcttagccaacccatttacaggtgcttgtggcagagctgtctgaccactcgtattcatggttctaagattttctaaggaaaactccaaaactggctgtctccccaacagctcagctcggagttcataggactgagataagagaggatgagatttaaggactgtctgcttgctgaagaccccttgcaacttcaaagactcctttgagggaacagatgttacatcagagcagagataagatgccaccagtggttgcagctttcccaagtcttccttggtaggattatttcggaaatctaggctgggatcctctgcagcaatggcttttcttttggttccgttggcagcaataaggatgttggcgttgccgttattttcggcactgccaggggacaaggtagaggatgggggagccagtttgaaccggatatggtgtgcttcagctgctgcgtcagtgagagcgggcgccatcgcagccattcagcacagagagacaggaagtccagcctctcccgatgccgaggccgaggccagctccacggccccttactgcctccccagagaacagactagaagagaaaggagaaaagaatattagaaatacaagcacttttaaaaacatgtatatttttaacaaaagcactacttgaggctgttgtctaaactgcctccagaaagaaaacactctggagctaactgtaccacagttattctagagacccaaatatctttcatctgggagaaagggggaggcaaaatccctgcacaagggaaggaagaattgcacccttcttgtcatttgttaccacagattgaaaggtgccaaaacacaagttcgattcagagaaaatcacagattgttaaaattaaatcatctccattaaaaaaaaatctctttaagcttgttgaaataaatggatttaaagcaagacacatcaaactaagcaataattaaacagaaaaaaattagtaaggaattcccgtgttcactaaaaaaagtatgccaaatatcacaggtctgtgcatttttctggccagggaatccagttttcatcagcttctcacttctctagaagtatagattatactacaaagctaactgtaccacatctgtaataccaacttgtttcatcagttttcttttctttcagatcaaagtggtcatcaatatcttctctactggcttcttcctctcagcctaggaatttactcaagtatcttctgccctcagtacagcctctctctcatacttaattgcccaaatatctctctttccctttaccccaaaacttctctaagaatagtataaataactgtctctgcactcttcactcttccataatctggatttcaccccctactgctctggcaaaggtgaccagtaatcttattatcaaatccaatggtcaaacctcagtccccattctatctgacttctctgaagcactggacaataccgaccttcttctaattctttcctgatgtccttgtactatcatcctcttctcttcctcctggacccttaaatgctggtgctgcacaaggtcccttctgccctcttctctctcaacaaccactagtatggtgaggtttcttaaccataagaaaaacttctgagctgcactaatcaagattcctataacctctatgttcctcaagccccctgaagctcagaattcactttctccttccagcacactattccgcatcctgtttcattaccttaagtaatgacactgcttttatttagtaaccaagctaaaaatctcagtcatttgcctctgtttgatcccccttgatctatgtggtctgggagccaaaggaaacatacgtaaagaactaagccagttgttctttaaagtgtggtctctggacttctggggatctcacaggctattttggaggttcgtgaaatcaaaggtattttcatagcaatactagaatattatctgccttttacactgtgttgacatttgcaatcagagtacaaaaacaaaggtgaacaaaactgctggtacattattagcacaaatcaaggaagaggcaccaaactatactaatagtcattatactctccactcagtttttctttttttaagggagttccacttaagatgtccttgatgaacagcaaaaattatgaattatcttgagcctttagtgcattttttaaaaatattctttgtgatgaaagggaaagtatgcataaagcactctgctgctttatgaattctcaggaaaaagcacagtacaactgagttgcaaaatgaactagagctttgttcatggaacacgatttttacttggcagaactactgacaaacattatttgaaacctgcttcactagcagacatttccttgcaaatgaacaaagtgaacctgtcacttcaaggaagaccactgacgatatttgctgccaataataaaatctgaattttttaggcaaagattagtgtttttgaaaacttgtatcaacaatcatgaacttaaacattttcccaatattttatttggtgggtgtggatgtgtgtgtgtgtgtttaacagagtcttgctctgtcgccacgctggagtgcagtggtatgatctcagctcactgtaacctctgcctcctgggttcaagtgattctcctgcctcagcctcccgtgtagctgggactacaggcacgtgccaccacgcctggctaatttttgtatttttagtagagacagggtttcaccatgttggccaggatggtcacaatctcctgacctcatgatccgcccacctcggccttccaaagtgctgggattacaggcctaagctgccacattcggactttctgaatattttaaaagccatttctgatttaacagacttgtgacgatattaatgaacgtgaatttttgattgcatataatgtaatgtgtaacatttggaagatctgcataacccagtgaacgataaaatgtccagtgaatgtcaggaaatcatgcatgggtaaaaagtttaagtgcaagacaaatcatttatttgttgctgttattttgaaacagggtctagctctgtcacccaagctagagtgcagcggcacaatcatggctcactgaagcctcaacctcctgggctcaagtgatcctcctgcatcagcctcctagtagctgggactataggtgtgtgccaccatgcccggctaattttttgaatttttgtagagatggaatttcattttgttgcccaggctgctatcaaactcccagcttcagccttccaaactcctgggattataggcataagccgccatgcccagcctgaattacttattaaatattttttaaatttctcaaagtttataagaaaaacaatttatttgctgttctcaacaaattttaagagttaaaaaagggtcctgagaccaaaatgcttgtgaaatcactggactaagcacccccctccctgccccaaatgagggcaatctccaatttaatcaaaaatgcttatctttggagcaataccaacacaggatggtaggccctacaggaccacagtaagcttctttatagtatgacaatttgaatcattaacataaaaatactcaaataaatgactgagaaaacattattcataaaagcaccaatatacatatgggtcgaatctgtcttattgctgtgtgtgtgtgtgtgtgtgtgtgtgtgtgtgtgtgtgtgtgtgtgtgtgtgtttctgagatgtagtctcgctctgtcgcccaggctggagtgcagtggcgtgatctcggctcactgcaacctccgcctcctgtgttggagtgattctcctgcttcagcctcccgagtagctgggacttcaggcatgtgtcaccatgcccagataatttttgtatttttaatggagatggagtttcaccacgttggccaagctggtctcaaactcctgacctcaggtgatccgcttgcctcagcatcccaaagtgctaggattacaggtgtgatccactgtgcctggcctcatataattattaacaccaaaagtttcttgttccagggttgtattttaaccaacactctttatgaactagattttcagggcttatgtagttttctcctgtgggctttctggcatatggcattctgtgtggcacaaattattctatgttgtcttttcccatttctaactttaaatataatactaattactaatatattattaaacattgtgttacagaccagttgacagtactaattcctgttattaaacattgtgttatagaccagttgacagctggaccaatatagttgttaaaaatattttgagtcacttttataatatgcaaagggtttttcccatggacaaacgaaaatcactaccagataattcccatcaattcaatctcctccccttttgaatgtcaatatgtagttgatatgagcaatgcaaggaggcatattatcagtgccagatgattaatacaacatgtgaagagtaattgtaccctactgcctgacagcactacagtaagacttagcaagggcaggaaacagcttccctctgaggacccaagcaagggcacaaatatgctttatgacttacataaaacttaggaaaacccaggctcactccagcacaaatgaaaaagagggtcataattaacatcacatcacagaaggtgcttaagtagtaaacttctcaaagttattctgagattattcaattctttaaagcttacaactttaagaaaaaatgccggcttaaatcccatctactccagctgggcacagtggctcacgcctgtaatcccagcattttgggaggccgaggcaggcgtatcacctgaggtcaggagttcaagaccagcctggtcaacatggtgaaaccctgtctctactaaaaatacaaaaatcagctgagtgtggcggcgagcgcctgtaatcccagctacctgggaggctgagacatgagaatcacctgaacccaggcagcagaggttgcaattagccaagattgcaccactgcactccagccggggcaacaagagcaagactccatcttaaaaaaaaaaaaaaaaatcccatctactccaagacttctctgaaatgatgtctatgaacttgacattaacatatacacttcaaagacaatagtttatttgatttgcactttatccttggtctcaatatccccataggatacacagcatagtgtagttactaaaacaatcatctaagtaagggggtgggggaggagagagagtgcagagaacaggaaaaagtgaccactttttccgaaaaaattcccattcctaattcctaaatcttgagatttctataccaaagaaataccatttattgacttgacatacctttattgactcgaaatactatgctaagattcaacattactcccaaagatattcataagtaagaggagcactgactcaagtgagcaaatctcagttcccatcctggctccacctcctgtaggttacttaactattctgttctttaagtctcctcatctacaagtaacagagccttcccgacaaggatgctatgatgatgaaataagatactttcaattacttggccacgtacctggagcaaccacccagtattatttgcacttttattacactggaaacaaaaaggaaacatagaaggaatgaatttccatggctttttaatgcacctagtttgcaattagctacaattgccataaaccaccacctaagtttagtactttaatcttttccctgttatgtctagacttacttttaatatttcatgatgttgtttataataaaaagaaaactgaatgccaaaaactcggttaaattattaaatatccatacaatggaatactgtgcaaccctaagtgtggcagagctatatttactaacatagaaaagtgcttgcttcattattaaatgaaaaaaagttacaaaacaaaacacagtatcatctcaattttgctttaaaaagtcattggttaagattcttttgtcttttgtttcttggcttatgtaaagtctccaccataaacatgtattacttctataataaaatggagagaaacaaaaagaaaacaatggaaattcttaaagagccaataactaagtaaaacaaaatcacagtaacattctttttttttttttaagagatggagtctcgctctgtcacccaggctggagagcagtggcgtgatctaagctcactgcaagctccacctcccgggttcacgccattctcctgcctcagcctccccagtagctggaactacaggcgtccgccaccacgcccagctagttttttgtatttttagtagagacagggtttcaccatgttagccaggatggtctccatctcctgacctcgtgatctgcccaccttggcctcccaaagtgctgggattacaggcatgagccaccacgcccggcccatagtaacattcttaaatttaatatacagagcaaaacaatgattcctatcccacttgacccctacaaaattcaaaaagcttcaatctttgacaatgtaaagcagggaaagactgtcaaatttaagcagttcttagagaagctcagggctaaaggaaaaaaaaacgaaaaacaaaaaaaggaagcagttctacacaaacagcacaacagcctatctgataaatcatctttctccaaagaatacaaagccttaaaagctataattaactgattaatcctcataacaacctgggcagtagaattagggctgagattataatttctaatttaccggtggggataaagtcagactgtacattcagaataaaaattcaagccccaaatatcccaatttttagttcattcagttagtaaactataatctgacaaatacagatggagctgctacacctgctgtcactcacacaaattgagattctgcagtaagcttgtacagataaaagaaaaggctacctattcaaggtcatttagctataaaaggttgggctagataatcaatagtttctctctcagtttcaaagaagtattttagggtctggaagatgttaaatgcactcagcaagcaaatacatttcggaaaaacttcccagatggagactcacaacgtattgcatcatactgaatatgcaaatgtttacctttaccaaacttttttaacaagcacctttttccattacatctattaatatcaagcagaaacatcattgtgagaaatacaagttgggataaagttcaaatatgtgacctctagggtcccttcctatgttaattctattattctaaattgcaccatcggtccaaggacaaacttctacctaacacaagtggcacttgggaagcaaaaatatacttctaggatagagtttctcaacctaaccactaactgacatctcacgatgagtaatctatcacagggggctatcctggcagtagcatgtttagcaacatctctgttttccacccactagatgctagtagtgcccttctgaaaattatgacaatcaaaaatgtctccagacatgtcaaatatgggagctggggggttcaacatcacacctcccaacagagaaccatatcctaaagattatacacacacatatatatactctttcaaaagcaaaacgtatccagctgcttcaaatactgtaagtcagaactaactccacacccacaaatgaaaacctcatttattcccagtcaatttccaagacaagactccagatacacaagaataacctggaagcatccaccttgcaaaaatatttagctgcagagaacaaaggggaaggaataggtcatccaggtggccaacaagtattacaaccacacttgcactgaaagcaaaagcaaaaatcagatggggaagaaaagtttgcccataatgtggcttctactaacctcttccttcaccattacctcatttctctacacaaaggacggaaagaaacagcaggaaggatgattagggaagtgtccatgaagttgccgcaattttagctgagacttgaaaattagctaaaatgtcattatgcaaaaggctaggacaagagaatggtaatgtggcattctagtgagaggaaatggcataagaaaaggcaacgctgtgtgggaaaaggcgacattctgaaggttaaaagaaatgaacaatttgggccgggcgcagtgactcatgcctataatcccaggactttgggaggctgaggcgggtagatcacctgagatcaggagaccagcctggccaacatggcgaaaccccatctctactaaaattaccaaaaattagccgggtgtggaggcgcgcacctgtactcccagctacttggaagactgagacaggataattgcttgaacccaggaggcagaggttgcagtgagctgagatcgggccactgcactccagcttgggtaacaagagcgagactccatcttaaaaaaaaaaaaaaattaacaatttgcttaaaacacaaagcatattttaatagaggaaatagtagaatgaaggtggaaaggcagtttgaagccagatccttaacggacagcctttaatagccttaattcagacttaaagacagtagaggggccaggcacagtggctcacgcctgcaatccccgcactttgggaggctgaggcgggtggatcacctgaggtcaggagtttgaaaccagcctggccaacgtggtgaaaacccgcctctaataaaaatacaaaaaaatcagctgggtgtggtggcgggcacctgtaatcccagctgctcgggaagctgtggtaggagaatcgctgaaacctgagcggcagaggttgcagtgagccgagatcgcaccattgcactccagcctgggtgacaaaagtgagactccatctcaaaaaaagaaataaataataaaaataaaaataaaaaatttagccgggcatgatggcaggtgcctgtagtcccagctactagggaggctgaggcatgagaatcacttgaacccaggaggcagaggctgcaatgagctaagattgagccactgcatttcagccagggcgacaaagagaggctctgtctcaaaaacaaaaacaaacaaacaaagacagcagaggccaggtgcagcggctcagacatgtaatcccagcactctgggaggccaaggcaaaaggattgcttgaggccaggagtttgagaccagcctggtcaacatagcgagatcgagtctctgaaaaataaaaagtatatacatatatatatacacacacatatatatgtatatgtatatataaaataatgacagcagagtatcattaaacactttttaaatgggagtgaaacatcagactgtgctttagagagatcagttgggtaggatggattgaaagtaagtaaaaaggcatctatagatggcaaagaccaataaaaaagctaccacaataatccagataggatgcaatgagaacttcaaccagaaaataatagtcaaagtctctaccaaagcttaaatccagaaatgtgaaggggccagtctaacaaaaaggccaaatatatgacaaacaaaaacatgatggcttataaagaatggaaagaaagctctcttttccttcataatttcatctcctttgtgacgaaatccttcttttctcacgaagcttttcaggtttggtatgtcctctctatacttctaacactatcagtctagcccaggtcctcatcagctcctgtctagattatcacaacagcttcctgactagtgcctcagtgccccaaactatcctttacctttttatcatctcactttcctactctgaacaagttcctcacactttttttttttttgagacaaagtctcgctcttgtcccccaggctggagtgcgatggcgcgatctccgctcactgcaacctccgcctcccaggttcaaacgattctcctaccacaacctcccgagcagctgggattaccggtgcctgccaccacagccagctaatttttttgtaattttagtagagatggggtttcaccacgttggccaggctggtttcgaactcctgacctcaggtgatcgacccgcctcggcctcccaaagtgctggaattacaggcatgagccaccacacccagcccctcacacctttttaatgagttcaaattcttcaagatgaaacttaacgtcagggcaagcacatcaattgatacggacccagaactccccacagattcccaactccgtatctttgcctatgttgctacctctacctggaaggtccttcttctactttttttttttgtccccaaacttactaatttttcaatacatagcatctccacaaaaacttcttagactcttccaattcatatcactttcttcctgcttgaattgtataatgcacttaaagtcactgtcattcagttcaaattatctgaattttccctaattgttaactaattctatttccaagacaagcaaaattccttaacagcacccttctttagcgtgctaactttatcgagagcttggtacatagtaagtgctgtaagccctaaatgactggactagagaagtcaaaaaggcctcgtgggggttgccctcaagtgtaagattttactaagaagagaaaaaggaggaaacacgaatcaaaaaattgacacaatcaaaataatgggaaagacgtggggcatgatccacaaaacaacttgcatgaatcaggtggtatatgtacagcttctcaagagaaagagaggaaaagaacagtgatttgtgatgaagtactgcaagctacattatggaatgcactgcaaagtatttattttacatatgaacaaaagtagatttgttgtggaatacaatggggaaggagagacaaaatttttactataaaacaaagagataatgtgtgtcacccacaagaccattatcaatttccttggccaacagggcttcttaactgaaaaagctttatattactaaaggaatcattcctgagtgcaggataggttattacaaatgttgttcactaacattaattagcgttttactatgtcaatcactatgctaagtatcttacatatattctcttaatcttcacaataacaatgtaaggtaagtactactgtcctcattttatagatgctcaaagaagttaagtaatttgcccatgatcacacaactatgaagttgcaggggcaggatccataatgctaaagccgatgcttttaactactacactagatagtttaaggcttaaactgaaacggtcttaactgcctgacagtaaattctgaattttagtctttagaggaaagtcagtcaaagaacaccaactacctactgagtatctccaataaatattaaaatgcctagagtattcaaagcaccacagtaagtacatacaaggatgacaagcagcagtaaagagagacactactgtgtgatttgggggatggaggcaatcctcatacaggctgagaagtaggcggagtcagaaaatgcttttcagaaaaaagaacatccaggctgaaacctaaagaatgagtaggagctgggtgcagtggcaggcgcctgtatttccagttactcaggaggcaggaggatggcttcaggcaaggagttcaaggccagcctaggcaacatagcccccatctaaaaaagccacccaaacaaaaacactaattttttttttttaaatgatggcctaccatggtagctcacacttataagcccagcaccttgggaggccaaggcaggaggatcgcctgagcccaggaggagtttgagactagcctagacaacacactgagacccagtctctaaaaaaataataattagctgggcatagtgggagggtcacttgagcctggcgggtggaggtcgcagtgagctgttatcacgccactgcactccagcctgggttacagagcaagattctgtctcaaaagaaggaaaagaggagaggggaggagagaggagagaggagagaggagacaggggagaggggagaggaggtgagagaagaaaaggagggaaagaaggaaggagggagggaaggaagggaaggagtagggccgggagaggtggctcacgcctgtaattccagcactttgggaggccaaggcaggaagatcacttgaggtcaggagtttgagaccagcctggccaacacagcgaaaccccgtctttgcctgtaatcccagctattcagaaggctgaggtacaagaatcacctgaatctgggaggcagcggctgcagtgagctgagatggcaccactgcactccagcgtaggcgacagaatgagactgtctccaaaaaaacaaaaagaaagaaatgagtagaattcagcattgcctatacaactacttcaagcatcccatattcaaaacccattccctgccccaacaccaaatccaaaacttcctcctgctcctcaacattgtctatttgagttaatcatgacctcaaatcaccaacttactttttaccataaatatttaatttaaacatctactaaatgccagatacaagatagtaaaatataaattaggtgtgaaggtagcctagcttgataaagtactgtatttcacctgaaggggtcaaggaaggcttctagaaaagatgacatactgactgaattttgaaaggtgaggtggtgcacagagggtgagggttggcaacacacagaatgacaggcacattcattccatccttggtgccaatgccctagtgcagaacctcattatgtactatagtaattcaggcagtaataatctcccaactattcttccttcttcctgtctcagcaagcctctaatctagcgtccactaccaaaatgattattagaaagggaagaaaaaaggaaaggagggggtaaacctaaatctaaccatttaaaatctttcactgactctagagtaaggatgagtccaaattccccacacaccattatctgtcccctttttacattagacctcatctccagcctgtcctcactgcagccacctgaaacatatgtttcctggctcttctatgcccctgcacctttactcatgctactctttcacggttcagctcaaggttacatgctctttcaagtattccccattactcccaggttgaggtggggtccctccctctaggctcttacctgcacccccatgacaccctggctattgctcatggtacaatataaactcacaattttgtcttgtctctttcttccccagagtatgtacttttttttttttttttttttgaaacagagcctctcattgtcacccgggctggagtgcagcggcacaatattggctcactgcaacctccacctcctgagttcaagcgtttctcctgcctcagcctcctgagtagctgggattacaggcacccgccaccacatctagctaattttttgtcttttttagtagagacagggttccaccatgttggcctggcctgacctcgtgattcgccagcctcggcctcccaaagtgctgagattacaggcatgagccgccacgcctggccaactatgtacttcttaaaaaaggagggttatagcttgttttatctctgtcccctacaagcagcacaatgcctggcagacagcagaccaacacacgttaagcaacctgagcattctatgctaaacccatcagatgaagatccattaggacgttaatggggatgtctgaagtgatcaaccacctaacaagaagaggcatcaactgaacctaggataggcttcacccactacaagttccagttatttacttgaccaagcacctgtacccagactaggaaactttttaactacactttttaagctattattaaatgtggttacacagcattataaaggtaatagccatcaaaatcacaaatgtaattgctcaaacttttacccagcaactgcacttctagaaatctattcaacagaaatattctcataggtactcaaagatgtatacacaatgctttcactgaagaactggaatacaaaaaaaaaaccctaattaaaaagatcaagccatataacaagtatgatcccattaaacatatatatatacacatatatatacacacacatatatacacacacacacacacacacacacacacacacacacacacacggataggctaggccccatggctcatgcctgtaataccagctactctagaagtcaaggtgggaggactgcttgagcccaggaattcaagaccagcctagacaacatagcaagataccatctcaagaaaacttttttttctgaaggatgtctatatatcaaactattaatggtgttaatcctacttctatgctagcactgaattcaaatttcctaccactctttagctgacaaaagacagaggaaaaaaaaatcatactttttatcatatctctttccaacaagccctaatggttggtgtaagtgctcctgaacaatcctaaaatcagcgacttctggaagattttaagaattctaaaggaggccgggcgcggtggctcatgcctgtaataccagcactttgggaggccgagacgggtggatcacaaggtcaggagatcgagaccatcctggctaacacagtgaaaccccgtctctactaaaatgcaaaaaaaaaaaaaaattagctgagcatgatggcgggcacctgtagttccagctactcgggaggctgaggcaggagaatggcatgaacccaggaggcagagcttgcagtgagctgagatcccgccactgcacctccagcctggggcacagagcgagactgtgtctcaaaaaaaaaaaaaaagaattctaaaggaaacaggttattctgggagggtccatggccaaattcctgagttcccactgaaacctaccttatacctttagagaaaagtcaattaatgacttttaaaagtacatttttccaatgccaataaaatgttaagtcaatactaatatccatttttcattctcttgggaggcaaggggtaaggagtaaatcactaagtgcaaaaaaatacagtccaattttttggagacatgcttaaggtcttcaaagagcttcagttctccatggtaacatatggagagtttaatgaaactttcctgacagttcaacttatcagactggtatttcttttttcttttttttgagacgaagtctctctctgtcgcccaggctggagtgcagtggtgcgatctcggctcactacaacctccgcctccaggttcaagcaattctcctgcctcagcctcttgagtagctgggactacaggcatgcgccaccatgtccagctaatttttgctgtttttttttttagtagagacagggtttcaccatgttaagccaggctggtctcaaactcctgacctcaggtgatccgcctcggcctcccaaggtgctgggattacaggcatgagccaccacacccagcccaggctggtatttctatgaagtgtctctcctatactagaaaccagaaactagctacagtacttagctttgagcctctttcccttcacaccctctggtggaggtgctaacaaacagtcacaaaggccaaataacaagcagcaagaggaaagtctagatatgagttcttagcaatttttggtttaacatcctaacaacaaaattgttattcctcttttttattccctaatacttaccttccaactgaatttaaccaagtctaaccttaagctctcccctttttaaaaaggaattaaaaggtgagggactccattaagtttgatgtcactcaagcaactttttccaaataagagcagaatctgctgtaattaaaattcagagtaagatctcattttggattcctggttcaggttacaagaaccagagtttttaaaataacatttagataaaactgcactcaatctacctccactttgcatttcctgaccctcaaaatcttggaaagaaactttaattctaaaaaaattacagccaggaaaaaaaagggtaagttcacagtcagcaacaataaaatacacagctaaataatttcctggtagagggctttcaaatgttaacactgtggaagcagcttaaaatcttggaaaagcaaggcttgcagaaagtaacatttattaaacaactattttgccgcattgtgctactaaatggggaaggtctactctatttaaaaggtctcttccaccttaaagggactctttgcataaaggtttaaaatcttcatataaaatgtttgatttttttctttcagactgcccaaactcatttgtttttgattcataaacatgagctgtgttttctactttggtcaagtcagtttccgcactctattttagctttacctttattctaccaaagacaagaaaatgcttaataaaaaaaaatatatattgcagctctttttggagtccaagtattttggtaaatcacaccttttggcttattttctcctatgtattttgttctacatcctaaaaggcacatggcttaaaaaagaaacaaataataatagttaccccctgccatactagtcatctcctatgacccacaatcctcccctcaatctgcaagtgacacccaaggatatcacttacctcctatatcttctgatagccttcaaacgctggtgaactctagtacagtggatatttgtcttttctaattcatactgtcttctacagccatagtgtggttcaactgagttttgatctcacatttcagggaatgggaagtactgatgagggaaacttatcttgtcatataaactattgttctgcacaacttttagtatgcccagaggtatatacgcaacttatcagcatagaaactgtaatttaaacatacatcttcagaagcaacatgagaactaaaaaagtcttaaaacagacttccaagaaacagttatgaagtccaattttaggaaaaagacatgatccaagtgttctttgcactgacacagtaggcaagccaggtgtctggggccattttacttaagaacctgccctgtactcctttcttaaggtaagtaagtaaagaggcactaaggtaaaatacgcttcccaagacatagactaatcaaatcactcaaggcaggaacatttaaaatgaagaaagagtacaacgaaagctgctttaaaactctaaataagacaagcaaggggccaggcccggtggctcacgcttataatcctagcactttgggaggctgaggtgggtggatcacctgaggtccggagttcaacaccagcctggccaacatggcaaaaccccatctatactaaaaatagaaaaaaattagccaggcgtggtggtgggcacctgtaatgccagctacgcaggaggctgaggtaggagaatcgctagaaccctaggggtggaggttgcagtgagccaagatcgcgccactgcactccagcctgggcaacagagcaaagattgtctcaaaaaaaaaaaaaaaaaaaaaaaaaaaaaaaaaaagacaagcaaggttatatgctcccgttgctcaacctactcaggaggctaaggcaggaagatcacttgagccccggagttcaggcactctaaactgtagcgcacaatgattacatctgtgcacgccaacctgggaatcacagcgagaccccgagacctcgtctctaaaatgaaaaagaaacaaaatctctaaaccactcaataagatttactctggggcaatcaacagacaaccacttattcagtttaccctagtccctcccctctaaactcaaggaatggaacggagaggtcctttgttggggggtggagagggacaataaaactatatacatctatctagcaagaaagtcgcttatttctgtgtcttaatggactcaccaagaagaaaaaaatagcccctacccatctccccacaagctgaaaaaacataaaaggaatacgcattactctttaaacatggcgtttactatgtttagaaaatccagtgtggattagtttggtgttttatagcacattttaaaaattgcttgtctaggctaagcgtagtggttcatgcctgtaattccggcacttctgggaggccgaggcaggtggatcacttgaggtcaggagttcgagaccagcctggccaacatggtgaaacccccgtctctactaaaaatacaaaacttagctgggcatggtggcacacgcctgtagtcccaatggcacatgcctgtagtccctgctacccaggcggctgaggcacgagaatcgcttgaacctgggaggcggagactgcaatgagctgagatagcaccactgcactccagcatgggcgacagaacgagaccctgcctcaaaaaaaaaaaaaaaaaaaattgcttgcctgatataacaaggtaactaagctttactcgcaaaggggcctaatcagaacctctcaatactaaaataccttctcaaacaaccacaacacccctatgtttacagagtacacaaatcaggtcataacgaacagaacaaacctaaaacttcttattcactttaaaatgcaattaaaacctgtggtcaactcaatcctctacagaagacgcagagacactggttacaatgtagcattactagagatggaagagtagccttagtgacagtgaagaaaaaagtttagtatagttacttcactttcttctcaccttgatatgagttcacaagtgaactaaggcctactcattttctaacttccagaattttcctcaacaggaaacactcacgtaacaaagagtgctctgcaggtttaaccagagaaataacatgtgtaggcaggaagaaagaaaatcagacaaaaatttaacatctcacgttggtaaagcaccaaagtcaaatacgaatgttctgaacgtggctttcagaaaagatgcaagaaaacttctaaaatacttcacttcagtggactcatatagatggaaagaccgaaaatcccaccctaccataaaggctctaataattcttaactgatcattcttttaactggtcacaatcacagacactggtatatactcaaatgaggtggccatcagtgacaaccatcttcaccataatatagacattaagaacctttgtaacatttaatgtttccctccaagtagttcaaaaaataaaaagtcaatcacctcaaattatgaggtactaacaaatacaccaaatatgctaaaggtcgaaggaacggcacactttgttgcataaacctagtggaaatccaattcagaatttcatgactgaaggtagttattccacatttataatacattttttaaattcccaagggatgagcatttttaccttgccttatttttagaactacacatcacactgcacatatcacatgacatgatgtaactgttagcaaagaaaatggtccaaaccattgacaatgtacatggtaaatcaggatcaatgcatactcaagaaccacatttcgtatttactttaaaaaaaaagtttcttaattcaaaatgttttttcaaattgaaaaaatgtctagtaacctatgtagaaaaaaccagaaatgtacttcgtattttataaaataggagtttacccaattatgggaaaaactgatataaagaaacagataaaggaataacatacttctaaaactacaggattaaaagtaaaaattttctagatcaacaccgaaatgctaataaatacacttagcattaggcacaaaacaattactactcaaaagtattcactgttgataggttaaaaaaatagttttaactgacaacgcctgtagacaattgaaattttctaaattggtcagacagcatgctagaaaaggaaccaagtagagcctataggaaaggggaaagggaaaacacacccacttaagcctttgtaaatagtggtcctttaactgacccaaaaagcagagaaaacagaaattacagaccatcctgacaaatggaaaacatattctaacgtactagtttccatacttgaaaggactttcaaaatgaagttcagtagcaatctataactatatcatgattatgcaaggcaaagattatgtaattttatcgtttattttaaaatgttctccgactctaaaactaaaacaagtaaaacgttttgatctctccaaagcgaaaaggaaaggttcctctgagctgcaatttaaaaatataaacacacaccccaaaacaaacaaaaaaacacaatgattgctagccacgtgacaaaggagatggcaacaccaggattgtgaatggaggggagggaggcgaggctggaggaagagagatttctcggaactttggggaccgcggcagtcggtctgccgaccctaggagcactaaactccagcccctacgagttgtgcttctaacaccctcaagtacagttttattaataagtcacagaaaatgctccagtgacctccaggataaaggggggtgggggggaccgaggaaaaggaaagagagcaatttaaagtggcgccatcatgtcaccccttctcccctaaagcaatcagtaagcaatagttaagtagcacgtttctctataaatccacattgggattccaacattggaaaacgaggatttttaagtaagacacgggagtagcgctgtttatcgtatggaaaacaaactatttgctaagaatcaaaagaccgtcagccggaaaacaggcccccaaaaaggcagttaagattccaactcacttaaaagcaaataaatccctcttcctctttagtttaaaaaaaaaaaaagtccgcctgagggagactacatctgaaaacgtaagtgacctgaatttacaggcaacaaaaataataaatgaaacaatcagagttgtgatacaaaccgtgcaacgcgccaagatgtgtgtttcgagcagagaaaggccttttgcagtcaagagaagttcaaggcgagagccagagtttgtttggggggttcttttacgggaataaatcatgttcttcaggccgcctttttaaatagaacgccaaaggaaaagctggcgaacgaggcggcagctcctggggaagggcccccgcacacccccgcccttggggcgactcccagcccggacccgcagcagggaagcccggagaggccatttaaagttccgggggatttttctaccctgccctgcctttctagttacaactaacaaagagagagagaaatgggagccacagggagagcgaggagaaggagaaagggcagcaggaggaggaggagaggagcagcagcagcacctaccacgtgatggaggagcgtagcccgggcggattcagccccacaaaatgggcgcagtttgcaaacagccccccggcctgggcgccg

SEQ ID NO: 688 - DNA, 162816 bp, Homo sapiens
attctgtaacttttttttttatttttttcaatttttccttcttttttttttttaagcactagtctgtgctttgcgaacagaatcaagacattaacaaagatcagcttctctgaagaaaagcatttctatagaacaaagacagctacatgtttcgctgccattacacagctccaaagcaggaaaagaaaatatttacaaaatacaaggttttttttttccattttttgtttttgttttttttttcaatgctaaaagggttattcagaattttcaaccttataaatagaagaagcactttatgcatagggatatggtgcattattgtatttttttttaaagaaacaatgacaaaccctttaacttgcaaacagaaaaaaaaatcactaatgttgaaaattgtgaaaaaaccccaaccattaagcagttgtctactatttttatacgattacaaaatggccaaaaaaaaagagtcttctcccccctccccctttttggtgatgtgatcatacaggagacaggcacaaggttaacagagaagggtgaagggggaacaatgggaaccacagctaggaccagacaatgttccacaggcaaggggagcgtgaaagaccaagagtggaactaacaccgacagggatctggatgtgaaggaaacatggcaaagtgaatcagagggaaaaaaaaaaaaaatcacacagggagatggctgctcacttcccacaacccccagtttgcaggggagtgggaatagaggttaagtagtcctaaccctaccttcaaagatcaggataggtggtaaaaatattccaagtggaaggacgggttgtgggtgtgtacatggcatgggagagcagacagggaagggtaccaaggggcatgaggaggggaacctgagcagccacagccaggttactgcagtgaaagagtcaaaacagagaagaccaaatgcagatgaaacaaaaaatcagtctcttaagttctgggtgagaaaggaaaggtgttctgccagctgagcactcggggagagcagctggcagttatggcagagaggctctggtggggatgttccagcacgaaaaaccaaggggacccagccaggagggccacagcagagccaagccacagatgggaggggagggggtaagagtccagagcaccctgccccattccaccctagctcaagaaggccatgctaaactgtagcccgccaggctgttctgccctgcccacaggtgtgagggagggggtggtcatctaagatcagtaagtccagtgattcaacagtgcagaggatgtgccaggaccaggccagcagggtctcatcctgaacttctgtttgccaacgggaggaagtgctcaggtgtgtgacaagaaaacatggaaacaaaaacaaaacaaaaattaaaacaagaaaaaaaaataccaaagtaggatctaaattccttaagttcactaaaaactgtgaaaatttccggcatatgatgtttgaatatcaaacgcagagatttctgaagctttaatgccaatagttagtgagtctgtttagatggctgtctcccgctcatctgtgagtcgggcgctgagctgtggctgctgccaccagatgccgactcttgagggggacaatgggaggcgaggtgggcgctgcctctgtctcccggccagtcttgctgcctgaggtgcgtcgagtgcagcgggctgctcgctcctgtgcatccagctggtcctcacactccgcctggggactgtgcgccagggggaaggtccgccgctcccagggctggacagactgtaggcagacaagttgctctttgaggacccagtcccagccagcctgcttcctgctccaaggccctgccacaaaccttgtggcctggagcctaggaccagtctatctagtgttcctgcgacagtctgggaacacccctcctagggtatacccagacaactgtattgatcatttagcagtgatcaatacagttccactgaacgttgaggagatcaatttaagtgcagccctttgtcccttcaaaagggggaggggatggctaggtccctcttcagcagatgctgccccttcctggttccatcccccaaccatgccaaccccacccaaaggctgcgtcccttacctgttcatccagccccagctctggtgtggaacaacgggtatcctcactggctaagtgtcgcggagtgtcccgagccacaggggtgaggggtgctgagtgcagttccgggctaatggggctcctaggggactgaccatgggagtattctgacaaagagtggctactgctgacatcaggggaggcaggctggggggtggaggggttggcactgcccagctggggggttgtccggccgtctgatgacctgtaggacctgcacaccaaggaatgcaaatctgagtgcctgggaaatgtttacttatgggggtagagggcatgaaaaaagcatccccactggaggagttgaggcaaacaaacaccaacagattttccttaggatccagcaactcccatttcttcccactattctctggaggggtaggtatacaacatttaccatcccaagaaaaaagcatggctgaacaatgccaggtgagtccatagcaaagtgcctagtgaattcaggaggttagggagattcgtgtagactttgaaaactgtagtcaaagaaaaaaaagtaaaagtaagagctcccaaaactttctacttgagaatcccgagggtttctgccactgttaacaataaatggagacagggtagtgatggacgttaagggggggcagtttcttcaagtggcatcacaaagccactgtccaaaggaaggttaacttgtagcgaggccttccaagctccccgggttgaatcaccatgaccccccaactgtcttccaaatgccacagatcatgggaattcagaattacatagtgacttctcagcaaggatctagcacttggctccttatatctccactagttccatgtatctccactagttccaacaaacaccaaggaaattctgagctatttgccactgccagtagatgagtatgatgagcaaccaagaggcagtagcaattccatggactcaagtagggcccaaactccctgtccaccctctctccacaggccctggggacccaagcctgccccatcacctgctgccccgccgctggggtggcacactcgtggtccacagccaccgtgccctctccatctcctcacatttggcatgcagggcggcgaaggctgcgtcggataggtcctcaatctgcaatagagcagcttcatcgatcccctcttttctccaggagttaagaaccagtcccaccccattctaggttcttcccggtcacgacaggaatacaaggagcttgcacttcacacccacaagtcttcaggccatttagggtgtgtgcactcatatgtatgtgtgcatgtgtacacacgtgttcttctaacagaagaaccaggccattacctcttcattctcctcatcaggactccccttcagagactgaagatcaacctcccgccagctgcaaaaccaagaacagacaatcatgagatggcaagcaggctaaaactgggggcagggtcaaagtgtccatgcaaggatgagaatcctgcacctgtgggtgacactgctctctgccgggtaggctctgccctatcacagctcagtctccctaccctgtcaaggcctgtgaaattggccacctactcaaatgcccaagaaggccagaaatgagagaagcggcctagggtaaggctgaggctgagagactgtgacaaacacaagaaaagaaacctgtttaaagaggaccaccactgttcaggaccagctgattgctcccatatggaaatgcatacccagggttgcctaatcttctgtttggcaacaaaagctggaaacaaagatttttatgtgaaatcctgctttgatgttgacaacaaattcagtattttaaaacatactgtatgtgttgacaaaaccggtctctagaccagtaagtgaatggcctaccaggctgtgactgctggttcgtttggtgtattcctataatggaatgagagagaactatatacagaaataatttcgttcttatcagataagaatttctcttaatgagaagacagaaccaaagactagggcccaactcttggtcagaagagaagagggaaaaagggcaatagcaggaagaatggggagaggagccaactattctgagcttctacctgggcgtaaggatttccttgtattgcagtttctctacgcgagttgttgcagcaacagacattgggatgacaatgttgttaatatcaaatgagctctctccccttctcctccttactggctgctgctgtaagataaaaattaagtttaaaaggaaggtacaattttacagacatcaaatcattcatctaagagttaaagcaggatcaccaataaccaagcatctgggtccttgggttgaagctgagtaatgaccatagcagctgctcccacctaggagtcagtctccaacagcaaaaaacctcacggagaaataccaggtggtcatgaggagttagtcccattcataagtcccactggtcaccctcttccttcaagggctcatgcgtaaatttcataggggtgggtacctgggatcttaactgttggggttcctactctatatacacctctattaacctcctctccttttacaatctttatttccttcctttatccccgtttatgacttaagactcatagtggcccctcccctaaaagcaatgcttgaaagcttatgctgaaagaggcccaaaggataggcccatctcaatacatcatctaaccttggttgtcatgaatgcacctccttctcaaagatctgaactcttcagctaaatctgcacccaccatctgcccagtctttatgtgatttcccctcttttgatgattcttggggaaagagctgagagctttctagctgtatcaaaggagatgaatggagggaaactaaagaggagaacctgactatacctcacattcctggtgaaaggaaatttgcttctataggaaatagttgagaagaccaaactcttggaaaaataagacttccaaggatcgaatatcagaggcagaggtaagcatctacagtagctgggagactagggaactaaatggcttagtctcttggatggaggaagaagtctactagctgctgctgcccagatagttaataccctatcctgaaacagagactagcaactgagctgtgagaggccagaaggaaacagtggcataacaaacacgctgccatggcaacaaaacagctggaaaacacctaagaggctgcatttatacctaaaccaccaagtgtggtcagtccacagggaaggggttggaggagtaagaagtcccctataactaacccctctatcctctgttcctggacggtgagataccctttattcatcctatcatcttaggacattctcagagaatgttaaaagtcagcacttcctgggccagagtttcagtcactgtcatttataacttcagatgaccacaatgcccttttcacttcaatttctttctctatcaaatcagatgactgccattgacctcagaaatttaggatatctggttaaccaaaatggttaaacagacttttggggatcttgcctgagttctgtagctgaggattagtgatctcatacccagagacctctgccactgccagatctgtgctgaaattatacatcccactacaagaaatgcatcttaagaaagcctcaagagagacagccttcccagtatcttggtcaagaataaatgtgaaactgctggcagaaacaggtatacactttccctgaaacttcttgggcttgttgttagtaccttcgagaaaaagatactggagcaggttgtgggatggttcaacgggctcttatctcatcctctgcctagacacaccccctattatgttagctactcattaggtctaaattaactactatctcctatttagagccagagatagagagcaggtgatgagaataaaactggttcccaaacttggttgtatatcagaagcaacattaaggagtattttttaaaaaaaaaaaaaaggttctaggactcccccccgctcttttataaaatcagaattttgtttgtttgtttgtttaagagatgaggtctcactatgttgtccaggctggactcaatctcctgggctgaagagatcttcctgagtagctggagctacaggcatgcaatatcacagccagcaacaaatcagatctttagaagtgtctggttggttggttttgttttttaaagctgctgaggtgattctgatgcagctactggcttttgggaagcactgacaaaaacactcgctctcctccctacctttctccagtgtcctctggcttctttacttgatttcaaggagagctggccctttgtatccatgggttcaaccaattgtggattgaaaatatttgggggaaaaaaattgtgtctgtactgaaaaggtacagatttttcttttcattattctctaaacaatacagcatactatttttatagcatttacattgcattaggtattatcagtaatctggagatgatttaaagtatatgggatttaaagcatacacataggttatatgcaaatactatgctattttatattagggacatgagcaacaatagcttttgctatctatgggaggtcctggaaccaatccccactgcagatactgcagatactgagagcctgctgttatctggcctatcttctttctttttttttttttgagacgaagtcttgctgcgacgcccaggcttgagtgcaatggcttgatctccgctcactggaacctccgcttcccagttcaagtgattctcctgcctcagagtagctggaactataggcacatgccaccacgcccagttaatttttgtatttttagtagggatagggtttcaccttattggccaggatggtctcgaactcctgacctcaagtgatccacccgcctcagccgcctccccaagtgctgggattataggtgagcgccactgtgcctggcctatcttcttttacataaatccagagtctttgaaaaaacttggcaatgagagagcctcaggggttagcatagtgctatacacaaaatttttactcaataaatggtaaaaatttcaagtgatccaggcctaagttaacattctccagacacagaaatattgaagtgctcaccaagtcctgaatctctgagttcagattttctatcagaattagtttagactcttttttataaatactttggttatctgaaaccctttgctgctggataactgagtatgtgagggacactacacacctatttagataaaatttgtgggttacgggggtaaagaaagtcgaagagcaaagagaccatttggaaaagattgatttgtaacagcaaagagagaacaatgtgaattcctacctgatcacaggagcctagtgagtccattttatgagcttggaagtttcctgatctaggctctgaaggaacttcctaagttgcctctgcaataccctcacccaggcttagcctgtgtagtgtaatggtaaaagagctggctctacagtcaggctgcctgagtttgaatcataattataaccctcacaagttgccttgacagttttcatgcatataaaatgaaatccacagtaccaacctacatctcaaaaggcattataacatgtaacacatgtaaatcactgatcactggtatgtagtaagtgttcaataaacattacagttgcagacttttacatttaccattacattacattgtaattattatacaaaaaggaccctttgagtaggtccatagcagctacaggtatgtatgttccaagagggcacacttgaggaattaaaatattagaatgaaattaaaggaaatgtgtctggaatagctgtgcaaactgcttccagatggagtgtggtatcgtaaaatctggtgtgtgcatgccaaatgtcctgccatgggggcctgctggatctgtaattctgctctgtatacctaaaaagcatggactctgccttctcccttcccttctcttctggtaccctcacgcctagtgtttattcttagtacttcacctccactcacccagagagtaaaaccaaggaaatcaaacactgcttccaacgcccatgggaatctcccctctacccacccctcctctcttgttcacttcttgggccaacaggattagggccacggaactgttgagtcctgtgtgaaacttagtccaacagatcttgaatagtcacagatcaccttaagagtttgtccctgcatcaagctttctatggatggctcagcataaatccatctctgctatgaaaaacaactcaagaaaaacaacagaaggtcaagtaccatgactttgacttaaaaatggtacagacatacatacatatgtcatgatgagctgagatcctataaatgccctgggctttataacccaccctcacactgtcctctggagccacttgagtgagctgtgacctgcagagggggtgtccggccaaccccacacaggtacttaccgatgtgctggctgtaacctgtgagctagagctggcgggtgcaggggaatctgaggaggtggagagctgtcgcaccaagggactgtgtggaggatggtgggtggctgccaagtagctcgaactgctcatgtctgtgtgatgcttcaacactgcagaagtcaacagaaaagagagaaatacatggctatcttaaccagcgttacttctaacacaagcttggaatggcagcaatacatactaaaggcaaaaatgttttctatgcctagaggataaaaaggtgaagcacactagctgtgggaagtaggggcagggcagaggttgctgtagcagttaagaagtgacctccatttagaagcagtagcgtccctctactctgctttcctagaaagtgaaggacaaagctgggggtaattaagagaagcctaggctgccccagaaagccctgagcaggtgcagttgcaggtagaggtgccatgggcctggccctaccttcacttctctcagatgaatggtctcgcaatctcattttgctgtggtttgggtcatgcacgggtggtggtgggttgagcaagcgctctgcttttggcgctgtcactcgctccaccatgggcacggcccccacatcgtctaagtgctgcctgtgggtcctgtcaggccgggtttggtgatgggacagctctgaagaggggaacagaaaaagagctgtgaaatatgtcctctcaaatattttcttattcgagttccaagctctcgagttctctctaggccaacgccgtatacccagggcagcaggacagtccttcaggactgaagtttctagtaatttgcacaatggctaggataggcacagggagcccagaaccagagaaacatgtcaccaggatacagaagacacctgcccgtagatgaactcaatgccatgccattgctggctgttcactgagcattttgggtcttgctccaagatccatggtgtctagaatagctcccgaagtccatctgagagcatccaagacaagcagaagcagtcactgtgagctgaattttttatcggtcaactgcctctcccaaccccaacatgcatgcaaactacaaatttgagaatataaaaggaatgaaaagtcactgatactctgggggacttcccggctccctgacacttactggctgttgttaggaaggagctgaccaatttgtgcctgtccttacgagctgaatctggcagactgcccggcatgggtgctctgtgcttaagcgataactttttgggaggtttgattttgtcaaaaggcttgttctgccactgagatttcagcatgctctggaaatgcaggcttgtgggaacatctgcaagaaacataaaatgctacaggttagtccaaacacctggcctctctagtgttcaagacctacactccatcctcctttaatttgcccagtggcctgacacttggcagggcaagtgctgtcatatggaagatctgtttacgtgaacattactgaaggtcattcttctatttgcaagcaggtcactttagctttttactttcaagtcccaaagggaaacaaaacaagacacctttttggtttggttgatggagtttttgttcttgtatccttgtttgttgaatttactggtttgaaaacatcctgtttctattctagagatttaaaaacatatttaagcctacttcttttctatcaatataaagttaatcaggatgcaattattcaacaatattcattatctatgttatcaggcactgtactgagtactacatactctctccaaataagaactacataccattctctctttccttcctctgtggctccgccaattcccatcatgagattatcggggatttttagctgactggttaatgttcaatatcacaaatcaacatcttttggactgaattttttatgctgtttcttatctttccattttcttagatttttcccaagaatatatccttgagcaattcctttagaaaaggaatttctagatttaaaccattttcctctcaaacatttaaagctattcaattcttccgtgtattctaatatccagtgctatatttaagagggaatcggattctttcttacttgtaggtggtctggtttttgccttttaagcttctgcaaaaaacaacaacaaacttgtggtattacactgactctacagatcaatttggggacaacttccatgtgttccaccaccaatactgaatctttcaatcgactgacgtggtatctctctctccatctatttacgtttgtcttgattttctcttgacagcgtttagttattgttgacataccggtcttaaatacaatttgttaagtttattcctaagaattagtgttttctgatgggcagaagttggaagagtttgcagggttcagaagaagacaggaagatgagggaaagtctggaacttcttagagatttgttaaatggttttgaccaaaatactgatagaaatacgggcagtgaaggccaggctgacaaaagtctcagatggaaatgattaaagatagtaccttttaaaatttcaacttcagttcttcattactagtatatagaagtacaataaactgctatataatgaccttgtagcctgtgaaactacttcgttatagactttttcttgtttattcagtaggattttctatagacataagtacatcatctacaaatggagactgttttaccttttctttccaatctgtattccttttttacttcttgcctattactctgactggaacctctggtgctgatgtacaacttttagattttccttttcatgttttcaatattctgacatttcaccaccatggatagcggtgtgagtctgttttcaagcttctgcaaagctttccagggatattcaaatctaaaagccagcacatttttcctcacctcccagttcctcctgggaatcggtaaccacttggggcatgctcagaagttcccgccagagtccctatccactgcttcagaatagaatgaaacaccactacttcaaggaagaaggctctggtggggtgagaggacaggaaaggaaaatctaacctagctattccaaaatgagtccaaatttatcacccagacaaatgcccaggtcctatcactactccttctgccctttaattctgggtcaaaaacctcctgtaatcagttcccacctcacagcaacttactcctggcatgtgctttgggctatctttctatttatttcttcacagttatcttgtctttatccatctttcaaaaataattacaaattccagtcactgatagcatgtcttctagaactattagaaatttattttgtgtgtgtgtgtgtgtgtgtgtgtgtgtgtgtgtatatttttttttttttgagacggagtcttgctgtcgcccaggctggagtgcagtggtaccatctcggctcactgcaagctccgcttcccgggttcatgccattctcctgcctcagcctcctgagtaggtgggactacaggcacccgccacctcgcccggctagttttctgtattttcagtagagacggggtttcactgtgttagccaggatggtctcgatctcgacctcgtgatccacctgcctcggcctcccaaagtgctgggattacaggcgtgagccactgcacccggcctgtttaatatattttctaaaagcttatggggttttgggtcccatagagcacagaggatatgctcaatctgaactgaggataagaaggcagggaagagacgtctaaattaacattactgaacccattattatctgccaggcactgtgtgtttatcatcatgcgtgtgccacttaatctttgtaacagttccatgaggcaaacacaattatgcttattttaaagatagggaacaggtgcagaaaggtacattaactatgtccaaggttacatagtttaatgagtaacaaccaactttcaaactcaagattatacaaccctaaagcccatactcttagacaatataccttgaggctactcactgatccagaggatggagaggattctgtagtaaagtcaattatttctcaaattactcccaagaaatagacagtacaaaatattttccaagccagttctgcagagtaaaagaaatttagccactcctgcctatggtatagatgatgaatttcatgacactgaatgttatgccttcgaggactgaatgttaggccttccaggactggaataaaaatctgagttggggaaaaaaaaaaaaaaaaaaagctaacattctcagggatgatttttcccagtgggtaagcaccctcagctccatgattgctgggctttatgacagtgaaacaaattaggaaaactattaaagttttaatgaaaacataacatttgctacctgtccaagtgtaaaaacacagtctctgaggacagtgctgtcttctcaaacatttttcataatcactcttttccacacttaaaaactcagctataccaaatcctaggaaataaagcattgtctagaagcattcggccctgtaaaacaatctgaaagctgggctgagctggaatgtataaaagaggctcaagaaaggagacgaggtcacttctgcccatcccacaatacccctttgtcagcagaagagttactcccacttggcaaaggctgtgtatgttttgtatatatatgtaatggaactccaaaaaacatagattttattttttccttttattttcccccatcgttctcccaaatctgaaaatgaagccaggaaaaaaaaaagggacagggatatgagagacctggttatagtgaaaacagcaatgactagaaacaagtaggcctggattcaggtcctggttctatctcgagtagaaggagaaagcaagaacaaatcattcagctgggctttagttccacctgtgaaatgaggcagtggggctagatcagggctggcaacattctagcattcattctctaaccctcctgttgtactggaggtacaaacacagctgtctttcctgttgtactggagacctcagattcttcccaaacaatacattaaataactccagacagttactgtcaattcatttgaataggcacaagaaaggacatctatttgttactgctagattatatgactgctatgagtctctcaactctaaaatgtttagtcaatgactcttcaactggaactccactcctaaacccttcccctcaactaaatgctcttaagtgcaagttggcacattgtagaacccaagtcatggaacactaccttgtactctccagttgacgtattaagcggaatcaagagcgattcctctttaaacccagtataaacagtttaaggaactccagctgctagactttgttagaagtttgctgtgttgccttttaattgcttccatgttaagagtgaacaggaacccagttatatcccccagtcagtaaaaaaaaaaaaaaaagatatcttaggaattgctggttgagttcatatactaactagtaagtgataatacctaggttctgtgaagagttaaaaatctaaaatagactggatacgggacctgaaagtaagcaaaaaaagggatatgaaatggaagagaacacaccagagatccattcagctagaggtctcctacattccatacccacataggtaaactgctattttcagagaagagggtgctgatccttatcaggtaaataacaggaaaataagacgaattactaatgtcatccttaagttactgtttcctcaaacaaaatgaaagatgaatgagaagaccctgacttcaggatgactagggtctgacattccacgattcacctggctgtctggctccttactttccaccattttctcaggcgcactttttccgggtgttttgtaatgctcacttcttcctcctgctgggaagttgctgtagcctcatgtgcagggtttggcaagctctctcaaaataccacagatcttcatggccagcaggtggtgctcttattaagccccttttataaagttaacaagcttttctccaaggttatatatcctctacatttccaactaaggattaactggatttgattacttgaggtgataaaacaaagcccccttcctgctggaatactaacaggttattataccctagtctctccaccttccacagccaggcgtagagttggctataacacagtccctcaatttctatcacccacacacacttaatgagaggggctgaggtacagtcaaggtgcgaggcacaactccaggatgaaaagcagcagttggttgttattctaacaaactacacaaactggttaggaaacagcactaaaactacttaaaaaaatatctgtcctatggggccagaaaacagctaagtatcacattcaaacaattttctgcctttatgtctggtataaatgtaactatatggaatcaatgaatcaaaatcatttttaaccttgttatgaaaaaaaaaaaagttggaaatcctgccactttaaaacatcttctagagaagaggttgtaagggtggcccagtagtaaaatctaccacacaaatgtttgacctacacagtcgtatgccaagctgctagccttcactgttatttactgctatacaatgatgtacagggaatcccaagacttcagggggtgtgttatttacacgggatattatgtgaatggtgccctttggagttggctatctctgcacccatgggaatcttctgatttccaaatggactgcattctgaatgtggcagttgtttgggtcaaagcaaaattattccaacaggaataatattagacatggtaatcaggtcttcaggtcaaccaactgaggtgtaattaatctacaggcaaatacagtagttaatagagcctacatgtaaaaatatatatatatctccacagtctcataaggagaatttaatgaccaactttttcgtccaaaccccagggccatagctagaagctcttcgtgtgtgtgtgagacatagacagaaaaacaaataggattagatgcaggaaaataaaaaccataaagaccagaaaagggggagtgttccctatctttctttccattccccctcattgctgcctgtagttgctctgaatgatggtgtgggaggtgtaaggtatgcggcagggcagcattcatgtcagatctatagtgtcctgcagtcagcaggacagaaaatgttcaagggaaatggaacctcttagtagagatgctgaatgatggaacaggagctgagagacacacagtctgggtatatctgagggtgggggaggttatttgcaactgtatgtggtaatgctgttgacaaagaaatgactgttctgtttagcaggtgatatccaatgagtgtgcttaagtgtccgggcttcctgtccttcttcaagtatgagactatacaattcaacacagtaattcagagagtaacccaacaaacattcctaagtcttcctagtggcgctgtctgtagccagaatcccaaaaagggtaaaaatctgactcctcttaataatctgtctggaaaggaacttgaaatatagtaaaaggaaggacaggcatcagataatctgggtctgaactgtgaaggcattcaaacccattagccatttagttttagataagccacaaccttaccaagcctgttccttgagcactaacactgaagtaacaccttacaaaatttctgggccgggcatggtggctcatgcctataatcccagcactttaggaagccaagatgggtagatcgcttgggcccaagagtttgagaccagcatgggcaacacggggaaacctcttctctactaaaaatgcaaaaaattagccaggcatggtggtgtgcacctgtagtcccagctacccactgaagtgggagaatcacctgatcctgggaggccgatgctgcaatgagccaaaaaccacaccactgcattctagcctgagtgacagagtgagactctgtcaaaaaaaaaaaaaaaaaaaaaaaaaaaaaaagccaggtgcggtggctcatgcttgtaatcccagcactttgggaggccaagacgggtggatcacgaggtcaggagttcaagaccctcctggccaatatggtgaaacccccatctctactaaaagtacaaaaattagccgggcgtggtggcgcgtgcctgtagtcccagctactcaggaggctgaggcaggagaattgcttgaacttgggaggcggaggttgcagtgacccgagattgcacgactgcactccagcctgggtgacagagcaaaactgtctcaaaagtaaaaaaaaaaaaaaaaaagaattttgaaagcagcatatgagacaaatatgagaagagtactacaaactttaaaatgctatacaaatagtaactgcagttacatgggctacataaatccaatggcaagggaaggtaaaagtcagtgactctggaatctgaagcacagaggaaaatgttttagtgttttccactcattgtgttcaagtttatttattgctccaccagctcctgactatccatgtgttccaggttttctgtttcctttctcttacaagaaatcacatggccacaggaatattacaccacatccttatcacagctagggggttttggtaacaaaagccaaaaatcccggtatctactggatttaggtggccagaaatgcaatcatttgaagaacagatgcagaacaggggattatagttatctaatatttgatcaactgtcaattagaaggattctctctaggacaagggttagcaatgattgtttttataaataaacttttgttgcaacacaatcaggttcatttgttcacatattgtctatggctgcttttgtgctacaatgacagggttgagcagttgtgacatgaactgacatcaattatatggcctgcaaagcctaagatatttaccatatggcccttgaagaaaaagttcaggccgggcgtggtggtttacacctgtaatcccagcactttgagaggccaagatgggtggatcacttgagctcagttcaaaaccagcctgggcaatatagcaagaccccatctttgtagggggcgggaggcggggaagcaggttgtggtggtgcacacttgtagtcccagatacttaggaggctgaagtgggaggactgtttagagcccaggaagtcaaggttgcagtgagctgtgatcactccactgaactccagcttagggcaccgagcaagaccctgtatctaaaaaataaaaattaaaaaaaaaaaaaaaaaaaaaaaaaaacttacagactacctgggagatattatgaagaacagcatggagcccttatcctcagggagattacatcccatcccttccccactccccccgccaccaagacagggtctcactaccgttccccaggctgcagtgcattggctcaatcatggctcactgcggccaagacttcctgggctcagctgatcctcccacctcagcctgctgagtagctgggacgacaggcgtgtgccaccacgcccagttaattcttgtgtttttagtagagatagggttttgccatgttgcccatgctggtctcaaacttctgacctcagatgatgaacccgccacggcctccaaaagtgccaggattacaggtgtgagccactgtgcctggtccctaaaatttaaataacagaaagcaaatacacaaacagccataacataattcattaacatattgataaaacacaatagggtaggtgcagtggctcctgactgtaatcccagcactttagggaggccgaggcgggtggatcacctgaggtcaggagttggagaccagcctggccaacatggtaaaaccccatctctactaaaaatacaaaaaaattagccaggcgtggtggcatacgactgtagtcccagctacttgggaggctgagacaaaactgcttgaacccaggaggtgggggctgcagtgagccaacatcacaccactgcactacagcctgggcaacaaaagcgagactctgtctcaaaacaaaacaacaacaaaaacaaaaacccaccagtgatttgagaggaaattcctaccttctgtaggctgggcacagatcatgagattacgtgaaaattcaatgaaaccaatccagattatgaaagcgctggcttccatctagaatagtggtttcaaaatgtctttgctcatgcacccccatttgatatgtgatttttaaaaaatcataatttcagatagttgtaaagattatatttgaatactacataatgctttaaaaacatttttatcaaaactttggcatgtaaatatatttagcttcattaattgaaaaaaaaaacttcttttaaacttatttagctaatcagactttagatattaactcagtatttattctaagacagacaaggaataggaccatgtaactgagctcagacccatcccagccactcgaagagttagagggaaatctcttagttgcaatcttttagtggtaccctctggtttggtagatctgttgcagtctttttggagaattctaagagaagacttggttgataggagttcctgagttatctctattttatttttaaaattcaaaacttttttgcttaatacctgggagattctccttcaggtgctgagaactcttagaaatgatctctttatttgttgtccccaccatccaagacctttttttttttttttttttttttttgagacagtcttgctctgtcgcccgagctggagtgcagtggcatgatcttgactcactgcgacctctggcctccaggttcaagcgattctcctcccaaataactgggattacagacatatgccaccacgccctgctaatttttgtatttttagtagagaaggggtttcaccatgttggccaggctggtctcgaactcctgatctcatgatccgcccgtcttggcctcccaaagtgctgggattacaagcgtgagccaccacacctggtctcgaactcctgacctcaagtgatctgcctgccttggtctcccaaagtgacgggattaaagacgtgggccacgacaccgagcctcaagatttttacactctggggcaagacccatagtgggactcaatatggccaaaaggaatgctcttcttttgtcaagtgggagaggtacaggtatgggaagggaggtgggaaaggagggctgtcagacacagagatttaacagggaggcaaactttagaaagacagtacaagctaacaacgaagatttgtgcttatctacaccctgcaaagctgtcgcgttaccacataaatgccagtatgaagatattctcctagaacactgccgtccatcctacattatatcatggcacgcacagacaaaacttttttttttttttgagacagagtcttgctctgttatccaggctagagtgcaatggtgcaatcttggctcactgcaacctctgcctcccaggttcaagcaattctcctgccttagcctcccaagtagctgggattacagacaggcacaaccacgactggctaattttttatatttagtagagacggtggtttcaccatgttggtcaggctggtctagaactcctgacctcaggtgatccgtccacctcagcctcccaaagtgctgggattacaggcgtgacccaccacgcctggcccagacaaaacatttttaaagatatactaagcgtattttggaccagattactgtggctagaggcaactgagcccagatccctcctagctacttgaagagttagaaggaaatctcatattaagttgcaaccttttagtggcaccttctggtttggtggatctgttacagtctttttgcaaaattctaagagaagacttggttgacgaaagttgtaccttgaaagtatctgagttgtaactgcaccttggctgattttctttcacctagaagtctctcaagtttctttcattagactttctagtctgtggtctttcttaccatctggaaatgctagaacaggatgaacacaagagtccaactgggaaagacgttccaacagaggggcttcatagtgaatttcgggaggcatggtgttgatgctgcctgaaccacacagtgcgcaggagggattcacatcacagccagggcggattgtgctgttccggtgaacctgtgaaaaaagccaaacaaaactgacaattcagcatctgataaaaagccagctacccatttgttatccccatttgttattgagaagttagctccccatttgttattgcgaagacctttctagatacttgtgtgacactactaaaaggatgtttgattagtttgttaaaagatttccatttgtctaacacactgaccttcaaagtgggtaaggaaacttgcttccttttcattgatgaaatctaactacttgaagctctaagtgcttacctaggtatcaaacttctgacagtttaaaaagatactaaaactgtgctttctgagaacactttataaactctgcatgctttcacgaccttgatggtccgctaagacgaacagttggttcttgattcccaggtgggacattacttgctttcttcagcaaatttatccacctaggagccttcaattaccaaccacacctcttctcttcttttcacacctcttcttcaaaagactttcaggtggtctcaagccaggtggcaagcttccctgaagcttgtaacttaaaagtaacttattaactactctttaacctggcctaaaatccactgttacaaagctcatacctaagtaataaaataacattttgtacagcaaatgctcactttcatagtcttcatgttagattaattccaaagggtagaaattatttccactgaacttcctttgtgcacatgtgggcagaataattgataacctctccaggtaagtccaaagttaaatatgaactaatttaagtcttcaaaagattgaattctgtataaaaactgaacatctacaattttatactttgagcaaatttcaggtcatgctgaatgcaggatccctacattctagtgttaggatgaacaagtctggcatttgccaaagcctaactcataaagtcacctggacacacagccccagaaaaagaaacttgcatgttgaatggcactataagaaggcatcctaggtgcaagctcagtagtagaacaaagacaaaaagcatcaaaactctactagcaaaaactctaacatttactagagctccatttattttcagcagagacatctcgaaagccttttatggatttgtgtaagagaaagatatacataagaacaatgtggtctttatcaacattcccccgacattctattgtaaccacatagagaggtggcacgcaaataaagtcttttaaaggttagactgggcaaatcacacagaactagaagccactgaaagggagtgataccaactaggcatgctacttttgtgtagacaatattaactggtattgttttgggaaaaaaaaaatccctgtatctatgtaatcagagctggctttctggagaggatgacattttgaggtaaagagaaatgagtaggtagagatgaaaatgagatcacacagtgggtgagtgggaggatttaggaaaattggttaggatccaaaaattacactgaaactttcaatattcaaaagagattatctcactccagtaggtatagcaaataaaaaataaaaagagagagactagaaaccaacccatgacatcaactagctctccatatgggacatttaacaacactacattttatggctagagtgtatcacttaagtcaaagtcaatattgggaggccaaggcgggtggatcacttgaggtcaggagtttgagactagcctggccaacatggtgaaaccccgactctactgaaaatagaaacgtcagctgggtgtggtggtgggagcctgtaatctcagctactcgggaggctgaggcaggagaatcgcttgaatctgggaggcagaggttgcagtgagctgagatcacaccactgcactccagcctgggcgacagaatgagactaagtccaaagacaagcaaacaaacaaaaaaacaaaacaacaacaataaaaaaattcaatagatgtggctaggcgtggtggctcacaactgtaatcccaaaactttgaggtgggagagaggattgcttgaagccaggagtctgagactagcctgggcaacacagtaagactccatctcttaaaataaaatttaaaattaaaaaaaaaaaaaaaaaaaaaatttagcccagcatggtattgcatgcctttagtcccagctactcaggaggctgagggagaagaatcgcttaagcccaggagttcaggttatagtgagccatgattgcaccactgcactgcagcctgggaaaaagagtaagatcctgtctccaaaaaaaaaaaaaaaaaaaaaaaaggctgcgcatggtggctcacgcctgtaatcccagtactttgggaggccaaggtgggtggataacctgaggtcaggagttcgagaccagcctggccaacatggtgaaaccccgtctctactaaaaatacaaaaaactgggcatggtggtgggcacctgtaatcccagctactggagaggctggtaagagaatcacttgaacctgggaggcagaggttgcagtgagctgagattgcaccactgcactccagcctggggaacaagagcaaaactccgtctccaaaaaaatttaaaaatttaaaaaaataaaataaagggtagaaattctacttataacttgacaaaagggtaatgtgcacacatgtaacttaaacagtaatctcacttttaaattaaaaactgtaaagtactaatagaacccgaggagtatataaaaatatatttaatacttattttttttttgagacagagtcttgctctgtcacccaggctggagtgcagtggcgcaagtctgccttccaggttcacaccattctcctgcctcagcctctcaagtagctgggactacaggcgcccaccaccacacccagctaatatttttgtatttttttagtagagacagggtttcaccattgttagccaggatggtcttgatctcctgacctcgtgatctgcccgcctcggcctcccaaatgctgggattataggcatgagccaccgcacccggccaaagatatatttaatacttattaaaggatacattttggaaaatttttgaaagaaaacttgaattcatacccatgttgcacaaatccacaccaagaatctatcctgcagacaaacttaagtgtacacacgcacacgctcttccactgaaacaagatgccaaatcatctgcatgaattcatttaagttaaaaaacaacaagaacacacacaatattgtgttttacaataagaaaacaaatttttaaaaatatcacaacagatggtgtgcacgtgtagccctagctatttgggaggctgaggtggctcacttgagcccaggagtgaggagctatagtgatcatgtccactgcactccaggcctgggagacagagtgagtcagtctcttaaaagaaaaaaaaaacaaggatctcctgggctcaagagattcttctgccttagcctaccaagtagctgggattgcaggcatgcaccaccacgcccagctaatcttttatatttttagtagagacggggtttcaccacgttggccaggctggtctcaaactcctgacctcagatgatccacccgtatcagcttcccaaagtgctgggattacaggcgtgagccatcgcgaccggtcccagtcatgaaatcctattggcagaatccaaccacttcataccacctcaactacactcaatctagtccaagtcactatcttttctcaaatgggtttcttcaagcctcctaactgatcctcctcctactggttcttacttccaaatcaatcaacacagtaatcagtgtaaatcttgttttaaaatctcaatcacatcataccaacctcataatcttccaaatgacttctcatctcacgaggaatagaaaccaaacttcttgcatggttcccacaaggtcctatagtatttgtcgcctctatcccctctctctgacttcacctcatttttttgttactctcctagctgacactaccagttactctgatttccttgctatatttctccaagatagcaggcaaccttccagatcacaggcctctgcacttggctcttcaaccactaattccatggtcattctctcacatcgtgtctttttctttaaatgtcagtattcaaagtaactttttttttttttttgagatggagtctcgctgtcgcccaggctggagtgcagtggtgggatctcagctcactgcaagctacgcctcctagcttcatgccattctcctatctcagcctcccgagtagctgggactataggcgcccgccacaacacctgactaatgtttgtattttttgtagagacagggtttcacggtgttagccaggatggtctcgatctcctgacctcgtgatccgcctgcctcagcttcccaaagtgctgggattacagacgtgagccaccgtgtccggcccaaagtaagttttatttagaaatacaagtgaaaggccaggcgcggtggctcacgcctgtattcccagcactttgggaagccaaggcaggtggatcacctgaggttaggagttcaagaccagcctgaccaacatggtgaaacctcatctctactaaaaatacaaaaaattagccgggcatggtggcgggcgcctgtaatcccagctactcgggaggctgaggcagaagaatcgcttgaacccaggaggcagacgttacagtgagctgagatcgcaccactgcactccagcctgggcgacaagagcaaaactccctctcaaaaaaaaaaaaaagtgaaaaaagattatattcttgactgtaacaacaaaaaatgccctggaataagtttaacaagaaatttaagcacaaagcttaaagatattgatattctacaaattaatgcagaatcttaatagacttgaggggggaggggagacaaggcaaaggggatttaaacaaataatctaaaagatacaactgaaagaatgtaaggaaccattccccaaaatttctgataagcaaaaatacaggggagtgatctggcctattacatgttttatagttacagtaattaaaataatctgccctcggttaagaaacagaaaatttaaataaaaacaaaaattgaccaaagtatatatgacagtttattgtttaactaaaataatacttttaaatcagtttaaaaaaacaaaaggaggtattactttttcaacaaatgaatcaggaaaaccaagaggtcatacagaagaaaacggctgcatttctgcctcacaccaaaattaattctaaataaagatttattcattttcattttattttatttttttgatacagagtctcgctctgttgcccaggctagagtgcaatggtgcgatctcggctcactgcaacctccatctccgggttcaagtgattctcctgccttagcctcccaagtaggtgggattacaggcacccaccaccaagcctggctaatttctgtatttttagtagagacgggggtttcgccatgctggcaaggttggtctcaaactcctgacctcaggtaatccacccaccttggcctcccaaagtgctagaataacaagtgtgagccaccgtgcctggccccaaataaagatttaaatataaaaacaaatattatactcaaatctaaaaaaaaaaaaattgtgaagcaatatatagtggttaacagtatgagctgtggagccagactgcctgggtttgaaccttgactccgccacttactagctgtgtggccttaagacaagttactgtgtcttcatctttactaacaggagagtacctgatagagttgttttaaagataaataactcacaacagtatctggctctcgactcttaatcacttttgtaaaaccgtaagtatagctactgatagaacatttaccatcaaacttgatagaacatttaccatcaaagatcttgatttcaaaattctagcttcttaacactgtataatatgatcattgataagtcacatgacatccttaaattttctcacttgttaaaaaggactaataataccaatttcatgggagtgtaggaaagatcaaatgactctgtaactgttaaaacattacacaaatgttagctaaattagtataccgcatgatttctcaacagctggcacttctttgttgtggggcacagtcctgtgcactgtagatatctagcagcatctctgtcctcatggtgcatgtgcctccctactcccccaatttgtgaaaatgagtaattactacagatattgccaaatgtctcctgtgaggacaaaatcactgagaaccatgaggttcaaattacggtcatcccgtctagaaaaattcaaagcacaggctcccattaaatattagtggtgagtcacagtaaacataagactcagtaaaaaaggaaaacaaaaaaaataaaaattaatagtaagaacaaagctctcaaagactattgtcaagaacaagcctgaagagagcttcccctaccaaagatcagataacgttagcatcataaagaaaagactacaatggcttgaaatacctcaaatatgtttcaatcaatgactcacagccccttcatgaaaaacttcagtgactgtccttagaggatagtagaaaactaatttgttattttgaaaattggtaaataaaaaaaaacaacaaatcatgctttcttctgtacaaactgtacctcagggtaaacaaatagttgaaaaggacaattttccctttataaacatattctatctagctaataaaagaaaaacagaaatgatacaagtagaatatcaccattcttcagcttccaatttaacaatgggtccaggcaatgatcaccagtggttgataacaaacagtttagtcattacgtgtcttctgatacaagcataaggcggccaccttgtgttttctcacgaaactaaaactggacttattcacgtttctactagttttcaagaaaaacaagggacagaaaaacatcactgttttttaaatgcactaaaaataagatggattaataaatggaaggatgattgtatgctaaaatgttagtggtagaacctagggagtagctacataggtgttcactgtaaaattcattcaacttcgtatctgaataatttcataacaaaatttggaaaagaaaacagtgacaccacaggacttctgcttctagcagagtaatagtgatcagatttacctttcagtcataaaccagaaaactggacaacaggcagtataacactgagaaataaatggggtggtctctaagactgccctggttttccgtctggaagtacattctagactgcagggcagggagaggatctgaagcagagtataatagcttcactgagttgaggaagcaaattctcactagatcagaattcagagactaaggaaactgaaaattgcaaggcaaaattcttgagaggaggaagctttacagaaaaagagccccagaaatcttcataagatccccctgagtgtttgctaaatattaaaaggtgcatgtaaagggtgaaactatcaggccaggcaagagcaactaggcagctgtgagctgaaatggtttccacagctaacacaagcctgagaggcttttaaactgtgaccagccaaagttgcatagagaattcaagacagaagatcctgctttagttgtggagctagactactaaggtggccaactcctcacctgacctaacaaatgacaaggaatttacctgccagcaaaacaaagcctctttaaaggaagatggcacaatccacatgctacaagcagggaaaattattaattggattttcagcttaaaacataaataaaacattgttagatatgccaagaggcaagaaaatactactatagggataaaatttttaaaagaaagtaggctgtgggaaactaaggtatcagataaatgaagttttctcaacaaataaatcacctatatggatagtttgtatcaaaccaacactctcactaattggaaaagccagatttaaaacacacacacacacacacacactctctctctctctctctctctctctctctctcaaaacataagaaaaatgctgacataatgacaatattgaaagctaagattccagagaggaaaagaacctggccaacatggcgaaaacccatctctactaaaaacacaaaaattagctaggcatggtggcacgtgtctgtaatctcagctacttgctgaggcaggagaatcgcttgaacctgggagatggaggtttcagtgagccaaggatgtgccactgcactccagcctgggcaacagagcgagactccatctcggaaaaaaaaaaaaagaaagaaagaaaaaaaaaagagcagagcttttggtactcttgtagggctgaatggataacactagagacttgaaatgtcaaattatcaataaaaagaggacagggaactaagcatgacacacttccaagtaccaccctcccaaagaaatagctgaagttgtgaatggtaggaggctacaaagctaagtggaaagtctctgaaaagggcagagatgtttctggcagtctcgtgaggagactagaattagatctcaggatatgctaagaggaaaggaggctgggcacagtggctcacacctgtaatcccagcactttgggaggctgaggcgggcagaccacctaaggtcaggagttcgaaaccagcttggccaacatggtgaaaccccgtctctactaaaaatacaaaaattagctgggcatggtagcacgcgcctgtagtcccagctacttggaaggctgaggcaggaaggagaatcatatgaacccgggaggcagacgttgcagtgagccaagatcatgccattgcacttcagcctgggtgacagagcgaggcgaggctctgactccaaaaaaaaaaaaaaaaaaaagagagagagagagagagagagagagagaaaaggaaactgatcaacacatgttctcagctggaactaagagagagaaacagactgttatctttttgagacagagtctagctctgctgcccagactggagtgcagtagcttgatcttgactcactgcaacctctgcctcccagcttcaaaccattcacctgcctcagccacctgtgtagctgccaccacagctggcttttttatttttgagatgaagagattgcaccactgcactccagcctggcgacagagcgagactccatcttgggggaggggagggggacaaaaaacaaacaacaacaacaaaaaatcagcctgtgcaacacagtgagacctgcatctcaataaaataatgagataaaatacttgatacacgaagaaattcccacgttcccttaattaatactgcaatgctatcaattctctttgaaggaattcccaagaaatactcaatttaatacttatgaaggaattaataccaaagtaaaactctattcaccattttctgttaatcatagcatattcgtccaaaacactaaaagaattcttttggctcaaggacaggttataatcatttgcttttgctttgcatttgatattcgttatctaactcatccactgttaacatgtggaaagattttcaaaggtttggcaactctatcacaatcaagcatatcccacaactggctcttgaagatccatcagagtgaagaaacaaaacgtgtaagcttctattttatctcagtctttcaaaatttattttgtatgtgttttataatgtatatataaaacaccgtcataacagtttagaggtaactgttccaagcacagagtgatttctgagtattcttttagtagctttatgtcctaaggtacaattttctacatggcatgcttgctcctttccaaatgtctaactagtatgaaaaagttggttgggcctccaaggtctattgcactctgtcaaggaagaacgtatcaaattattaacttttaatactgactcatattctagttcattagtcctcaaccatggtgtcatgaaactggatttaaataggtggaatcaaaactaggaggcctagaatcatatattaacacctttatttaccctgatgtctacaggaaacctggtcatagccatgagagaatgccctgtacaaaaatgtcactcttcaagtgtgatacaatgggaagaagaggaggactactcggaattctatggaagccagctttaaaatttggcccagagcaatcccccctatgacaacaaggactacaaaattctaaaatgatgccagtacactgccaatttgttaggaaattgctactttttaaaaaattgaaagaaatgctattaagggcaataaaaatttcaagggtatgttagtaataaatgtagccattacctattctactggttattagtacaaaaaaacccagccttttcaaccattcatttccaaacactgatggtttccactgccagactatacacaagtttctaatggtccacagtaaattgagaatgagaacaatgcagtaaattattaataaaactacattcttttcttttttaaaaaaatactatttgtcttatggtttaattataaacataattttacttaaaaaataaaaagcaaccttatttgaaaattggctggtaccaattttattttaataactttattgatctgaaatcttagtacgtttaggttaagttataaacacctacttcacttaggcactgggccaggaaaagaacataatggcatataagaactttccactggagtgcttcttcattcacttagataattactaacatccaccatactagacccctaaagtgatgaaacacacaataaatagcaatataggctattcagtaattacaactagtaattccgtcattttataataaaattatgatttaggaagtactccatgttctccatgagccttactctgatattcacttaccacaccctagtggttattccttagattacatttaaaatattccacattcagagttgtagaggccttagactattatctcctccaggattactactgttagtctgtctttccacctccagtctcttgtgccaatccatcccaaacataatagttacagattggccgggcgcggtggctcacgcctgtaatcccagcactttgggaggccaaggcggatggatcagctgaagtcaggagttcgagaccagcctggccaacatggtgaaaccttgtctctactaaaaatacaaatattagccaggcgtcgtcgtgggtgcctgtgatcccagctactcaggaggctgaggcaggaaaattgcttgaacccgggaggcggaggctgcagtgagctgagattgtgccattgcactccagcctgggtgacagatcaagactccgactcaaaaaaaaaaaaaaaaacaaacaaacaaaaaaaaaaaaaaaaacatgttacagcagatttacctcccccaaaatagcttacaacacttctctgctcaaaaatttaaaacttatagactgaaacccaaatcatcagtttgggcattcaaggcttcctatttatttactgatagatctcatttctctttattcccaacgagtttaacttactgaacactttgttttagtcattgattttaagaagtacaagtgatataacaacagctttttttttttttttttttttttttagatggactctcactctctcaccaggctggagtgctgtggcgagatctcagctcactgcaacctctgacttcttggttcaagcgattctccagccccagcctctcgagtagctgggattacaggcacgtgccaccacgcccagctaatttttgtatttttagtagagatggggtttcatcatgttggccagggtggtcttgatctcctgacctcatgatctgccccaccttggcctcccaaagtgctgggattacaggcatgagccactgtgcctggccagcctttttaagggcaaaagagttactgcactaaacgtgcatctcaattttaagatatattccagccataattcaactaagctgatagccctttaaaaacacagtaattgggctgggtgtggtggctcacgcctgtaatcccagcactttgggaggccgaggcgggtggatcacttgaggtcaggagttcgagaccagtctggccaacacggtgaaacctcatctctactaaaaatacaaaaaatagctgggcgtggtggcgtatgcctgtaaccccagctactcgggagaatgaggcaggagaatcgcttgaacccgggaggaggaggttgcagtgagccgagatcgcaccattgcactccagcctgagcaacagagcaagactccatctcaaagaaaaaacaaaacaaaacaaaacctcaatgagttccctcaagtatgttttatttggttctggaatgcagtagagatcatttaagatgcaggtaaggaaaaaatattaatcacttgctttgtgtgttctgtactctgtactcacaataactgtgaactcactgtcatgtaacaatattagaacataatttacctgttaacttctttgctgtcattagaaagtaagctccatgaagataagggctttgttttccttaccaatgcaacctggctgccctgaataatacggtgggcattcaaaaatgctgttgaataaatctgtctggaaaaccgagcaattcaagatgacagaagacaagatgcttgctcatcagcaaataccactgaggtcatgtcatgagtgaggagccatgtgagacacagaaagcaacctagacagaaggaatggggtgtgtctctaactctggaagaactccagctttctgctagatctagtacatggtatatttcccaaagtcaactaatttctctgtcttatttttcatgcagcttacttttgtgtcaggatgattctgttttagaaagtggcattggaacaaaaggatatttagttttatgcctatctcttgcctaagctaccttttataattttatatgtacattcaaaactacattcgttcttaggcatggatcagaagaaggttggctacttcacatattaaaaaacaaaatccaggaggccaccacatacttcagaaaatttttatacgactcctgatgtcatgccatagtggctggtaaactgccaaaacagaggaagggtgctttattttcatgaggtggcggttttttttttttttttaaaatgtaaaagcattctgtgttaaattcatcaaggaattgacaaaaagctattttcctacacttgacagtaatatactgttttctgacattcctgttatcaactcctctgaaaatcttttagagatatacgactattagtaaaaaaaaaaaaaaaaaaacaaaaaaaaaactgagactgaaatgtcaatatgaaaaccctgccaaataccttattcttatctatttctgctattttgatatttcaggtagagtccgaggaatagacaggaagaaatggtatcgcctgacagtcaattctacaattcttttctttaaagagaacatggcaaacttacacagtacaactgcatactagaataaaacaaggaaagtactgaaaattcaccatgcaaatactaattgttccagcaattctctcatctcccttatttgtcattagcaaatatgttgctagtggctctcttaagaaaaattcccattctctgctctcttttacagcaacattctttgaaaatgttatctacaatggttccctcaattccttctgtggccttgtctcctgaaaccactccaaccatgctttaattcacctttctccctctaccaaaactgctcaccaatgtctgcaacaaccccaccccactaaattcaatggtctcaattctcagccttcatcttactgatcctgtctgtaacaactgacacagacaatccctcctcctcctccctctccaaaacactttctccccttgcctttcacataccacactctcttggtttttcttctactttattcgtcactcccttcccaatcctttcctcatctttcacaggaatgaggaggaatacctaagctctggaatacatcaaagggctaatccatatacctcttctttatctgagctctccagcactctctattccctcctctattgcatttctctctccaggattttttttaattaattaattttttattattattatactttaagttttagggtacatgtgcacaacgtgcaggttagttacatatgtatacgtgtgttttttttgtttgtttttttgtttttttaaaagacagagtctcaatcactctgtcatccaggctggagtgcagtggcacaaccatggttcactgcagtgtcaacctggtgggctcaaatgatcctcccgcctcagcctcctgagcaaatggactacacacgctcgcccacagcaggctttttttttttttaaagatatggggtctcactatgttgcccagactggtctcaaactcctgaacgcaagtgatcctccttcctcagcctcccaaagtgccaggattacaggtatgagccactgtgcctagcctctctccaagatttaatgctataggacacactgcagagttcatttattattttctttctcttaacaactagaatatttcatagggtaagcacttttgtctgttttgtttagtgttgtatacccagtgactagacagatttagctcgttgcaggaagccaataaatatttgttgaaagaatgaatgaacaacaacaaaagtggtaacaataacagccactttgtacgaggaacttatcaaccagacatcccaataagcatgttacatatatttcattgaaccctcaaacaaccctatgagatctctgaggctttggagaggagtggaagtcagggtggttaacatgcaccaaattaccaaactactaagtggtagtaccatgattcaaacccaaggttatcatcttcaaagataatgctcttaattcctgcacagtaccaattttactggaatattattatctcattagttttggaataaaggcaactgctatttgaagagtcagcaatctaaaattccctacagttgtgaattaatctccatttcctttgtgaagacaaacttttttttagtaatatcaatttaaaaactttagtgaagattcctttttttctcaggcagggtctcactctgtcacccaagcttaagtacagtggcacaaatacagctcaaagcagcctcaaccttatgggttcaagcaatcctgcctcggcctcctgaatagctgggactacaggtgtgcaccaccatgcttaatttttaaatactttgtagagatgaaggtctcactatattttccaggctggtattcaattcctaggctcaagcaatcctcctgccttggcctcccgaagtgttgggattacaggcatgagccactgcacatggccaagattcttttttagggcaaaggattctatactgccattttcagtgataacagtgaaggtgagagggcacactattctccttcaaagtgttaagggcagtacttaaactttcagtctctcccatttctattaaaaagctcaagacagtggttttcaaaactagctgcagagtcaccgaggagctttgtgttttctgaaaacaagattccaacatccaactccagagcaaacagggcccaggaacctagtattttataaagctccccagaagaccttggtggttagccaagtttagaaaacaccaaagttggcaagagactaactctatctgagcatctggctcactgcttgacaatgaccaactctcatctgtaccgaccttcttggaaagaggaacgatgctgttgggtcgaacaagcctccgcttcttacagctcagtacaggacgtgtccgggctgccacacaggtgccatcagatgatgaagagacgagattcagtcgttgcttcttatgtaattgttcctcagcatcagagctgtcacctggaatgtggtctgccaagacaggctgaagactatacaaggggaaggaagagtattctcagaacacacaaagaaacaaaataaataaacaacaagaaaacacaaagaaacaaagcctcttatactagttcaacctctatttgctaatgttcagacacaaagaagcattctagagcagaagcaggtctcctcttgatgtctgttaatctacctgtgtgtgcttatgtgtaaggttcttggtgcacattaactacatcatgtctgaaagataaaagtcaataaataaactcaagttctagtgattgagttctcctctacatcaaacacacgagtaaataaagtctagagaactacagttggttagaaaatgatgaattttgcaaatgttaatgggcttccttagaatcagttctatgaaacccgaattttaagggtgttgtacacatcattcacttgtacagaatctccctgaatcttttgttttctcccttgaatcttcataaatacagatttacaaacatagcccttggagatctaatctgtcctaagcagaggaggttaatataagcacttctgaggaattcctgcaagattaaaacaataataattcacagtaactgtagtgtcttttattttactccatgcccactccattttagtaggtaaaaggaaaatatacaattaattaaaatgcactgcttcattatacagtgaagattaaaaatgttactaagtgataaggcttccgcttctttaaaccagggtcagtcctggctaaagagaactaagagctccaaaacacctttacaagtctactaagtgtaggaagtagaagagctaaaacttacgtgttaataactccattgacaggtctgagtgctccacatgatttggtagacagtgactctgaaatatgaccaataataggggcaccatggttttccaatggctgagaaacagactcaatctgattaagaaaaaggaaaaaagaaattaacatgtacccaagcgcacccctgcctgaaaagcaccaccacttcatttgcacaaagcacctaaaacttctgatgatcaatttgaaaaacacaacttgaatgactgaagaaaaagaaaataagagaatcagtggtcaggtatgatggctcgcaactataattgcagcactttgggaggccaaggcaggaggatcgcttgagaccaggagttttgagaccagcctgggcaacacagcgagacctcatctctaattaaaaagagagagagagaggttgacagagagaaggagaatattatattagcttttgctttggggggaagagggatgaggaatccaaatgtacagactaaaagtaagtacctattgacaggaaaatgacctcaataattctatggaacagaagcttagcaaaacaattacacagtaacataagctttcaactaatgatcaagaaggatatactaacatcagtatcaagatgactaagaggaaatttaaatgtagttaatatctgcttaactctaacagagtatgctagaagcttgttttctaaaaactatgctttgtttaaaaatatacacacaggccggggatggtggctcatgactgtaaccccagtattttgagaggcaaaggtaggaggatctcttgagcccaggggttcaagaccagcctgggcaacatgacaaaaccccatctctacaacaaaaaaatacaaaattagccgggcatggtggtgcgtgcatgtagtcccagctactcaggaggctgaggtgggaggaggatcacctgagccaggaggcagaggctgcagtgagccatgatcatgccactgcactccagcctgggtgacagagtgagaccctgtctcaatgaataaataaataaataaacacacacacacatttttccctgacagaaaacaaagttaataaaatctcaatgaatctaattatctgatgctatcagatactaactattgtctttagagtattcaaatcaaatatgtttagaatataaaatgaaataacagatgagaaagaatagaaaaagtgtgatttgcagtattcaaaacaaattatatatttactaggctcaaaacggataggaacagtatgaatgccagtcatatagcacctctgaggtataggcaataaagcaacagatgcagctatccctcagttctagcaattgttgaactatcccagaaaggctatgggtctttgactccttactttatttttttgagatgaagtctcgctatcccgcccaagctggagtgcagtggcatgatagcagctcaccgtagcctccacctccctggttcaagcgattctcctgctttggcctcctgagtagctgggattacaggcacacactaccatgctcatgtaatttttgtatttttagtagagatggggtttcaccatgttggccaggctgttcttgaacttctgacctcaactgatctgccctcctcggcctcccaaaatgctgggattataggcgtgtgagccaccacacctaacctgtctccttacacttgaactgactctggggcacgctgaagttctctttcctataaaagctttcaaggtaaatattcctataaatgcttcctacaaatgctttcaaggtaaatattttgaggctgaaattctacttttcaatactgatttcttttgtctttatacccccaaggataaaacaccaaaggactgaacctgaaagtagtcctagacaagcatcaaaaagaacagactgaggctgggtgtggtggctcatgcctgtaatcccagcactttgggaggctgaagcaggcagatcacctgaggtcaggagttcgagaccaacctagccaacatggtaaaatcccatttctactaaaaatacaaaattagttgggcatggtggcgcctgtctgtaatcccagctcctccgggaggctgaggcacaagaatcacttgaacccaggaagtggaggttgcagtgagccaaatcacgccactgcactgcagcctgggaaagagagagagagagactgtctccaaaacaaaacaaaacaaaaaacaaacaaaaacaaaaaacagattgggaagataatctaaaagttttaatacaaattatcctaaaatacagatcaaactatatacacagacaagtcatataagtatgctacaatgagtgaacaccgagaaaaggctgtcttttttgttggatatcctgtacatctactaagatatcacaaacatcttgaacaattgtcaatgctatcaaaaattacagtaaatctggcatagacacattgccttaagctctatgcagatttcccttggaaagaaacacggtattaagcagcaagagctataaggatattcctatcttctgacaaaatattctaaccaatttttaaaaatctaccctaaaggagtaactcaacaaacacagccccaaaaatcttattcacaaaggtggtcactgcaatgatatctatcaataatctaaatgttgtaagcattataactatagttatcagttgtggtacaccaaatcaaaatattaaaaagaatcataaaggatatttcttctcttatggaagaagagatttcaagagaaaaaaataatagtttaatatagttgtagtgactaaaaatatacatacacagataacaacaagacaaagagtgttacagttgtaaaactattctgaaattttctttacattttaggtaatagttttatattaaaaagaaacccccataaaaccaaataccctcctgaatgctagtaaggatttactacacaggggaaacctcaaaaaggctaaacaaatatggtatgacaaagaacaagaaaaatcaaaagaatttaagattcaggttggtattaactaacagatgtataacttcaggcatgttataggtattctagatttcagaagttctggtttagatgaaaaagtttcctttcaatagaaaaatgctgtttaaaaatgctgtttgtttttatttcggcattaaattatggcagtgatttgatttatatatggtatatataatttatatggtatatttgatttatatatggtatatataatttatatggtagtgccttcacgtgttctagaaggtactacgtttaagtaacgggttgactgactctccatttgattaagtttttctggtagggattatgagatttaactgcaagaacacttgtcaagataaaatgttgccattctctaacaaagtctcatttcaaaacatttatctttcttatacaaagtctaaagaagaatatgtcaagtaaaatcaccagtaatgtcacgatccatatagctaactactactgctataacagcctgtcttgtttctcatgtctgcaggtgtatatatttaaatgctattcagctttaacatgaatgttattgattttcttatagaaacctgaatcttcctggagtaattcagcccccaaatcaaaattgaagtcaacaggcaacacattattaacatggaaatgttgtcaagaacatagaggtatacagaggtcaagagcataaacatcagaaagggactgtggctggcctgcattcccagccacaaaaaagaaagcactggatactcaggaaggatctacttcagatcttgggaaattctgtaatcaagctagtatccaacagcaggcatttggacatgtcctgcaacccatcatcaatgcaaagagcttaaaatattaatcccaatcacagtgttccatttggaaaaagaaaaacataacacacaaacacatgtaatttcacctagctccttaaatgcaggcactctcccttgagaaaaaatgaacatttcctatcctgcagtctaaaaggctgcaaatgcagaggataaacattaacaaacacttaagaaatattaaatccgcatactaatttcagcttattactactgcagtggtttacatcattagtgtttttagaaaactaaagcatgactgagatatctgctatccaataggcaactgcaaaaaggatgaaagaacttaagactctcctacctagaaaataaggattatcactgaagcttccatttgaattttatttgatgttgagatgaactcagggtttatgcatcccacagccagaaagaaagagtagaaaagctaaagtggtagacagagtgcctctgtaatcccctcctctccaaagcagggccctaggggattatcttttggagtaatcttacagttaaaggtagcaaggagggttgctgaattgctccccccacccctccccccgccccgattgaaagggccaggtgtacagcataaaattactaacatagcaatgagattcaaatttgttattcacataaagcaggcatctcattcattactccactctgggccagatcaagtaagcgtgacaaagaggccttgaatgaaaagctaaaactaaatagtttttacgggggtcgttttttctagggtctaagaaccaatgtctactagatttgtttcaccaaaaagtagagagggttaaggggtaaaaacagagagccacacacttaaaagcacacaataaaattaaactctacctgcaaatatgtatttttactttattcaattaatgccatgtcacacctgcttgcaatgtcattttttaaatgtatcacattcgtttggctagaaaagtcaacagttcagttttggttagttattccctttctgacaaacattaaaatggaaagaaaatgctaactgggtgacaggaatttaacttattcctgggttaaaatagtttttgactttgtatgattgatttcatgtctcaagcccaccccacccccatttcaatgatactgagcatagtttcgcttaaattcaccaaaatattgctggcctataaatagtatactagccatttccattagctagcaccatggccataaaattgtactaaacaagaagtggaatgttctgaaaattccattttcactaagttattgcctaggctttaatttctgcctatgtggggctatgtgcctcactttccggcttctgcaggttgaggataaaagaaaatctataaaattacattataacaattttgaactcatttttttaaagttttgattagcataatgctgttactaatccaatggttcctaagcctaagatttatgtttaccaacacttgaaaataactatctagaatttaaagaaatatagcaaatgcaaaaatgcatcttaaattcttattgttcaacttatttatccatagcccaatttattataaaagacctaacttgtcagtgttttctaacactgtgggtcaaatatttcttggccaatatctgtccctttaccttctatcccaaaacccttgtcaggccaatgaactactcactgtccctagagactgcaaaacttcaaagaaaggaagagtattcctacttacaccaatggaatgaagatgtatcttggactgtgtaaaaagaaacagcaatagcttacatttttagcatgcctttcttctgagaaagcattagctcttcacttaatagtacacttgtttttctcatcacttctgtaaagtaggatgagcaaggaaagggtaaaggagcaggatcattttacaaacagaaactaacacacaaataatgtgttacttgttaattgccatagaagcaatgtttttcgctaaacaaaaccctccttaacgtcaaatctagtattttaaaaaatatttatccaagaaggagattttaaaaaatatatacatgtgtctgctcatcggtgcaaaaaaatacaggaaagataagccaaaacgtactgaaattgctaacctacaggacgttgagtgagaaaaggatataaagaagaatgtatagcttttttagaaccacagtaatgtttcccatacaaaaataaaaattaacaatgcggggtggggaaaacagggaaggctagaattgaatactgtagtaacaaatgaacctaactgtattacaaaacaacataaccatactgaaagatttggtggaaggaaataactaacctacgtaacttcagaaaactgtattttgactgcataacagttaacatactgtacaaaaatattgtactctagttagcaaatgtgtttttcacaggggtactagatgacaactgtgagactatacgggtactaggattaaacgagtatcaataaggaagggggaaggctgctgtgttgaactggtatgaacttacggttttttatatatatatacaggttaagtagatacagaaatatagatgtgtgtgtatgcacctgtgagcatagatacatatgtttccttgctttgccttttgagacatcctagaagcagtgacacttacgaagtaacaatgagcacaactagtactcagattttagttcctaataaaaggaacctgagctgaagtaggcaaaatacaagaggaacctggaacatctagtattagaaagtatttcaaaatataagcggtacatgctaaaaggacacaggagccaatctgaaagagcgcccaatacccaaagttgagataactggagcaactgtataaacagtaataggttataatccattaaataaaataaatatccatgggaccatcctgatattcacaactgagtcaatgaatgagtaaataaatgaggggggaagacacctcttcctaacagaattccatttaatgcaggtaggaagtagaacaaccaccctttagtaaacaacacagcaataattgctgtaggaaaaagtcatcagtgaacaataaaattatgagtaaaaatataatgagcaacagaatatttacatagtgtctccctataagacagtcatttattccagccagggcaaaatggcaaaaccttgtcactacaaaaaacataaaaatgtgccaggcatggtggcacatgcctgtgatcccagctacttgggaggctgagagatgggaggatagctgagccagggaggtgaaggctggagtggtgattgcgacactgcactccagcctgggtgacaaagtgagaccctatctctaaataaataaataaataaataaataaataaataaataaatattgtcagttattacaaagggaaaaatgctaattttacagaggagaaagctgtcaggcaccaccttaaccaagggaacaaacctatcatcactattagaaagacaagtcaaaatcatgaaccccctgtggtgtagagaagggtacagtatcttctgtggcattcctgtaaaacaatgcgtaacctctaataatgagaaaacaccaatttgtggaacgctatacaaaataactgaccagaaatcttgtatccaagtaatgaaatacaaaaactgagaactctcacatattgaaggacatttagagatgcaaaaactaaaagcaatgatagattctggacaacagaaaggacattaataagaaaactaataatacagaaattcaaataaagtatgtctattactttgtataagttcaatgttaatttcaatgttaatttcgtggttctgataattaacgattattgtgacaagatgtgttaagattagagaaagctccgtacggagactctgtactactatttcaacacacacacactctctctttctttctgacacaatctcgctgttgaccaggctggaatgcagtggcacaatcttggctcattgcaacctctgcctcctgggttcaagtgattcttgtgcctcagcctcccgagtagctgggattacaggcgcacaccaccacacctggctaatttttgtatttttagtagagacggggtttcaccatgttggccaggctggtctcaaatttctgtcctcaggtgatctgcccacctctgcctcccaaagtgctgggattttaggtcaccgtgcccagcctaaaatcatattttaaaagaatgaagaaaaaatgtatctagcattaataaaacaaacttcattcatacataaatctgtacagtctacaggttcctatcagttacagtactcacttaagataaatatagaatccattctgaattggccaaaatatccaacactccatcacagaaaagtatttgcagttacctgataatgccaggctctttcaagcctatgctgcattacacattactccctacaccatgcttcagcaagtccataagactcagaaaaaagtccatccttccctaggaaactacctttactgactccctccagcactcccattttatgcttgttggaagaacaagaagcactcaagaaaagatagatacctggttctacttagtctttcagacacaaagtgcagtctggaacaatgacaattagcttttactaactttcattatctatcaaacattgttaaaagcaaattataaattttaaattaactttgtaagaaggctagaaatcaggtagtaggaggagagtgtgactcctccaatttggttcttgtttttaaaaattgttttggctactggccaggtgcagtggctcacgcctgtaatcccagcactttgggaggccgaggcaggcggatcacttgaggtcaggagttcaagactagcctggccaacatggtgaaacccccgtctccactaaaaatacaaaaactagctgggtgtggtggcacacgcctgtaatcccagctactcgggaggctgaggcagaagaatcacttgaacccaggaggtggaggttgcagtgagcccagatcacaccacagaactccagcccgagtgacagggagagacttcatctcaaaaaaaaaaaaaaaaaaaattgttttggctcttgaaaatacttaacatttccatacatacttgaaaatcaatgttcaattgttaccaaaaacaacacaacataaaccaaaaaatcttgctgggatttttcactgggtttgcattgaatcattgtgtctaacattgactcttctaacacataaatacagcatacatctccgttcacttatgtaatctttttcagaagttttatggtttcagcaataaagtcattaacgtcttttgttagatttattcctaagtattttatgtttcttgatactaccgcaaatggaactgtttctccgggttatttttcagttgtttgctctaataaataaaaatagaattgacttttatatattgaccccgtacctggagaccttggctaaatctctaattctcacaggtttagggaattccatggggtttctaagtatcatatcttcaaatacaagcagttttgccctaccttttccaatttccatgcctttaattgcttttttcttgcaatattgcattagccaagacagagtacaatgtttttgtttgtttgaggcagggtctcaccccgtcgcccaggctcaagtacagtagcatgatctcagctcagtgcaacctccaccacctgggctcaagcaattctcccacctcagcttccagagtagtgaggactacaggtgcacgcccccacaccaggctcatttttgtatttttttgtagagatggggtttcgtcaggttgctggagctggtcttgaactctgaggctcaagcgacccgcccaccttggcctcccagagtgctgggattacaggcatgagccactgtgcccagcttacaatatttttaggatatatttttttcctaattgtagaccaacaaaacaagcactttcaccaagtagtgtgatgttaggcgttaggtttttttcctaatttttaaacagcatcacagctcaggaataaggtcttcacctttgattttcacgatttttactacaatgttgtgattctcatggttattattcttgaagtttcatgatttttttattttatttttgagacggagtctcactctgttgcccaggctgcagtgcagtgccatgatctcggctcactgcaacctctgtctcctgagttcaagcgattctcctgcttcagcctcccgagtagctgggattacaggtgtctgccaccacgcttggataatttttgtatttttagtagagatagggtttcaccatgttggccagactggtctcaaacttctgacctcaggtgatccacccacctcggcctcccaaagtactgggattacaggcatgagccaccgtgctcggcctaaagtttcatacatttgtaaactgactgtttaaattcaaaaatccagtcattaagttcctcaatttttttccatctttttttttctttttcctcatgactaagaatcatattctcatgtttattcatatgtatggtaattttctattatatacagacaatgtatgcaatacattatagagactctgaatttagttagcttttcctaaagagtgttgatttttgttctagcaggcatactactactacctggttaccttcattttgtggagctagttttgtttttataaaagcatagtggagtctattttggttccctccttaatcctatggtgaatgccttcgtcctgggaaacattctttaactctttaagtgtgagcctttattggtttcaatcaaagccctcaggtttttgccaagtctagttggaattcgaactccaaattctgccttccctgcattaggcaatgatgatcttctctgctcagctctttcagccttccaattactgctttccactatgccctataaaatcttccctaaacatgtgcaggtcaggggtgagcacaaagatctgaaaggggctcaaatagattgtgggcctatgcccctccccatctcccatagctccctctttgccactattcccctccttcaatttctacctaacttggcagccctgaactccatcctctgataatatacaaacaagcccatgaagcagtgactattgaattctagaagctctggggcacatggactgagaatgctctcatctcttcctggcaatactttctgtctgaaattttgctgacattgttgagtaatttacctagtaatatgcacaggttccaagcttgcccttctttgctcattactttttcttaagcaggggaaagcaagcttctatttgaagagagagaatgagaaggtggggaagataagaggcatgtttcaatacactagagaacaactctcaaccgctttttacatgctctctttccaagggcacaccctctttgttcaaaaggagtcttaaatttcacagaagcatttatctgtacacacgacttatcggcagctaccaagctagaggcccgttaagttttctctccctcagctagccttacacctttaaaactgcctttgagtcagaagtcagaatgaagaggttaaaataaaaaaagaggcatttttctaggcattcctccttaggtcttccctttctctaacccactactctgtggtataaaaacagtacccacttccctaacccagaaaatattccttgatttgctccatgactcaaaaaaggttcacccatgaattcagtctccagttcttttgctcataggttgggtccttttagaacaacttagttcaataatatctgtactgtattcaagacccaagcagatatatactggttctgtcaataaacaatcatcctgtttggaaataaagcaaaaagactatgtatccttgcagtgtaccactgggacattacctaacaagcccacccaggaaacatctgactctccataaattatttaactttgttttacctactatctataattgattagggcccagaagtcttactggatgtttattttagaacgctgacaagttaaagttggtttgcatcttgttgaaaacaatgtccaaagttacagctttattgttctataggatattaataacttttgtatgctactgagtaatcatattcctgcattcttcctttttatctggtattaaaatactgttaacagtttggccaccatcatgattcccttgttattcagtaaatcactatatatttaggaattatgtctaggctggtgcagtggttcacacctgtaatcccagcagttttggaggccaaggccagcggattgcttgtgctgaggagtttgagaccagcctgggcaacttggtaaaaccccatctctacaaacaatacaaaaattagccagacatggtggcacatgcctgtagtcccagctacttgggaagctgaggtgggaggatcacttgaacctgagaggtagaggctgcagtgagccaaggtcgcaccactgcactccagcctgggtgacagaataagaccctgtctaaaaagatggaaagaaagagagaaaaagaagagagaggggagagagagacagagagagagagaaagaaaaagaaaagaattatatctaatgttttgaaactatattttgacaattctaaagacgctgatttttttgttaattccagctgagtttcagaaatgagaataaaaaaattaaacataacagaaaatacctctgacattattatttttaaactacaagtcttcaaatatatttttgggtaataaacaagcacagtccaggagtttgaggctgaagtgagctatgattgtgcgattacactccagcctgggtgacagagcaagagcctgtcttaaaaaaaaaaaaaaaaaaaaaaaaggaataaatacacctacctccatttggggaaaaaattaacaaaatggaaaacaggctggttacatgtgggtatgaaaacctacagttgccctctgtcccgggcaacctaatttttttttttaagcaaaactgagaaaagtcactttcctaaaatttaaaacaaaacaaaacaaaaaaacctggggaacaaacaagcaaagttaaatactgccttcttatacagaaaaactttgcctggcaattgacatacgcacagctttgcaaatatttggcattttaaaaatttaagtcaatagcttttaagaaacatatgctctgcgcccattctactaataataaacaatggaaatgtattgtccctgctccccccaccccaccccccaacccctgtcttctcttaatactttctgaacgcttttcagaaagcatggatatattcataaagggtagataattcacgaaaacagggaaggggtaatctctccttgacaaaatagtgacagtgtatacttagttgttttcattatttattttactcaatccaaaaagcattctattgcacaatgttgaaactagtatggccaacacaaagggaaagatggtcttgaccttcaagaatcttacaatttaatacacacacaggaatcttacaatttaacacacaagtaaatgaatgaagggtagggaaaggaccaagctcctaaagagtgtgtgtgtacaagtgaatctgtataaactgtctcacaatcactgtggattttttaagacaatgaggattagtaacacaatggaggactgttatgccctgtccttcagaagtgctgaggtaagagaaaacatgactacagggagattactcaaaaaagtttggaatccctaaattctatatacaaatatataagtatctacatagaacttactcccctatcacatatgcctcatgtttcatgtttcctgtacccataccaccaatgtatctatgtttcctttctcacttaacaatttttaccctgattagaccattcactaaaagtttcattaataacttaaaaaagatctgtaaacagcatgcaatgaacttatattatagacttaaatagtggcaaaacttggcattctgctctttaatttattcaaaactactttccagttaagaactatcaatcttctagtgtcttcacatttatctctagcaacagtggctggctttcaaaattaggtgagagatctttccaagatctaaacatctccaatatctgcctcagagaaaatttagtttccaccacatcatgcgttcctgctaacaatgattaaaataaataaaagaactataaggttggtttatttgcggatacaagaacagcttgcttaactcaccatttaaaaagccatcacttcacactagctttattatctgaagcataatcaaaataataaactacggttgtgggactttggaatttctaattaagttatggagacttaaatcaagaaatatgaatattcataaaacccagtaaccttttaggcaaagtaaaaaagtgaaaagaacaagtgctcttggaattcagaaagaaaattaactatggtattgagagaaaccaggaaagagaaggaatcacagtagagctaggatacagaaggaaacagaaaatgacagtttaatgctcattatagaataacagtgaatcacccacagagaccattttcagtgttcttgtgaatttaacctctagtctaaccttttaatgaaaaggctataatatattagagtggcccagaaaggtgaccttatgtctcaggtgtcagagccacacccaggtctcctgattcccaatgatactccctaaagccttacttgctctggctgtagtgttttgagaattggagctgcttttaatcctatggtcagctacacagctgcaggatgggccctagattccctattcaggaattcagatcttaaaacaccaaaagtgataaaagtagatacagttccccttcttcagccaatgcaaggatcctagttacagagaaaaaacggtgtgccaagacaacacccttaattctcacgcatttccccctttctatcttttatacttaccaatttatcagtcccatgatctgtcttcacctcagaactaagtggaagaaataagtctgttgtatgctctgggggaggtacctccccaagaactatcaacccctgcaggatagagaggagaaaaatagcataagtgagcagtataaacttcaaatttaatttaggagttaagtctcaaaaggactgttggtgtactagaggccccctcttcctcaccctatggttcagaaacaaactacagcagcagcagctttgttttcccaaagagctatttcaacaagcagcagacccaggctcccctctctgccacttgactgctctgacctacatggctcatcagccatttagcatctttattcatatctttcagatatgaaatctttaccagattatggcatttataccatattactagactccactagattaacagcagcaatgcagtttttgtagccaacaaatgcagtttatgacttactaagctgaaaatgctactattcttaatcatgtactccaccaactatacctgcacaaacaaaactgaatgaaacaaatgtggaacagtcccctacaatttatgagaaaccaagagcttcttaaaagctggcccaaaggaacctgcttttttcataagcataaatattacttcagattaagttcctgcttgacaatttcaaattcagacctttggaaattcattccaggaaacaatttacataaaaagaaattaaaaatgaacccacaagtcctccccattgtacatataatgagccaggatgggtaaaggcagaaggtatcttattattaaaaaaacaaaatactacatatgaatcccaccatgtataccagaagaggtgacaaaaataaggctatgacactatataaccgaaagactgggatgcaagtgatcagggttcccaatctctttctctggtctaaaaaatagagatctaactagattaagaagctcttaatggaaatttattatcagaatcacctggggaaccttatcaaactatactggcttaggtccaacatctactcagtacctctgggggtggggccaggtagtctacctttttatgggggaagggaggcaggacatggtgggtacatggaggtgggtgtctctctcctcccccaccccgccaaccccactatgttaccgaggctgatctcaaactcctgggctccagcaatcctcccacctcagcctctggagtagctgggatgacaggtgcctaccaccatgcccagaggtggatattctactattctttaaaagctcccctggtaagtcctaaacttgtaaagttgaaaaacactagacttgattagtttgggctcaaagaacatcctaaagtatagatttgggggactagggattgtgactattagtcttagctctctaggccatacgacagactcttatgagccactaaaccagatgatccatccctggggtccttgtaactaaaaaaccaatatgaaatacaagctgcagaaaaggggaaaacattaagaaagaaaaatggaattttatttcagtttttaaaaaagaagtatgtatctctttttctcttgaagcaaaagaagcactgcctccctattctggaatatgactacacttagcctgtatcaaaaatgaattggagggtcccggaatggcggctcacacctgtaatcccagcactttgggaagctgaggcgggtggatcacctgaggtcgtcaggagttcaagatcagcctggccaacatggtgaaaccccatctctactaaaaatacaaaaattgcccaggcgtcgtggcacatgcccatagtcccagctactcggaaggctgaagaaggagaatcgcttgaactcaggaggcagaggttgcaatgagccaagatcacaccattgcacaccagcctgggcgacagaccaaggctctatctccaacaacaacaacaacaacaacaaaaatgaattggaggctgggtgtggtagatcacacctgtaatcctagcacttggggaggttgaggttaggagtgcgagaccagcctggccgacacagtgaaacaacgtctccagtaaaaatacaaaaaatagctgggcgtggtggtgagcccctgtaatcccagctacttgggaggctgaggcaggagaatcgcttgaacctgggaggtgtaggttgcagtgagccaagactgtgccattgcactccagtctgggcaacgagagcgaaactccacctcaaaattttaaaaattaaaaaaaaaaaaaaaaaaaaaaaaaagaattggagtctcctcagaaacaagagaaaggccattaactagtaagcaagaaacattaaccctagcctttaaaatgaggtttctctggttaaagaacttctgcttcaaaatattttcttccctaaatcaaaagcataaaatataccttacaaactttatcacatccaaataaaaactatttgcaaaagacagttatcttgtacaccactgccttctcaaaacgttgtattcaacagatattccctacttaagggcccaaactgtcttcctgcttcctgtacaaagcatgccaaaaatcattttattattcaaattttcccataaccggttcctaagaacttttttaaagatcaatttccaactactttccccaaatatttgttagtgttataccaatctcatcatctcctagacaaatgtttcaatgaatgtgaagctgttgctgctgctggaggtaagggttattagtcagtagaaggttaaaaaaaactgaattaaaggttaacacatgagctgttcatctttatttatactcatttttatattttatcagtccaaattgccgttcgtccttccaaagagattttcaacaagtcccacctccttccaagaaaatgtcccgggttaatgagttcctacttgctttatccacactgccagacctcctaaagcacggtgattgtatcttactttctgtgtatttaaatctcatttccagagcattcataatcttatgccacattatttatttcacttattattgcctcagtttcttgtttgttgagacagggtcaagctctgtcacctgtgctggagtgcagtggtgtggtcacgaatcactgtaacctccccctcccgggctcaagtgatcctcccacctcaaccccataaatagctgggataacaggtgcatgccaccacatccagctaatttttgtatttttttggtagagatggggtttcaccaagttgctcaggctggtctcgaactcttggactcaagtaatgcacttgcctcaaactcccaaagtgctgggataacaggtgcaagccaccacacccagctaattgttctattttttggtagagatggactttcaccatgttgccaaggctcgtctcaaactcctagactcaagcaatccacctgcctcggcctctcaaagtgctgggattacatgtgcaagccgctgcacccagcctttaattgttaactaatgttagtttattgaagatgtggacaaaatacaaatatatttaaatgacccatgtcccttagcagagtcatacaccaagaaaataaatgcatagcaaatatttgttgagttgtataatttttttcctaacaggaaaatattaactttataataattatagccagaagataaataaatctaacaattagatataaaattactccttcaatttttctttttcagttatatgaaagtaaggacgcagtcagtattttccaaagggaagaatttttccttaaactacagaataatttctaaatacaaccctcagatagattatgaagacatctcctaagagagtataataaaacttggtagggaccatctattcatcgacataattttatagacccacagaggatgtaggtcaaagcttatgtctctacaggccaatacatggcagaactggggcaaaagtctgcatctaactaatatttcattcctcttttgttcagttaattcaatcatttatccgctcatcagcatttgttaggtactaaggatacaagaaaaaatgagagacctatccctctcccctaacccatccttcaaagtgcttattacgttctaatactgcggcaaagaaaaacaatgtaaataggtaaatgttatgtactacattagaaggtattaaatgctagagagaacaaaatataggatagtgaggggattaagaagtggaaatggtggggttggtcgtgacggctcatgcctgtaattccagcactttgggaagccaatggaggaggactgcttgaggccaggagttcaggaccagcctgggcgacgtggcaaaaccctgtctccacaaaaacaataataataaaaattagcctggtgtaatatcacacctgtagttccagatattcaggaggatcacttaagcccaggagagagagagagatacaagtgggagggggtactacaggcgcataccaccacgcctggctagttttttgtatttttagtagagaaggggtttcaccatgttgccaaggctggttgcaaactcttggggccaagagatctacccgccctggcctcccaaagtgccgggttgcaggcatgagccactgtgcccctgcttgaatgtttatttgaagacagaatcaaccagctatgccaatgtgcttacaagataggagggaaaagagtcagagacactgccaaggtttctagcttccacaaccagaagaatggaactcttcttcatttgttcagaggacatttgaatacacattagttttaattaaacctatttttgaaaatatgtgctcaagtgttacactgaagcaaccaacaatcatccatacactgtccattgcccccaagatatgtaagttcactatggcattcaaaaccaaacactggatcctctaatttaatactgtacctcacaccaaaaaggatgaaaacagctaaaaagaggctgagcaaataaaaagcatccaagtaggtaagagtcattcatgcaggtagcatctattgagtggctaccacgtgcaaggtagtgtgaaaacacagtaataaaataaaaacagattctaccataaggagcttatgttcatctagccttgaacagacaaagagacaaagtattatgacagtactataacagaagttgagagaaggtgatgtcagagcagaaaagagcctaactgaagagactgatgaaagtgaggctttacagaggaggtctacataattacttaacattccccaaaatatatttaatatattttgagctatacttattcattaactatacacttaatgactttgcccttttctgtatacaatgtttcatatgccacaataacacttatttcggataaagtttactcatgtttaataaccatgaaaagaaaggttagcattagctgagaaaacttcataatgttctactccacacctgtcatgctaccccaacatgggcttccctaacattccaggtttaaactgggtcagtgttgaatagctgtgccattagcctggtggcaataaacttagggctgctgtactatgaaatagcaaccggtagaagccgaagaaaaaggtcaagagtctccttttccttcgccatgtcccgagtcagagccaggatcatgcttaggctgcacaggcctagaaaactccaagagtgaagcaagcttctgctttacacaaggaccaaaggaactggaatgggtcacagttacatgcagccttaatacctcctaagtgactcctctgtggatgaaccctctctcaactgtatttgcaatacagctaacaggcaatttcacatacttccttacatcactctatcaggtcaatcttccctatgcatctcaagacaaaccagtgaccccactgcagaccagttccacaagaatcaccctgggctacctggaaaagataagttgtctaaagtgctttaaaaaaccctattaagatgagaacttcaacagctttatgaaaattttgaagagaaaggtgttataagcttctgcagttcccattcaactccttccctattcaaaagtttcaatgctcttccacctcccatcctcaataacatttccatcctcagctacagctgtgtaatctcaaagagtagtcagaagaggagattttaaaaaacaacgtaagagtcaagccagtgcttctgggaggccaaggcaaggaggatcacttgaggtcaagagtttgagaccagcctggacaacacagcgagaccccatcctttaaaataaaaaaaaccctttaacaattagctaagcatggtgggacttgcctatggtcccagctacttgtacttgcaaggctaaggtaggaggatagcttgagcccaggagtttcaggttacaaagaactatgatctggccattgcacctcagcctgggcaacagagcaagaccctgcctcttaaaaactgcttagtccctattctttcccctcatttaccaggtgtgaaatttcaacaaacatgtttcagtgaaatgatgaaaaggacacaacagcaaagtatgttagaaaaaaaatgctttggaatcagataaaaagtcctgagtttaaatttagctctgccttttacaagcctctgaagatttattctgatcattaaacgaacatacatgagtaaacctttaattagtatacactcaaggtacgtatattgttttcgtttctccttctaaagcatggaagagtttctttttaaaaaacaagctgacaaactatgaaaattaaaagagtacaacagcatgcagaagtagtacagaggagttcctagaagttatattctttctccagagagcaatattattcccaaaagggactctactcacttcacagcttggaaggtaatacctaccttctgacagaacagaaactggtgtctggatcctagaatcacctagcagtagtcacaaatactttttttttttttggtaatacgccacttaaataaaattaatgttaataagcaacaaagtaaatccttaaaaagaaaagccccaccatccctccaatctcccacccgaagacaaattataactcaacagcctatcaccaagattcagcctatcacctaggttcatctcaaaaaaaaaaaaaagacctgtgcaacccaggaagtgctgggaaatcttggtgcagcatggaaaatatgaacaccaacccacttaaccaaaacacataggaaaaactttcttccatttcagtaactaaaaaaaaaacccaagcacttaaagtgattactaacttgagcaatagctctgcactcacttggatgtgtaaccatgaacaaactacttgactgctctgatcttccattgtttatcttgaaaatcgtgaatgagagtaaaatgcttagcacagtgcctgacatatcacaagtgctcaaaaacttctattaattatagtgttacataaagactaaatgcatgtgaatatatcattgggggaaaattccatggcttgttagagcaagttgaatattgtctcttccaaatttatgttcacccagaacctgtgactatgaccttgtttagaaaaagggtctttgcagatgtaatcaagttatgaagagccatttagtgtgggctctaaattcaatatgactggtgtcctcctgacatggaaatctacacagatgcaaagagaaagatggtcatatgaagatggaggcagcaactgcagtgatgtagctacaggccaagaacaccaaggactagcacaatatcagaagctggaaaaagacaaggaaggattcttccctagagcctccatagagaccatggcccttttgacaccataatttcagacttctggcctccagaacggtgagagaacacatttctgattttttaagccatcccatttgtgatagtttgttatgacagtctaggaaactaatccatttgttgaaaaagaaatgtataaatacgacacgtaaagctgtgaattttcttgatgcattacttattggaactatcaacctagttttattcttcctatcggaactctgagaagtaaaagattatctatgatgttgtattttacagaccaagaatctgaagctcagaaatgttaagtgacttttcttctcaaggttcatgtaagcagctggtagcaaagccacgattagaaacaaaaatttaccaagtccaagtatggtgcttaatacaatacgctttgaatgatgaaactcttggataagcaacatacattcatgtgccaaatagcattatggtcaatgacagaccacatatacaatgatggtcttataagattttaatacagctgaagaatacctgttttagcacaaagcactactcctgtgtttgtggtgatgctggtgtaaagaaacctacagtgctgctattagaagtataccacatacaattatgtacactaagaatataatagctgataataaaagctatgttactgttacacttatttcttatgataataaaaagtgttatgtatttactatactatacttttaatcgttattttagagagtacttctactcattaaaagaagtgaactgtgaaacagcctccagcaggtccttctgttggcactgtcacaggcaatgaaagctccgtgtgtgttgttggccctgaaaacctaacagtgtaacaagatgtgaaggtggaagacagtaataccgacaaacctgaccccatgtgggcctacgttcatgtgtgtgtttgtgtcttagtttttagcaaaacagtttaaaaaataaaactttcattttaaaatggaaagttttaaagatagaaaaaagcttgtagaataaggtgtgaagaaaatatttttgtacaattacaatgtatttgtgttttaggctaagtgttattacaaaagagtcaaaaagttttaaaaacttaaaagtttataaagcaaaaagttatagtaagctaaggttaatttattattgaaaaaaatatttaaaataaatgtagtgtagcctcggtgtacagtatttataaagtttatagtagtgtacagtcatgtcccaggcttttcaatttcagttacccttcacccaccgactcacccagagcaacttccagtcctgcaagctccattcatggtaagtgccctatacaggtgtaccatttttatcttttctactacatttttactgtattttttctatgtttaggtatgtttaaatacataaatctttaccactaattgcctacagtattcagtatagtagcatgatgtactggtttataccctaggagcaataggctatataccatattgtctaagtgaatagcaggccataccacctcagcttgtatgtattaagtatgtatatatgtaagtatgtatgtatgtatgtatatgagacagagactcgctctgctttgcccaggctggagtgcagtgtcgcgatctcagctcactgcaccctgtctcccaggttcaagtgattctcctgtctcagcctcccgagtagctgggattacaggcacccgccaccacacctggctaatttttttgtatttttcatagagacaggggtttcaccatgttggccaggctagtctcgaactcctcacctcaggtgacccacccaccttggactcccatgcctcggcctcccaaagtgctgagattacaggcgtgagccactgcgcacggccctcagcttgaatttaagtgcactttatgatgttcacgcaccaatgaaatcacctaacaacacatttctcagtttcccttttgttaagcaatgtgtgatggtatatacaaaactccagattattttccagatatttagaaatacttttcagatattttgatattttgaaagtttctgaaaattgctctgtcattacttctgagtgatgagctgaagaataaagcatgaaccaaatgaggtgagtatcttcttatacacagctagtgagactataaactgacactgccaaaatacttctctgaagaatgcattaagaacataaaagagcattcatacctttgactgagataaagatatttatcatggcatatttaatttaaataacaaatgtaacttaaatagtcaacaaagaaagccaatagcatgcagccattaaaaatgttttccaaaaaccaactgggaaatattcagggcacatacgtaacatgactgtatttgaacaaattacttatgtgctaggaaaatgtaccataatgttggtagcgagataattttgagctgttgggttgttttttttttttttggggggggggggagggtgggtgtcttttatacttctatgtcatttcagtttcctgagaattgatacacagtatttcatcaattctaagaggtactctccccacatgtcaacaacttttaaatcaagatgcattttacaatttctgttatgccctggtttaactgaaataatttctttgtcgtacttaaaacaatggtacatcttacaatcaatagcatcttaagttctatgaaatgtagcagttttataacaaggaactaagatgatataacatatacacatatataaacccacatatatatttatgaatgtatataaaaagatgaagcagcacttatgactactattatactaatctcagttgttactaagagactctagttctcaaatatagaaaatcccacttaactactggctataaaaacctagaaacagacactgaagaggtgtctctgatagagaaagactgtgtttttctcctcagtacaggcatatccagtcacctcctagttattcttagtcatcattccagttcaagttctacaaatctcactttaaaatttcctttgtgaagacttgggaaagcaaaatatgcaccaaatctagaatgtttattagttttgttccagctaatttttaaataagtaaatcaggatttaatttgtatgctaccctaagggaacaaactagtaagaataaaaaagtgagccctctggactgtgtcctcaattaaagtatgctctattgaacttttagggggagggggaatatatatatatatatgtatctccaatctggaaagaagctataagtccgcagtgacatttttagaataaaagtttaaatgattagatagcccacagaactttcacttcaaaccctgatcattctgttcattttatcagttgatcaaccttcaacttttggcctactaatttaatggatactgttcacaggaaagccattttcttaaggctttgactagtactaaggtcaaaaaggcattttgacccttatttttagtagcaatagactttttctagacatgggtctacataaagatagagctcagccacaccaagctaatataaaaaatactttgcaagaatgtaagcttcatgaaggtaggatttttgagaacactgctgagacacagtaagcacttaaaataatggtacatcttaccatcagtagcatcttaagttctatgaaatgtggcagttttataacagggaactaacaaatataaatctaacaaatatgacagttaacatcaatggcttgcttgcattattcagtctgttttccttgtttcctgttagctcagatacccacacagttttgttctaaatacacgttcagttaaacattatattctaatagtgttttcctttttatgagacaggcctttcttagttgtccaggctggagtgtggtggcacaatcttggctcactgcaacctccacttcgtgggctcaagcgatactcccacttcagcctcctaagtagctgggactacaggcacatgctatcatgctcaactaatttttgtaatttttgtaaagacaaggtctcactatgttgcccaggctggtctcgaactcctgagctcaaatgatcctcctgccttggcctcccaaagtgctgggatcacaagagtgagccaccacgcgcagccacatcaggttcttaaattaaaccactatatcaggtcattaaaccatttactttgcaatagttaagaagagggttatgggggttacgaggtgggaggggatgtgagaaaagcgatattgatagttttcggcagcatttaaaaacatcagatacttatcccttaccttattagcacgtatctgtttgtaaatgtctgtttgctgacgaattcgatattccaagtcagaaacatgagcctgaagccagttccagcggctgacaatagctgcccggtctgcagcccatttccattctgacctgcgtctcctaaaaggaaataaactgagtgaaatccaagagtagcagtaatatctataccagattggggggtggggagtggaatttaacttttaaaggcccttgcagagactaactctagtgtcaagaaaaacccaagagagagacaagacacctcccgctcatcaggatgcacatggatataaacttccaaataggtatttcccaaattaagtggaactgcgttctagcatcctgatcctgtggcacacagtttctctgaaatccctttaatttctctgggacaataaaattattgtccatgccaaaataaaacatacattaagaataatctatacaggaaatccaactgacactaagaattattaaaactaataaagaattcagcaaaagtgttcagtaaagaatatttaaaaactaataaagtagaaaatatcattaagtaccattcataacaccaacaaaactaatgatatattaaatatctttacagagaaaataacgcctgaaagcatgaagatctatacaaatggtaggacacatttttttaggatggcgattctcatgaacatctataaattcaaagaaattccaatcaaattgcctacagtatttttaataaaagctgagaaacagatctaaaagttcacatggaataaaggaccaacagcaagaaatttgcaagaaggcatgatgcaaatacacattaccagacagccagatttgctgcaaaactatagagagcctcaaaacgtagaactagatacataaaagataacgggaaatttttaaaaaatcagatcagtgcagaaacgatcaaactactcaataaatagtactaaactggccagttctttaaaggaaaaagtaaaattagttcccttcttcatgatataattacaaaattttggcatttcaaattgctaaatatgaacagccaaacttaaaagaatatcttcgggacttagagcagggagcatttcttagataatacacaaagatttcacctacttttcaacatacaatagaaaatctaataaagttaaaaggccaactacattttggtggaagatatctaacacatataactgacgattaaacatcagaatatgtaacagaactctcagaaataggataaaagaaaaaaagacaatcttaacagaaataggaaattcacataaaaggcaaataataaatatataaaaatgtgtcatctcgttaaaatttggttaaaatataaatattaggtaaaacattaagatgctgtttgaaatctggatgggaaaacgcacagtctcataaagccaacaggtggtgagaaatggaaaagagcaattaatatattgctggtaacagttaaaattggaaccaccatttttgaaaaataatttgaaaatacttagcgaggtgtaaaatgtgcatacccaaccatcatgatactgtattttttttttttttttcctgagaggcagggtctcacactctatcattgaggctggattgtggtggtgcaatcacagctcactgtaacctagagttcctttgcttaagctatcctcccacctcagtctcccaagcagctaggatcaggagcatactacatacctggcttttttttctttttttttttttttttgagatggagtttctttcactctggttgcccaggctggagtgcaatggcgcaatcttggctcaccaccaaccttcgcctcccaggttcaagcgattctcctgcctcagcctcccgagcagctgggattacaggcatgcgccaccatgcccggctaattttgtatttttagtagacacggggtttctccatgttggtcaggctggtctcaaactcccaacctcaggggatccgcccacctcgacctcccaaagtgctgggattacaggcacgagccactgcacccagccctgactaacttttttttgagacggagtcttgctctgtcgcccgggctggagtccagtggcatgatctcggctcactgcaagctccgcctcccgggtttacgccattctcctgcctcagcctccggagtaactgggactacaggcgcccaccaccacgcctggctaatttttgtatttttagtagagacggggtttcactgtgttagccaggatggtctcgatctcctgacctcatgatccacccacctcagcctcccaaagtgctgggattacaggcgtgagccactgagcctagccccactggctaatttttaataaaaaatgttgtggagatggggtcttgctatggtgtccaggttgttctctaactcctgacctttagcctcccaaagacacgagccactatgcccagccatgaaattctgtttctgagaacataaactacacattcctctgcataaggaaacaggttcactggaggagagtctgtaatagataaaaactaattatattctaattctgctgaacttggtaaataaactataatttattcatttaatagttctatagtaataaaaataaacgacatctgtatgtatcaacatgattaaatctaagaacacaatgttgaatgaaacaactacaaaaaaactaaacaagattaagtacacacaagtagtgaaggaatttgatgaaatactatctagcaatttatttactgtatgtatcaacatgacctaatctcaacaatggggaatgcaaaagctgcacaaaaataaacaaataaacattaataaggattgttaccaatacagataactgatgaatatattttaaaatgcctaaaactgacatacaacaaatttacaatcaagctcctcattatctctggaaaggggatggagaagttggattttagctctacctataatgtttgacttctcatgtaaaaaaacaaagatggaaatgtgacaacattaacattgtttaaatattacactggggatacatggtgtctactatattctgtaatctaaatatttcataatctaccacaaaactattttcccagaaagcagcagcagtcacacagccctcagccccacttcccatcaggatacacacactcactgctaaaacttatgactataggtgaacttgaacacagtctcccataggggcaaaatacaaaatgtcaaaaataaaaaagaacaaatctgaccacgacagagtaagacatgaattaatacttaatcataccataataattaagaccaagggtagtaatggtattttaacttttgtatggaccaaacataaaccattcaaaccaaccactgtgataattatcaattatgtctcttcttttagaaagaaaacattttacagttccctaattttgatggaaccacttcaagataaaaagatacttttaaagtacagttatctgcttcaatgttggctgcaggtctagctctaccctaaatccaggaaatgatctcaagagatcaataagaaactagggatcattcttgaacaacaaaaatgccccctacccacaaagagacaaaactagttaaccctcgtattttattcccacctttccttacttttcaaggcttaccacctttctatcctgcaaaatcttttggatttatagattcctttcattcctaaaactaccaccacaccaggtccccatctatcaccactgggcaaccccaacagcctccttagctgctcttcccaacaccagtcaatcatactacttttcctcaatcaactcccctcacacctttttcatcctggcattctaatgtttaaggaaccatgcagctcctttgaaaatacaaaaggaaaagaaaattacttaaaacattttagttcgcaagaactttgataaatacactttttcttggatattaatgaaggtcttatgtcccctacacaggtatttacctaaataacaatacaaagcgagcctcctgataatatgttttggataatatggttaataaactaattaaagaaaggcaagacagcactaaggaatactaacaattcccaatttatgaacaagtttcattttacaagtgtatctgtgatgtgatggtttagaactcgaagtgatttccaggagaaagttgttacaacattattcttccataatgctgctcaaactctcatcatctccaatgaaaaatggaaaaccacaactcaagcgtccaagaagtatcttgtgttcaaaataccagcaatatgagcagaaagctaaactgttattaagcatgagaggtgtacagttaacaagtctggataagatatgaagatgttaccatactccagtggcagagcagagcaccactaaacagtaacacaagaataagagcttcacatcttttgttccttaacaaatacaagcggccgggcgcggtggctcacgcttgtaatcccagcactttgggaggccgaggcaggcggatcacgaggtcaggagatcgagaccatcctggctaacacggtgaaaccccgtctctactaaaaatacaaaaaaattagccgggcgtgatggcgggcgcctgtagtcccagctactcgggaggctgaggcaggagaatggcgtgaacccggaaggcggagcttgcagtgagccgagattgcgccactgcactctcgcctgggccacagagcgagactccgtctcaaaaaaaaaaaaaacaaaacaaaaaaaaaacaaatacaagctatataaactcagcttatcagaggtaaagatagacttcctcctcaatattcgaagtgtaaatttatcactctgacaatttacagctcaaaacaagggacacacattgaacattagggacatgtttaatgttataccatacagacttcaggaaagaacacaggactaaggttgcagaataatactttaaatacaatgaggacttggtttctaatatagtcattatcaataatgaagaaaatcacgtggattctaacactgatgagtcaactcattcctgatgcttgtttctgtgctattagtgaaataactgttttaactatgtgcctgagtaggacactagaatgccttagaacgtttgattttaccgtgtgctttatcctagtccatacaaaaacatgtactatatatactgtagttatcacctgagtgggaattcttttcaactcgtattttgctcattgcttttataaactttttattggtaaaaatggctttgtcaccatgtgctatacaaaaattcattaaaatgttacatgatgaattactttttggttacctaaatgcagtatcaatatttgcttttgtgacaccacatgaatagtacaccttaatgttaaccagctatgtgctagtattggtttacataagaaatatttgttgtatataaatatttcattagctatgaacttgtactttaatcgttctttttacacagttagactattaccacagagaattgagaatgctctgttgactctaagaacatagatctttcctgtgtttgtttcacactgcttttgagctaggtagtgagtacctgtgaatggttttttgttgttttcttcatgtgactcaacaattttaagacttctcattggtgaaatctatggtgaaaccccatctctactaaaaataaaaaaaattagccagacgtagtcgcgcacgcctgtaatcccagctacataggaggctgaggcaggagaattgcttgaatccaggaggtgacggaggctgccgtgggcccagaccacacgccactgcccttcagcctgtacaacagagtgagactccctctccccaaaaaaaaaaaaaaaaagcgccctctataaacacacttaaaccatacagtaaaagtaattaatttttttccttgcaaattcagggttcagcttacatgttggctaaaaattaatttttgtttttagttctttaaagttattaatagtcaatgggtttaaaagggattatcaatagatcaactcttttgtatttattagataagtagcaccaaaagctagacattgaaccacatggaacaccacatgttgactaccaggcctagtgcctctaattaagtcacctaattctattctaagatgggaaatttgtatgtcaatccagtagaacagggctggtggattatgcttctcttccctgatgtattaacataaatttttttaaatctcattaaggcaacaaacatgccagaaaaacccgaatggtggtaatttcaactttgattctgatttcagtcccatctcgattctttccttttaatgaaacaaaggttctattagccaactaaagtaaaatgactgttcacagtgagctacacagtgctacattcacactggtagataaattgacaaaggattatgtgctacttccaagtgtgcaggaaatcctgagacatctaagttctgaaatctccaggttatttagataacttttaaaaaccaaaagattcaaataaaactgagatcatcccagagcgtacaattgccagattaacagttttcagggtaagagttagggtcactgtggggcaggaatgagaaatcttgaaattgctgagtcacatgaaaaaaacaaaaacaaaaaaccactcacaagtactcactacctagctcaaaagcagtgtgaaacagagggaagatcaggagacaagttctcacttttacttactttatgtgatcctaaacatataaattgacctctgcaaataagaacaacatctgcttcacaaagttgtgatagccatacaatgatgtaatcctaactgcaacctaaaatgtatgtattagataagaataacaatttagtcagctgggcacggtggctcaggcctgtaatcccagcactttgggaggccgaggcaggcagatcacaagataaggagtctgagatcagcctgactaacatagtgaaaccccgtctctactaaaaatacaaaaaaaaattagccgggcttagtagcacgcgcctgtaatcccagctactcaggaggctgaggcaggagaatcgcttgaacccgggaggcagaggttacagtgagtcgagatcgtgccactgctctccagcctgggggacagagcaagactctgtctacaaaaaaaaaaaaaaaaaaaaaaaagaaataacaatttagtcattataaccatggatttaaattccgtatcaaaaaggtacaaaaaaggaagaaaaacagaataagattaaagaaaaacctctcagataaattcaggaaacaagtgttttcagttagcaacaagccatattctgagagtttcttgagctttgaactttagagtcatctaaaagttccactctaaacagaaaaatcaaagtagtctattagaatagacattgcattatcagtgacattaccaccaaatttaaaaagatggaggggataaagcacaaggagaaaaagaagagaaccaaactgtccagagttaaatatcccacattttagttgtaaagtaaaacccaggaaaaaactcggatacatacttcgtcttaacccattctcatctgtcacatgacctaggttgtgtcagctttctacagatatctgtagtaatgtggaacaaatgtaccagagccaatacttttttttttgagatggaatctcgctctgtcacccaggctggagtgcagaggcacgatctcagctcactgcaacctctgcctctcgggttcaagtgattttcctgcctcagcctcctgagtagctgggattacaggtgcctgtcaccatgcctggctaatttttgtgtttttagtagagatggggttttgccgtgttggccaggctggtctcgaactcctgacctcaaatgatccgtctgcctcagcctcccaaagtgctgcagttacaggtgtgagccacagcacccagccccagagccaattctacctaaactgccaattcatcctgacagacccttgaaattgaacacagcacttttgtcttactacttcaactagattacctctaatatttaaatgaaatttgtgtagttttggtagtttatttcagccaagcatttagcccaccatgaactcactctatccttcttccttccatttaacaaatatttaagcaactattagttaccaagaattagactaggttagggatgcaaaaacaagaactgtggctaaagtttacaatttaatggggcagatagatgttaataatcaaataatcatataaaatatacgataagagatcctaactatgtcagatttagactgggggatctagaaagacttgtgatataaatatttaaacagacctccaaagcataaaataggacttggatgcacaaactggtagggcttggggatgtggagcagaagacattaggtggaactgtggtgtgtcacaaagaaacgacatgtatacaatggttatgtggttagaactccaacagtgaacaacgaaaagaattcattcaacttgacaatggatacaggtaggcagggccaggtcacacagaacctggcaatccatgttaatcttataaaacaatataagcaatcctcatctttcctcatgctcttttatttatctcagaccctgtttgaatgaaaatttacaaatacaagctaaaagataataaactcccacaaaaccatcaaccaatttcaactatcaacttttggcgaatcctacctcatctataacatctatctcccatccctatgaattatttttaagccaattcccaacatcacatcatcacctctaaatatttcggtatgtttccaaaatgtaaggtcttttaagaatatataccagtatattttataatctaaaaaacaataattccttaatgttaaatatccagttactggttaaatttcctggattgtctcagttttctccaaatcagagtcaaataagatccacacaattcatttacttaatacatcacaagctcgtaacacgctcctcctcattttctttcctcacaatctgtggaagagacagcactatctgtcctttagaatttcctccattgtggattttactgactgtgcctttaacacaaagcccatacttctaaacttgataatttgacacctctaggctggccgtgctggctcatgcctgtaatctcagcactttgggaggctgaggtgggtagagcatttgagatcaggagttcaagaccagcctgaccaacatggtgaaacactgtctctactaaaaatacaaaaaaattggccaggcgtggtggcctgggcctgtagttccagctgcacgggaggctgaggcaggagaattgcttgaacccaggaggcagaggttgcagtgagccaagatcacgccactgcactctagcctgggcgacagagtgagactctgtctcaaaaataaacaaacaaacaaacaacctttagtagtttgatacatttcattttctgtaggtcagctgataaattttttttgtacattaaatttttacatgtttaagattgagatatgttttaaaatacactcaatcttttaaaaatcatttaaggtactttaaactcctttcaatacccgtcagtcagatttttcatcaaacatggtaaacatatacatattatatactctgcctagcacaataaaagaaatgtaattgtttgtcataccctatgcaaatttccaaccagaaaatacccagaagcatcttctaacactaaaacccacgtctctccaggaaagtttttccttgtgcatcgtacctcacaattcactctttgtcctcttcaagcttagttggatcctcttattttgttatttgtatgtgctattatttccaagtcatgtcatatatataactggtctccaactagattatccatgcctccttatgggaactaccatgtgttttaactgtaagacaatttttaatgatgtctgtgcacatgtagtttacaagtaaatttgcaaaaaatataaacaatatgagagagttttagctgatgccttatcctgtttaattctcaaatgtttatattttaaaaacacttaactgaagtattctaatggaggaaaaaatggcatgacaaagaagtatggaaatggcttacagttcttgactggctgtaggactgaacatggaatttgagcatgaagattttgagcaaaatactaggctacttactgtgtcttttttcttttttttttagacaaagttttgttcttatcgcctaggctggagtgcaatggtgcgatctcggctcactgcaacctccgcttcccaggttcaagcgaatctcctgcctcagcctcccaagtagctgggattacaggtgcccgtcaccacgcctcgctaattttttgtatttttagtagaaacaaggtttcacttggacaggctggtctcaaactcctgacctcaggtgatccacccacctcggcttcccaaagtgctggaattacaggcgtgagcaaccgcacatggcctactgtgtcttctttagagaataagactgttatgtttcaagaataaagcaaatgacaaatagtgaaaggctctcagttattcaaagtactgccattccagagcagctcctccagagtgaattaattttctgtctacttttcttcctttcaaaagttaaactgaggttagaatgttcaaattctgtatgtgatactaatttctctttcaaagagattgcttgaggccgagcatggtggctcaggcctgtaatcccagcactttgggaggctgaggcgggcagatgacttgaggtcaggagttcaagaccagcctgaccaacatggtgaaaccccgtctctactaaaaatacgaaaattagtagggaatgtggtgggtgcctgtaattccagctacttgggaggctgaggcagaagaattacttgaaccctagagacagacgctgcagtgagtgagatcacgccattgcactccagaccaggtgacaagagtgaaaccctgtctcaaaaaaacaaaaacaaaaaaccccaaaatgatcactcgagctcaggacttcgagaccagcctgggcaacaggtgaaaccccatgtctctacaaaaaaatacaaaaattagccgggaatggtggtgcaagcctaaggtcccagctactcagtaggctgaggagggaggatcgcttgagcctgggaggtcaaggctgcagtgagtcgagactgcgccactgtactccagcctgggcagcacagcaagaccttcacacacacacacacacacacacacacacacacacacacacacacacacacacacaccccagaagggtgaaggagcagaaaagtacagtgtattgaggcagggtccccctttcatccctactaccccagtcccacatattccacagggagaacttgcctccggctatctctagaagaatgagagaattttaatactaaatccaacagaaaaacatcttctttctcactttgaaaatacggtttattggaaaagagtatggtgtctggagtcagtgaacactgagttccaaatcctggccccaccacttagctagctattatcattgagcccccagtcagctactgagaaatcaaacaagttccaacgcacaatctccaggaataatgctccaactttagtaagtctaagaattgcctgagagagttaagtctcacgtacctttatgaagaaaaagcctcttagttattatgtaagatatctatgagaccatactttttttgttttgttttgtttttgagatggagtctcgctctttcgcccaggctggagtacagtggtgcgatctcggctcactgcaacctctgcctcacgggttcaagcaattctcctgcctcagcctcccgagtagctgggattacaggcgtccaccaccacacctggctaatttttgtatttttagtagagacggggtttcaccatgttggccaggctggtctcaaactcctgacctcaggtgatctacccacctcggtctcccaaagtgctgggaatacaggtgtgagccaatgcgcccagctgagaccatattttcagaaatagtccttaaagacactgaggtttagcaacagaacccatcttcaagaaaatgagttgaaccaaaaattaatttgttaataaacttaccagttcttaaaaataaatgtggtaaaaaggaacaaaacaaacaaaaaagtgaataaatagaagaaaccctggtacaggcaaggtggtgtagactctattctttctcccagctcatccctgttctaagcacaattataaatcctgcaaataacacaagaggcaatcaaaggaaaactctgaaagatagaaaagggaaggcaaactagttaaaggccccaggactaaaggaacaacacagtgacaaaagcatctaataaacactatccaaccgaaagaaggtaacccaagtttggcatttcctggcttccaagagagcaacaaagagcatctcagacaggctcattccctgcctccatataagggaagtatttccttcaataccagggaagcactgcagcaacagcaagggggatggatcaggaggtctgctaataataggaagccagaggaaacgttattgccccatttctctatttctttttacggcaaatactcattattctaatttgtctcttctcactgtttctttaacacagggtttcaacccactattgcaccaaagctgctggtcaaggtcaccaatgacctccactgtactaaatccaatttccacatttcagtccttaccacccttgatccatcaccagtatccaacaaaggtgattactccctccttcaaatactttctccacttctctttcaagacatactaacctggcttttctattgtctttttgaattccttgtaagactgcatatgcgaaatcactaaatcttctttcctatacttcctttctaggtgatcttacccaaactcatggctttaagtatccaactatgtttctgactcccaaattcctacctcgagctgaaatcgctcccctcaactccagattcctgtttctacctgcctactcaacacttctatttgaatgtctaaaaagtgtctcaaactttacatgatcaaaatgaagttgatactttcccctccccaactcctatatgccatcccaaacctgcttcaactagatggatctgttcaggtcaaaaacctccatgtaatccttaatttcaaccccccaccacctctatctctctcataaacacactcaattggcaaatcttattggcactgtcttcaaatatatccagtattcagccacttcttgccacttcattgttagtactttggttgaatctttctagatgagtccaagagcctctaaatgggcttctagctctcacccttgaccactttcaggatattatcatgaacatagcagccagcctaatattgtataaaaggataagttcgatcatgtcactcctctacccaaaacctagcctagttgtttaccatctctaaaaacccaagtcctgacaacgaccctgtaaggcctcaaacagagagcctctatcacccaatccctgctacctctctggcctcatctcctgttctcctcctggctcattccattccagtcactgctgtttgctgaacatgttaggcaagctgtcacccacaggaccttttatttgctattcctaaagcagatatcctcactttcttcaggtcatttccttacatgacactttattaaggctttcccttaactgtcctataaaattgcaacccctctccaaataccccctacacacctttctttcccgcttcctggctttattaatagaaccttcatgaaaattatttttaattatctatctttcttactgtctgtttcccccactagaatcatatccggaaaacagagatttttgtcttgttcaccataatatctctgggtgcttggaacaatgcctagcaaatggcaggtactcaaatatttgttcaaagggaaggaaggaagcaggaagagagagggaatgagggtaacaggctggaactatgatcctaacttttccttacaaaagattaaaaccaaagtaattccagactgaagctaaccccttttctcatctggtgccaacagacctcataaaactaactctggcctcctcataaaactaactctggcctctaatgctgaaagcgagtcaagcaattatagtccacactcttagtccaagtatacacaaaccagagaaaataaagctatattacaaagtgaaaactactaacaagatatttgagagctcttctttttttggagataggatcttgcactgtcacccgggctgaagggcagtgatgcaatcatagctcactatagcctcaatcacctgagctcaagcaaccactctcacctcagtctctgcagtagctgggacctcagatgtgcaccaccacgcccagctaattttattttttcatagaaatggagcctcacgatgttgcccaggctggtctcaaactcctaggctcaggtgattctcctgcctcagccttccaaaatgttgggattacaggtgtgagccactgcacccagtctaatcccaaccatacacaacttgaatggaaacttgctgagggtactatagatgttccagagtaaaaacgtttccgcttttacacatggtaaaatacaaaattctcacatctcaatttctatgcttttgcaaaccacttactaacagaatcgtgaattatatgatacgtgtaagatagttaagttttattggcagatttcgattctgccacatcaaattgaaaaatattctgtcatgttcatcattatatattatataaatttgcctccctcaaaaaccacacccccaccaaaaaaaaacccttaagaaataatttttaatgacatagacctcaaaggtcgagctagttttcagttaaagaatgactgagggcacaaaggtggacatttttaccatcctaaaaattggaagatatcactcccagggtggctgtgtgatttcaatgacataacatttttaaagtctagcattccattataagtgctcagtaaatgggaagttgctgctgctcttacaagcttctgactaccatacctggttgaactaactcagttaccacaaggtactctatgcccttacatctaatgacaaatatttgttttgaaaaacgtatactccttaaacacacttgagaaacaggaaccagagacccaagtacattttgttctgaatcaaattccagcatgcacagcaaagtgcatgtagaggggtgagagggtgactagggagactgcttcaatgggagattattctgcagtagtgccttaactgtagaacagtgatgatgataaactcatcctaaatttaggactactgacaggaacaagtgaccacagtaactgttcatcttaagtcgtaaaaagctttctggcaatactcatcttcaaaaaaacctagcatgtaggaaaaatcttttatgtgtttgaataagggtaatatagttaaagctaaaggcttagatttttaactggtctaatgagagaaagcacagtagtcatataataagaaggtttatgttttacttcattttactagtgtttcctcatgagaattaagtaacagaaattataggaatcacaaatgaagtgcttactccatgcaaaacactggtctggcacattacagatattaattcacgaaatcctcattaaaaccctgtcaagtgggtattatgatcatcactgccccatttttataataaggaaactaagacaataaggctaagtaacttgtctaaggtcacaccactaacaagcagagccaagacttgacataggtgctctgggccagagtttttgttaacagttggaatatacaaatttacaagtattactgccaaatcaattttctcaaaaataagtcaaagtggaggaaggggggagatgaccctctgaattcactaaggttctgtgaaaagatgctgaaacaaataaaaagagtatttgattgtcaaatatatgctatttagaaatactaatggaaaagaatactgtgggcaagaaaagaatcacaagtatttgtgctgagttctgaaaggagagaaataaggttggggtgggaggtggggaaagcaggtcaagcatggaatagagcatgaataaaaatgcacagtcagaaaagtaaaaagctatgtcctagatacaaagcagtagtaataggtagaaatagtattacaaaaacagcagtgtcactaggtatcaggcactcaatgcataactaaagagaacataaaaataattaaaactatagtgaaacaaataacaagaacatgtcatattcctggttgtgataactacctatcataattgtagtttttttcccttaaattattaagttggagcagttattttacgtctgatgcatttcttaagcggttttaaagaagggcatagaatatgtgatgataaatttgacacaataatttgagttcatgtgaatgagtgttcaaacattgccaagaaaacactgaaagataatttttaaagatggagtttcgctctgtcgtccaggctggagtgcgatggcgtgatctcggcttactgcaacctccgcctcccgggcaagccattctcctgcctcagcctcgcaggtagctaggactacaggcatgtgctgccaagcccagctaattttttgtatttttagtagagatagggtttcaccatgttggccaggctggtctcaaactcctgacctcagatgatccccctgcctccacctcccaaagtgctgggattacaggcatgatccaccgtgcccaaccgaaagagaatattaaggaagactctgcccaaccaattattaaaattgccattatacaacaagtataatcaatagatacggatggtatttgaactagactagacaaagagatcagcagaccacaaaatacaacatatacatccaagtatacatggcaacgtaatatgcaaagatgacatctcaattctcagaggaaagaacattgtatttaattgttgatattgatataaccaactacacatttgggaagaaaggagagggaattcctatcttacactacacacaaaaataaatctaaagtgtgttaaagactttagcataatcactgcattgggaggcattcttaaagaacagaagaaaagcagaaaccagaaaagtttattttttggaaaattaattaaaaattctcatgctctctgatccacttttcaagattcgatcccacagaaacgagagcaccaatacaataatgtttactatcaaggtaactgaaagcaactgtatttcccaaaggagaatggctgagtatattattgtacacctctatagggagtgttatataatcattaagaatgaagacaggcacggtggctcacacctataatcccagggctttgggagcccaaggtgggtggattgcctgaggtcaggagttcaagaccagcctgaccaacatggtgaaaccccatctctactaaaaaataaaaaaattagccaggcatggtggggtgcacctgtagtcctagctactcaggaggctgaggtaagaaaatcgcttgaacccaggaggtgaaggttgcagtgagccaagatcaagtcattgcactccagcctgggtgaaaagagtgaaactctgtctcaaaaaaaaaaaaaaaaaaaaaaaaaagaatccagaccgggagtggtggctcacgcttgtaatctcagccctttgggaggctgaggcgagcggatcacctgaggtcaggaattcgagaccggcgtggccaacatggtgaaaccccatctctactaaaaatacaaaaattagccggacatggtggtgtgtgcctgtagtatcagctactcaggaggctgaggtgggagaatcgcttgaacctgggaggcagaggttgtagtgagccaagatcacactactgcattccatcctgggtgagagtgagacattgtctccaaaaaacaaaacaaaacaaaacaaaaaactgggcagataaattttttttttttttgagatggagtgtcactcttgttgcccaggctggagtgcaatggcacaatcttggctcactacaacctccgcctcccaagttcaagtgattctcctgccttagcctctcgagtaggtgggattacaggcatgcgccatcacgccgggctaattttgtatttttggtagagacagggtttctccatgttggtcagggtggtcttgaactcccgacctcaggtgacccgcccaccttggcctcccaaagtgttgggattacaggcgtgagccaccaggcccggccgggacagataattttagacatcaatttaagtgggaagaagactacaaagaatacaaagaaactagcaatgcctgaagacattttttgttgtcacaactgggggtggggggatggtacttggtagaggccagagatgccgctaaccatactacaacacaggacagtttcctacaagaaaatgtcagtagagctgacactaagaaaccttgctgtatatgaaccactgataagaataaaatcttagctttccaaggtcaatcttgccttttagccccatcatggccccacgtgtttgcaggttctttggctaagccaccaaatagctgttatggtctgttaacaatcaaatgaatggcaagggagaagtttaagccatgacccagcatttaaaaaataatggaaaagaatacaacagaaaactaagagtatgcagcatgcagagtatgtggggaaagtaatttttgttaaagttaggcatatgcaagcctttgtgtctctcaaatttacctgtaggtataagtggggcaaactgtttatcgcacggtagatcatgctcaaagaaagtcattcaagatactcctcagttctctcatccaaaaaactcatgagttggactaaaaaaaaaaacaaaaaaacctacgaggcactttctttataaaatgttaatgaatttatgatcatctgcatgaagtctaccctgtatgtacagatgtaacctacatgggagggggtacagtccttataggtagacacctgaaaggctcaattcatttcagatgtttcaagaaaattccttagtcaataacattcacatagactttgtaagatcttgattaagccatgaggccaaatctaaatctaaatcacccactcagaaagtgccaaaaaccttaaaaccaaaagaaacattagagattatctatctctaagcatctcaatttttaaatgagtaaaatgagcccaaaatggggcccaaaggattaaatgatttgcccagagtcataagccaagtcagactgtcaaaccgttaaagcaaactgataagaaaaagatgctcagggccaggcatgttggctcacgcctgtaatcccagcacaatgggaggccgagtagggcagatcacaaggtcacgagttctagaccagcgtggccaatacggtgaaaccccgtctctactaaaaatacaaaaattagctgggcatggtggcaggcgcctgttgtcccagctactcgggaggctgaggcaggagaatcgcttgaacccaggaggcggaggttgcagtgagccaagatcgcgccattgcactccagcctgggcaacagcgagactccctctcaaacaaaaacaaaaaaactaaaacatctaactgaatcaggctgcttaagtatcaaaataatcttaaatatctgaagaggaagaaggataaagattccctaacatgcagaactaaaactagaaaaactttattctaatgttcttagactactatcaaattctccctaggacttctacattgctgataacagcttacaatatttttcccagtttagttaagaccacatgtcagtattttattacaatctttcaagcaagaaagaaggtctctgatatactaatttaaagacatatacactcttgatagagctatattaggaaatggcaatggctaattcgtaaactagatttttaaaaaatgacaatatcttgtttaaagttattagactatgacagtcatctgagtggggaggtaactagttccccagcagaagccttaatcccattaaggtttatcagacaagtgtataacagaaatgttcatttcttctcagaaggaggttatgaattatatcacacggattctgtttagatgaggtttagaacaatttttctttttaacagtttctccttttgatttagacactctctaaagatctgtccagatttaggtccatttcactgaaattttgtactaaagtccacgaatttttttcattttttctttggcaaacaggtatttttgtaaacccaagttttatttatttatttattttgagatggagtttcgctcttgtcatgcaggcaggagtgcaatgcacaatcttggctcactgcaacctccacctcctgagttcaagcgattctcctgcctcagcctcccgtgtagctgggattacacgcgcctgccaccacacccagctaatttttttatttttagtagagatgggattttgccatgttggccaggctggtctcacactgctgacctcaggtgatccacccatctcagcctcccatagtactgggactacagacgtgagccaccgtgtccagcctgtaaagcaagaatttttaaagagcaaaaagaaagtgcagattttctgtctccttactacagatgagaaaatagtataaagctatcgagagtgtcaacagttctatattacccccgtccccacccccactgtactgctcctgaaagctaaacagaaatcccaaggaaagtatacattcaaggaacgaagataactttagatatgtattacatgatgcatatacgggttttcagtgaactatatgtgatttcaaactaaattaaaaacaaggctttactatgacattatgaatgaaaaacagtttatttataggatactttgactctactcaaaaagtatgcttaaacaatccaacaactttaggaaagccaaccgataaatctttgcaatcaggcagaaatactaaggcatttaaaaaacatacccagaccgcttttaacatttaccccagagatctctaggctcatcacagagggtaaccacaaaatgcttaagctgcatacagacatcaggcaaatgccacataactgctggacagtaagttatcaccacagtagttaccaatgtgacaaagcagaggataaggagcattcagagttggaaactacggtggaaacgtttccatttatggcacattttctgattggttttataactcatgttactaactatagaatcatagacgagaagaatccccggaaccaagcctcttataaataagtcaactgacctgaaaaacttacgacagagtgaaaactagacccaacttcaaactgagataggattttatacttcacaaaaattaaagttagttatttagattttattagaaatagctcagcacgtaaagtcctcaaaggaaacagacatacagtcaaaaaaaaccattactgcggggcgcagtggctcacgcctgtaatcccagcactttgggaggccaaggcaggcggatcacgaggtcagaggatcaagaccatcctggctaacacggtgaaaccccgtctctactaaaaacacaaaaaattagccgggcgtggtggtgcgtgcctgtactcccatctactaggcatgctgaggcaggagaatggtgtgaactcgggacacggagcttgcagtgagccgagatggcaccaatgcactccagcctgggcaacagagcgcgactccgtctcaaaaaacaaaaaccaacaacaacaaaacattattaaactataataatgttttctatcaagacacaaaatattaaaagtagatcaggaaggaataataagtcaattcattatcaaccttgtgactcttctgtccagcctcttccagaggttccctttacttttaagtgcaatgcaatctttaaccttaactctaaaaactcatttagagtcctccaatttcttatcagttttccaatacagctcaagaacttttccatcagtgaataaaagttgcattacttttccctttcacagcttgttggcagggaattattttaaatgtacaacaaaaatctataaatctgtagcttccaaaagagtgtttgaaaatatattttaaatggcaaaataatctcagtaatcaacagtaatactgaagtaatgtttgaaaattacatttttagaaagtataaagttacatttattacaagtgaagaaaaaaatttttatgagggaatgtttttaaaaagggttacaaattctttgacacttctcccaatgagaggcagatttctgtcaattccccctcaaatctgagggagcttgtgaccactttggtcaacagaatatggtggatgtggtactagatgactttccaggacaggttataaatgggtatgcagcttcaactgagcacagagacttcatgttaagagatattataaccctgagaattccatgctgaacagccatgtgcacacagtacttgacgaagcaacccagccaagcaaagctttctagccattccttaaaagctgccagacttatgggtgaagaaactatctcacaaatttgtgtatggactctccttccagtaacgtaaattccaagagagtaggaattcgtctttgttttattcactgatgtatccacaccattttaatagtttccttttatgtatgcagtaagcattcaataaaggtctgttaaatagatattagtgatggtggcagtggcaggtggagaaggggatatcctattcatgaatagttcacagcagtaaccatgtgcatgcctcgcaaagcagccaaagattttcagagagtctatctaattccaatgaaaagcccaggcttttaaaacggtattttacaaagactgatggatctgactaaagaaatttaaaacttctatcattcaaaaaccataaaaattaaaacataaataaataaaaagctagggaaaacaatttgcattttaattatgcttttaaaatgcaaaaaaaccctttcaaataactcaaaaagacacaaagatttacagatttctttatataaaaaagtgacaaataaatacaaaagaaatacactactaaatcaaccaaataaaataatccaagaatgtcttttttgtttattaaattggaaattctttaaaaactactatctgttaggcttcagaacactgctgacaaaacagcagtttcattctggagaacataacatttctcaaaagccttaaaactgtcattatcccatgaccactccccactacccccaccccagaaaaagtccacatctagaaatttaacctaaggtaataatctgtgatatgaagcaagctttacacacaatgtttttaaactcttagataaaagagcactaactgagggtcatgttcccgacgttagttttatttgcttgtagttgggttttctttggccttcacaagtgtgtcaaaaaaaattcagtaagttgccagcattttaaaatctattgcacacaaacacaagatctgccagcactgggtctgcaagcctcttaatgactattagctaaacagtagccaatcccttcagatgtggcacatgatacacagttcaaaatcatccctaatctgaaagcttggttcatttacattagatgctttatcttctaaagttatctcagttggaagccctacactagagatcaaactttaagcatgcagggcttgctaaacgctgattggtgggccccacccccagagtttccgactcaggacatctgaaatggggtcccagaatttacatttctagcagatttctaggtgatggtccaaagactacactttgatggtctagagaccacattttgatgaactttccttgctgaagccagagagaggcctagcatcctttgaattacacaattacaggatacttaaacaatattggagattccattaatgggggagggaggcaaggaagagtagaaaagccgacggataaacaaccaatagtcagtgcactgcttccctctatcagaggtggaaaaccattgccctacactaaatttaagaataatcctagattaagttgctagtccaaattttctattctacattctttctcatgggccttatccatttctcaaggtttaatgacctcttctacacttcatggataaaataacaggggtaaacaaaaattgtggtaaaagatcccacgtagctccaatattttatgactaacaaatgtgtatcaccagccttaatattttctactgaatttgctttctccagctggatcctatacatagcagcttttgctgaatgcttcctttgttccgggcattgtgctacaacattacatgacttttcatcatttcatcataataacaactctatgaaacggtgcctactatccccatactacagatggagaaaaagaggtcatttgtcaaggggttaggtcatttgtcagagaagcaagcacaggtaaaatctacatctgtatacgggtaatctggctccagagtcctcaattttctttttctttttttttttttgagatggggagtctcgctcagttgcccaggcgcaatcttggttcactgcaacctccgcttcccaggttcaactgatctcgtacctcagcctcccgggtagctggaattacaggtgcacgccaccacgtccagctaatttttgtatttttagtaaagacgaggtttcaccatgttggccaggctgctctcaaactcctgacctcaagagagctgcccacctcggcctcccaaagcgctggggatacaggcgtgagccaccacacccggcccagagtcctgaattttaaccactacacttcatctaaaattcaacttgtacaaattccaatctttcatctaaaactagctcttcctctaaacttgcctactgtcaatgttttcaccttcctgctcaggctgccaggctccaaatcactaagttcctaccataattaagtccttctacatttcacatctgtctttttctttttatttcaattgacctaaatgtccttattcacccttcacctggcctctaaaatgcctagtatttctgcttctagtcttacacccaacggtgctcctcactcattgcctatgggtcaaaggccagcttatttaacatcaaattcaatttaagaccttacctacctcttggatccatttctgtggttccacaaacagattaaaaattatacttaaaacacaccaacacacatgcagagctttatttctgaagaagaagagagaggggtggaaaggaaaaaacttaagaaacaatgttcaatctgaaagtatcacttctaagtggaaggctacaagggataattaatagctaccaaaactgaacactgaaacatcacatccctctttcatggagccatgtaagttaaaaaagaatcttaaactgttgaggtatatcaacatagacaaaatctgaatgccaaagtgagtttcactctaggatcaggttatctggcagctcctgaaacaggacagtttcaggaaccctgtacaaacctcagtgaaatgaaataacttcaagctgtttgttacaggggactcttgtgtcttttagtctaagtaaaagcagcaattttctacaatatatttatataagctgtgcatttccatgaaagaaaggaggtctactgtggatatatgcttggtatgaaattatgtcagaaacaagtgggagcgaggggcaagtcaacatgctgtcactaaataaaagacagacccccagaaatgacctcaacaatcaaagaaaacatgatagtgtaagttaacatgattaattttttaaattaatagactatattttaaagtaatttgaggtttaatgaactgagtagacagcagagtacccatataccctcccttccatttcctttgcacatttattatacttaatgagccaatacttgcatattcttattaaccaaagtccatttacatcaaggttcgctttgttttgaattttgacaaatgtaaaacatgtacttaccacgaaattttacaatatgcaataccaaaaaatacagctagattcaaagagagaatgtttcagcatctcattatctttatcacagtaacataaactgaactccgatcttctcccctgctcccacctagttttcccagtcttcccatctcagtaaagagcaataccttccatccacttgctcagaccaaaaattccttcctcttttataacccatacatccagcccatcagcaaatcctacctgctctaacttcaaaatatatccagaattgaaccttaattctcacactttaccaccaccactggaacccaagacaccattctctcactaggttattatagtagccccctaactcttttttttttttttgcttctgtccacaaactaatcagatcatgtcactcctctactcaaagcaggaactggcattctaccttagagcaagagctacaatcctcacaacaggcctactaggttccacacaacctgtctccacctacctcagttcccttttctgtctatgacttcacctcctgtgtcctcttcaccacttgctgttgaagctacactggtttgcttgccggattacttcaggcagtctctgtccttaaagttttggcactggctgttctttttgtccaaaatatcttccacaaatgctcacacagctgacttcacatcctgacacaaatatcactttcatagttaggcctttttccctgatgaccctatttatcactgcattgttttcccctgtactccttatccctcttacctgctttatttttttctgcatagcatttgctgcaaccaaatatatattctactttgttattttattgacccccccaccccactagaaaataaatgcagcaactgaggtttctggccttaaaaagcacttagtaattatttgttgaatgaataaactatggtgtacagattctcctcaacttacaatgggggttttgtcccaataaacccatcataatttgaaaatatcataagatgaaaatgcatttaacgcacctaacctactgaacatcaaagcttagctgggcctaccttaacgtgctcagaacacatacattatcctacagctgggcaaaatcatctaacacaaagcctattttataacaaagcatgaataactcatttactgaagactgtactgaaagtgaaaacaacggctgtgggtactcaaagtacagtttccagttttcacacgataataaagttgaaaaaccataatttgaactatagtaagttggggaccatctgtcaaggttcctaaaggtgacatacaggtgctagcaactacagtctaaaaaaataaagccccaattctcaacaaatcagtaactgattctggaaacacagaagttcctttgactctcttaaaggcttcaagcccctctatcagaaaaaaatgtctacagtttgaggagactagcctgctgccttcgggatgtccccatctgttttctagccactaacacagccacaaagcataccacacttaggaacagatctatgggtaggacacaagcatatttaggctgctatcataaagataaagatgcattcagccataaatacttaaacaagtattcatactggaaatatgaaacacttttaatcatattcctaacaaaagtaccacgagattaactggctgagaaataatgggggtgatctcctatcgactacaaaagtgggttagaaactgaagtaatctaacctcatcaagcaagtaaagcttcactttactgcactttgcagatgctgttttaaaaaaaaacaaattcaatgtttatggcaaccctgcatcaaacaagtctattagcgtcattcttccaacagcgtgcactcacttcatgtccatgtgacacatttgggtaattctcacaatatttcaaatgttttcattatctgttatgatgatctgtgatcagtgatctctgacactgccattgtaatttctggaggtaccacgaaccgcgcccataaaagatggaaaacttaactgataaaaatgtgtgttctcactactccactgaatggccattcccctgtctctctccctctcctcttgtttccctattccctgaaacacaacaatattgaaattaggccaattagtaactcctcaatggcctttaagtgttcaagtggaagagtctacagctctcgctttaaatcaaaagctagaaatagacacttgcggatgttttctggtaaaatagctgaaagaaaagaattttttttagagacggggcgcagtggctcatgcctgtaatcccaacactttgggaggcggcggcaggcggatcacctgaggtcaagagtttgagaccagcctggccaacatggcgaaaccccctctctactaaaaatacaaaaattatgtgggtgtggcattgcgcacttgtagtcccagctactcaggaggctgaggcaggagaatcacttgagcccgggaggcagaggttgcagtgagccaagatcgtgccaccacactccagcctgggcggcagagcgagactccatctcaaaaaagaaaaagaatatatattttttaaaagctagaagtgattaagcttctgagaaaggtatgttgaaagccaacataggctgaaagtaaggcctcttgtaccagttagcaaacttgtaaatgcaaaagttcttggagaaaatttaaaaagtgctactccagtgaacacacaaatcgtaagcaagagaagcagctttattgctgatatggacaaagttttagtggtctgtatagatcaaaccagccacaacattccattaaactgaaagcctaatccagaacaagaccctaatcctcttcaattccatgaagactgagagaggtgaggaagctgcagaagcaaagtctgaagatgacggaggctgctttacgaagtttaaggaaataagccatctccaataacctaaaagtgcaaggtgaagcaacaagtgctgatggagaagctgtggcaagttatccagaagatctagctaagatcatcgatgaagatggctccattaaacaacatgtcagcaatgtagaaaaaacagcattctattggaagacacaatccaaaacttttgtggctagagagtagaaaggagaaatcctgtcttcaaagagaggagaatgcttgacttcaaagcttcaaaggacagcctctcttgttaggagctaatgcagctggtgattttaaggtgaaggccaatgctccttgaccattctgaaaatctaaggcccttaagaattacactacatcagccaggtgcagtggctcatgcctgtaatcccagcactctgggaggccaaggagggagaactgcttgagcccagtagttggagaccagcctgggcaacacggcaagaccccgtctctataaaataaaataaaaacaaattatgctacatttactctgcctatgctctataaatgaaacaacaaagccaggatgtcagaacatctgttgacagcatgttttactgaatattttaagtccaccattgagacctcatgctcagaaagattcctttcaaaatactgctgctcactgacaatgcaccattgccggagaggtctgaaagagatgtacaaggatataaatcctgttatcatgcctgttaacacaacatccattgtgcagcccacagatcaagcaataatttccacttctaagccttataatttaaaaaatacattctgtaaggctatagctgccatagatagtgattcttctgatgaatctgggcaaagtaaattgaaaattattctggaaaggattcaccattctattgagtcactcatgattcatgggaggagttcaaaatatcaaccccaacaggagtttggaagaagttgactccgactctcatggataatcgagaggttcaagacattgctcgaaaaagtaactgcagatgtgaaaaacacagcaagataaccagaattagaaatagagcctgaagatgtgactgaactgcaatctcgtgataaaactgaaacagatgcaaagttaagttgactctgactctcatggataactgagaggttcaagacacaggtcgaaaaagtaactgcagatgaggaagaaacagcaagataactagaattagaaatcgagaattagaaggaaagaaagggaaggaaagaaagggaagggaagggaagggaggggaggtagggagggagggaggagggagggaggagggagggaggagggagggagggagagagggagggagggagagagggagggagggagggagggaaagaaattgccacagcttccctaaccttcagcagccactaccctggctagtcagcagccatcaacatggagataggaccttccaccagcaaaaaagattatgactcacttcatgaaggctcaggtgatcgctggtatttcttttagcaataaatattttaaaattaaggtagtccactatttattatgacataagcctaccgcatacttaacagactacagtatagtgtaaatgtaacttttatatgcaataggaaacagaaaaagcccatgtctctcactttagtgtgatattcactttattgcagtactgtggtcatctggaaatgaacctgtgatatctctgaggtatggctgtattttcatacaaataaaggcactccccctaaatctagagtctagatcccaaatacatctgtccatatagggggtaccactcccaagaccaaaggggtgtatggctcctatctccagccgtaccaaatcatatatacagtgtaatatctggttactctttattcaggacagctacattcaaaggaaacataaaatgggcagaataaggactccttgctcattaacaaaacaaagccaactcttatgtcagagtacccttttgatcaattagtgtgattatgttcactagtaacagattctaccatcattgttgtccatttcatttccattctcaagctttaaaaccccaaaaggacagaaagagatactacaggctagtattagtaatactaaaaatagttacctcttattgaaacctgaagggcctggtacttgacatatatcattttctaatctttatatgaactcaataaagcaaatattgttatttcaacactattacatattagagactgagcaatctggacaaagtcacacagcttatcagtaccagtaggaattcaaactcaggtctgactcaacagtctgcattcttaaatatacctcaataaagctgttgaaaaagtaaaagtcggccgggcacagtgtaatcccagcacacctcaataaagctgctgaaaaagtaaaagtcggccgggcacagtgtaatcccagcactttgggaggccgagtcaggcggatcacctgaggtcaggagttcgagaccagcctggccaacgtggtgaaatctggtctctactaaaaatacaaaaattagctgggcgtggtgatgggcgcctgtaatcccagctactcgggaagctgagacaggagaatcactcgaacccaggaggcggaggttgcagtgagtcgagatcgcgccattgcactccagcctgggtgacaagagtaactacgtctcaaaaaaaaagtaaaagtctccatctttccactagaccacactgcttttctcaatctttatgacaaacatgtaaggcatattgggttctggataatatgtcaaggagatatactattttggaatattttggcaaataaaggggggctttaaaacatgaaatttttttttcttaataagaactgtaatctatttccccaacttcattattaagtgagttttaggcctaggtcttccagaacagtttcctccaaaacatacagtgtaatatctggttactctttatgtgtgcataagaaatgtcactgtgacaaatgttataaagaaaaaatttgattaccctaaaaacaaatacataaacagcccgcaagtttagctcctaaagtaggaaagaataatgtgaaaatgtttctggctgtaccactcaacaaaaatttgcccgccaataaggaatcctttcttcaaaaattggtcatgatcattagccaaactgtaaccagtaacatccagctggattatggagctaataaagaacaacagaggggatccacaggaaattcaacaggtaacttacaactggctctctcatcagactggcagactgggtctaatccgaggtcagatgacatgggggattatggaagccaataacaatcatatttaaataaatgtcctttacagaacaccaccactttcctcataaaaagttcaaaggactattttcacccctcacaattacagtaaggataagaagcccaagcacagcttgaagcagcaaaattttctgaaaaggaattgaattctgtgttctcttcaggatcttcctttcccaataatgggggtattaaatttcacttataaatcaaactgaaagggaaaaaaagaacaataaaaaatgagctggaaaacctacattcatcatcttcaaaacaacatcaagttagaaacagttttaaagcaatgttacaactcctttagaatctggcaggttttctggtttttaccagatcccgctccggcaacaacaaaaaaagaaacagttttaaacagttttatgggcgtggtggctcacacctgcaatcccaacactttgggaggccaaggcggacagattgcttttcagcacaagagtctgagaccagcctgggcaacatggtaaaattttgcctctataaaaaaataccaaaaaataccaggcatggtggtggcacactcctgtagtcccagctacttgggaggctgaggtgggaggactgcttgagcccaggacagcaagggtgcagtgagccgagattgcaccaatgcactccagcctgggcaacagagccagaccctgtctcaaaaaaaaaaaaagttaaatgctgatgactgaatagaacacaattctctgtaaattcttcaatgtgataaagcatttcctacaccagttaccagtggcagcacctaataagacttgagagcaacttaatacttcaccctcatgtatgtatgaatttaaaatagaacatcacaataactacgaagatacccaaacaccccttccctaatttttttttttggtacaaacaaagtctcgctatattgcccaggtggatctcaaactcctgggctcaagtgatgctcctgcctgggctttccaaagtgctggggttacaagcgtgaaccactgtgcctggtcgcttccctaattcttaacatgtcccacaaaagattctgcttgatcttggcccccactatatcatcactatctctagtaaatagactcaaagcctctgctttctctgtggctctagccacactggcagagaccaaaggagagttcaatgataggccctctcacagaaccttgtgccttaccatacttgtcagttacaattttattcactcgattcaagcattttttggatgcctcatatgtttcaaggtacctttgttacagcagtgaacaaggcaaagcccctaacaggaggaaattcacattccagaggtaagaagagaattaaaaagccaaaaaaaagtgtgtgtatgcatatatatgtgcataagaaatgtcactgtgacaagtgttataaagaaaaaaaacacagtaagaggacagagagtgaagttgtccttgtacagttgacagtcaataacacctcttttaacagtagtagagacctgaacagggtgaagaacagagccaagctgacaggagatctggattaaagctttccaggcagaaggaatcgaaaataggcgggaatatacttagcttgttgagcaaggcaaacagcatggctggagcacagagagccaaaagagaggtgataaagacaacaccaatgaggtaaataaaagcagacagaacttggatcctctagagcctgcagctcacgatatggagtttgaattttagtctacgtgtgacaggaagcctttgaagaactttgaggagggacacggatgtgttatcgacacactataaatgaccagtaacttcagaagcaaggaggccaactgggaggctgcgaaggttgtccaggcaaaggatgataatagcttagactagggtgatggtagcagtcaaatgaggaatgttatttattttcagaatgtaatctgaaggtggagccaagatttgccaatggaatagaatgtagagatgaaaagaaaaaaaaatctattcatctctgcatcccctcagagaatgtacctgaccaccatgaaagcaagggccatgtttgtcctattcaggtccttgaacaaaggaacagtgcagtatgttctagttgaattaataaatgacctgcttctttccctacagaatcacaatattggcatttattttggctggcaaatactggtacgatgtcaagcatagaaattaagcaccttaggagaagaaaagggagttaaataaaaaagagatccatgtttcactgaacttgcaaattcaactcaaagcaccacctgtctgaaaatggaacgtatatatataaaaaaactgctcattaaggaaaataaatcacagtatctcagcaacagtgctttgtcgtgagttacaagattggctacaccatctgacaggattacttaaattgacaaagacctgcctcaccaaacacagctagaggtccttgggtccttgtggtactggtatcaggaatctgataaatcagtcagagtgtggagtgtttttaaaacacagacaaaatatatttagcaagcaaagtctgttaaagggaagattggagatcactttaaaaataattcaaagcctactctaagtatttgcaaaattgtaagattatatttctgtgcttttgaataagattcagattggacagtctcaactctcccttgtgggagagggtaggggtgggggtggacctgttttctactaagaaatttataggactctccaaaaacagaacttagggcagtactccttaatagtgaccatacattagaatcatctagggagggctgggcacagtggctcacacctgtaattctagcactttgggaggccgacacaggcagatcatttgagcccaggacatcaagaccagcccgggcaacatggtgaaatcccatctctactaaaaatacaaaaattagccaggtatggtggcatgtgcctgtagtcccagatgctcaggaggctgagacgggagaatcacttgtgcccagaaaggtagagggtgcagtgagctgagatggtgccactgaactcatgcctgggcaaaagaatgagatcctgtctccaaaaaaaaaaaaaaaaaaaaggaatcaactagggaggcttttaaaacatgaatgctggagacccacaccagataaattaaatcaaaatttaatcgggggtgggtcctgggattttccctttaagtgtttcccacgtgatctgaatgtgcagcccaagttgagaatcaccaatttacagcaataaagtttaaagtagaggatttaaataaaagtcttttaaagaaacaacactttcagaagtcaacaaacttgagccttcatgttaacacgtgggggtcacagtgggcattttggagcacagataaaaggacctgctttggaattgtaaaaggctgtttcatacatacaaacagttcaggaaaggatagaacgaaaacaaaaacaagaaaccttgattaaccccaccacattccttcccaagggcttgaattttttaaccgaacactacaatagcaacaaacctagagagtcagttcaagacggcttctccctgtaatgctgccttagaactctacagaacagcagtcactgctgcacagctaaatacatctccagccaaggaaatctagacatagaagatagaaaataacatcccagtttgtccctcctctttcccctccctcatcacatatcaacagctaactttgaacacatctgtggttcactgtaccacttacaggggtacagaggaatgaaattaccagtcctcactgtaaaataaacacatttctttaagaaattctataaagcacaagaggaaagcaaaaccttagtaaactgacaaatgttcccattctcccagcacatgaagaagactgccacagtctttttcaattacactttgaaaccctctgtcctggttttcaagcacaagctgatcttcacctcattatagatactcaaactgccacccgtcttatttttaaatatcagagaagtgacaaaattctatctatgatcaaggatgtattataaaagagaagaaattttgcctggtttttacatttatttaagtcccttctacaatgaataaaaatggttgttcaaatcaatgggtgaatgggaatacaaataaaatatgggtagcattttaaggcatggtattaaggctaacatgatgtccatctaacatccagtttctgaaaatctgaaatcagaacacaggaccttttcatttcaaatttacattaaagttcagctcactgattaagcatttccctcaataaaattacatttgtcataccttaattgtgcaaaagctgcaaactggtaaaaaacttgaatgccatggcatgattattcaaaaataactggtacaccctatgcctgaaacctgagtgcctactgtgaacctgccaaaatgattacaatgacaacccatcatcttcatcacatgaattactgcaatgtgaacagtattctgctgagcactatacagtaatcaaaagacaagctccacatcctcaagaagcttataaatttgactgaggagatagggctgataggcaagatagcaataaaacacataataagggcctaaatcatgcagtacaaactaagttttgaataccagttcccagcttgcagtctcagacatagatagcaacaccaccaccaccacccttgccaagccaagtaagtaaaaagtaaaatgagtaggctaggcacggcggctcatgcctgtaatcccagcactttgggaggccgaggcaggtggatcacaaactcaagagattgagaccatcctggacaacatggtgaaactctgtctctactaaaaatacaaaaattaactgggcatgacggcgcgtgcctgtaatcccaactactcgggaggctgaggtaggagaatcacttgaacctggaaggcagaggttgcagtgagtcaagatcgtgccattgcactcctgcctgggccaaaacagcaaaactccatctcaaaaaaaaaaaagtaaaatgagtatacaggagtcctaaaaacttgagaaaccaaaggaagcaattcatttggtcaagagaaaggtcagggcagtttcaaccttcccatttatttagctgtgtgactttcaacaatttacccaaccctttaaaggaagatagtacctactaattaccatgagaaccaaatgagatagtgtatataatgcgctttgcacaatgcctggcacatagtctcaaatactgcctattatcattactgttagaaacagtaaaatcctagtgttggcaggggcctttcaataatccaattttccagtcgaatagttctcagggtgtagttaccatcagcatcatttgggaaattgttagaagcccatactctagggctccactccagacccactgaatcataaattatcaaatctgcgcccagtaatctgtgttttaacagcactccaggtaattgtgatgaccattaatgttagagaattgctgccctaattaaaccctctaattttacgtataaagaacatggaggccaggttcagtggctcttgcctgcaatcccgacattttgggaggccgaggtgggagaaccacttgagtccaggagtttgagaccacgtaatatagttagaccctgtctctgaaaagaatacaagaattagctaggcatggtggcatgtgcctatagtcctagctgctcgggaggctgaggcagaaggatcacttgagcctgggaggtcgaggctgcagtgagccatcatcataccactggacttccagcttgggcgacacagcaagaccgtgtctcgaaaaaaacaaaagtaagcagatggaaacctgaagagataaaataacctgctcaaaaccacaatcatggagactgtttgtttagggtccattatatgccaagtaccagggtgaccactttttacatttttaacatcaggtcctcacaacagcccagctgggccccaattaacagaagaaaaactgaggttcaggtgtgagatggatggagtaatttgtcaaaggcggctcaatttttaatgggcaaaattaacattcaaatccaagttgtatgtgatcccaaacccttactgaaaccaggaccactgagtgttctgagggaacgataccaagcacacgcccagacttccccacccaagggcatcgttcttttcattctatcataccaccttagctgcaatgattttaccatgaaacataaccagaaattagcactttaaagcaactctcagaagacaggtggtaaacgattcttcactccaactagaaaggaaaaaatgacaacatactatgaaaaaagctatgaggcaggaaaaagcacacgtcaaggcatggagatacggatatagactaggtaattttgcaaccacataagtgaaagaaaatttgctatccaatcttcctattctctactcccaagagcctagtgcttttgtatagttttcagctcagtaaagtgcctccagatttataaaagctcaatgacaataacaaggtatctttattacaaaatagttgttaaaagtttgattcgaaaaattttaaggaaacctttcaggtaactgaaagtggagggtaggggcgcgactcatgaaggagttttttaaccaaagaaatgatatgatacatttttaaatgaccacttcagttgcaatataaaataacagattttggaggaaaatgtcaatacaaggatatcaattatcaattattaggttactatattggttcaaggagagatgatggtggctgtggagatgagtgaaatcaacagatccaagatatattttagagagtattgtagaagactaggaatgggagtgaccagacaggaatgaagacttctagacttactgcacactgtcatgaggaaggatggggatggaagggtacagtggaataagctgggttttagcagaaggaatcaagagccccattacaaacacattaaatggcctggcgtggtggctcacgcctgtactcccagcactttgggaggctgaggcaggcggatcacctgaggtcaggagtttgagaccagcctgaccaacattgagaaaccttgtctctactaaaaatacaaaactagctgagcgtggtggcaggtgcctgtaatcccagctactggggaggctgaggtgggagaatcgcttggaccctggaggtggaagttgcagtgagctgaggtcgcgccactgcactacagcctgggcaacaagaacaaaactccatctcaaaaaataaaaaataaataaaaataaacacattaaacgtttataatgtatttacaagactaacaatcagataaagtctgaacttcagaaaggagatagagctgacctgaaaatataaattacgaactattgttatatgaatgttacttaaaagacgaggaggccaggtgtggtggctcatgcctgtaatcccagcactttgggaggccgaggcaggtggatcacttgaggtcaggagttcaagaccagcctggccaacatggcgaaaccccacctctaccaaaaaaaaaatacaaaaattaatcgagcacggtggcatgcacctgtcagcccagctactcaggaggctgaggcaggagaatcacttcaatctggaaggcggaagctgcagtgagctaaggtggtgccactgcactccagcctgggcaacagagtgagactcggtctccaaaaaaaaaagggcagaagatggggcggaagaatagagataggaaagaggaggatgttgagaactaaaccctgaggtacttttagtattcaaagtgtaggggggtctggaaatcttgtagagaccagtaggggttggagtatgacatcttccaataatgaattctcgttgctgtccccttatgggtctgggtctacctgatagtctcttctggaagtcggtatcacttgtgcttaatttctactcttttgtgccctctatacagcctctactacaaatcttttttgaagaagcacagggagaaataacttggggaaaaaaaaaagcctatcttttagaaatagattctgaaatatttacagatgaaataatatgttgtacagaattggcttcaaaatagtccaagtaaggggtggtctagataaaaaaaaaaagaacagctctgagtagatgcctgttacagttgggcaatgcacacatgggaaggttcactgcactggtctctctgaatatttcacaataaaacataaaacatagtatggaaggttggcaaacacaagtccatgagaaatctctccatcttacccagattaacgagagatacaaccaaggatccacaggtttgatgcagacattctaaaagattcaattataccaagactttaaaggtgacagatttttttcccctcaactatacatttttttttttttttttttgagacagagtctcaactctgttgcccagactggagtacggagccataatcatggctcatttcagccttgactttactggctcaagcgagcctcccaagtagctgggactacaggcatgccccaccatgcctggcttttttttttttttttttttttttttggtagcgacaggggcctgctatgttgcccaggctggtctcaacctcctgggctcaagcctcagcctcccaaaagtgctggattataggtgtgagccactgcacctggcctatattgctatcttaaaatgtctcagtgacccaacaatttgccaaagagcatgtagagcaaactaggctctattcagcatttccatttcttaatgtatctatttgatttcaataaaatttcatcattttgaagatctctcccattagcttgggaaactacagaaacatgcacataactactgagaaggtatcaagtgttcctacactagtttaaaaaaatcattcaacacccacataaattctgatatgcactaggctgaacagctgttaaccactgagaagctgggcactgcatcctctccctgggtcaaaactctatatgctaatcaaacagggtcatgtatttgggaaaataataatccatggtaaaagtcacaaaaagaccttaattttaaaatgagaattcctaatctatacattctttaaaaaatctagggtatataggttgatgtaccttccttgatcaaaactcttacttctctgaagcctgtcagagtattttcaccacaaggcttggattaggtttcattttacatatgcatgcacatgttcacatacccataatcatccttcttagtagtatatagagacggaccatatcgttaccctcttctgctcaaataaatgtcttcccctacaaatgctaaggagtaaaatgatccagaaaaagtagaaatttggcataatcagcactgacttcctcaacggtaacatacatgacataaacacattaggtagactggatgcccaaaggccaatccaacctcatgtcttcctggcatttctcaggcctttctcgtcacccaccccacctaggttccacgtttccaaaaaagttccatgaagattcaggaaaaaacaaaaagggaggaaaactcattttattaaatttacatcatatccttcttcccagggttcaaaattaaataaaaccaaaagaagaaaaccagaaagacaaaagcacttttgtccaaggtggcaaaacacaagagcaatttaactgccattatgaaccaacttatactaaaatagtatttcctggaatgtgtataaattaaaaaacaaaacaaaatgttcatggttacttttactttcagggttgggaactgaatcccacaaacagcagctaaacctcaaaaaaattgtaattccctaattatttccagattaaaacacttctcttgaacacatgtttctgctgttctttggggtgagtgtagggcacagctggagtacagtataacacagaaacagcaagtgcactaagagcatcaaatccttccccccaaaattgtttatctcttccagactcctattcacacttattcccctgacttaattttaattctgcctcttggccctcttaccttgtccctttctaccctactcacttattctctattcatcctcattctctgaaatgatagtcaaaataatacttcatgctaaagcattttcttaaatatttccagatattccaacttgttatgatctcccacttctttaaaccagaagctattactacttttagagtgcatacctatttctgccccatatttatcacatacaacttacgtatgatttagttagcatcctcaaacttagaaaatgattctcgcagcccagcaaaaatccttactatagcagccaatcaatatctattgaaaaatacatgtaccccctcgatacaattgtcataaaagttttcagtgtgcacttaatttgataatgtcacttccatctttctgttttgaaaactgtttcgccgggcgcggtagctcatgcctgtaatcccagcactttgggaggccaaggcaggctgatcacaaggtcaggagatcgagatcatggtgaaaccccgtctctactaaaaaaaaatacaaaaaattggccaggcgtggtggcgggcgcctgtagtcccagctactcaggaggctgaggcaggagaatggcgtgaacccaggaggtggagcttgcagtgagccaaaatcacgccactgcactcaggtctgggcgacacagcgagactctgtctcaaaaaaaaaaaaaaaagaaaattgtttcataagaatgactcatccttcaaaggaaaaattcagatgaaaaggtgtctgcactatgtagtgtgttaaaatttgttctcaagcctctccagctaccctcaggagtgaacagtggcaaactgcagcttaggctagtgaagtgatctgccctacaccatcaagttagccaagaatagaagccacatttcctgactcctgccttgactcctgatctctttccacacatgcaaatacaagttcagcatcccaaacccaagatccaaaaagttcccaaaataggaaactttctgagtgtcaacatgacactcaaaggtaatgtttattgaagcattttgggtttccagatttgggatgttcaactggtaagtacagctgaccctctgtattcatggattcaatcaatcaaacagcaaaaatatttaaaaaacaatgtctgtactgaatatgtacagactttttcttctcattattccctaagcaatacagtgtaacaactatttacatagcatttacactgtattaggtgttataagtaatctagagatgacaaagcatacaggaggatgtgcataggttatacacaaatactatcccatcttatatcagggatttgagcactgtcagatttggtatccacggaagttcgtggaacaagtcatccaagaatactgaaggataactgtataatgcaaagattccaaaatccaaaacacctctggtcccaaacatttcacatcagagagactccacctgtaatggctttcagttctgtaaatcaacagcacatctagttgtgtgaatacatacgtggctaaggttcaaagtactttaaaagtattaagtccaagacaaagatgagatagtattcctcacctgatccaagggtcacacctgacagtaagaactggagtcaaaggatcatcactgtaacccatcaacataggtacagttcacaatattaggagaagtcatgaagtaacatacatacaggacacacataaatttcacctctaaccaggaatcctgtgatagaattcattaaacctattctcactcaactacccccagtggcttatgaatcaatcctaaaggcatcagacacaagactattaccattacaaatttctaatctgctaagaagtcttgagttttaaggaagaaactagtgccaattcattaaaaaggaaggcagaaaaatggaaaaccagaagtctttcattgctgctctatccccataatctaaaacaatacctaggacatcacaggaaaccaatgtctatttactaatgtctatttacctcttagcctttattaaagtgaactcatagtattgacattattttctcatcctcacagggcatttgaccacattttggaaccaagtttaaaatctttcataggccaaaaaaaaaaaaaaagtatataatgactaacatgctttaaataccatgacaaatataattaaatacttgctctcactgaattcaaaatttttagttccctcaaggtgaagttactcattttccattatttctctctaacatcaatttctccaccagatttcctccacctgtgccactactcacccatctaaatgtgcacatgtgtactcaagcattcaatgaattgcttattatgtactactcagcacgaagaagcagaggaaacccagcctttggagtgatatgaacctgactctacttcttgttttaaccaattactaagccttgtgacctcgggaagtcaatcattatgtctagtactcctgttgcctaactgtaaaaatgtgaaggattattacgtacataaaagcataataccaaaaataggcactaactgattgttagtttccgtccctctcctacaacagcaccctgactttggaaactaaccctccacgaactgaaagcattctcagaatatactgtccttaaaaaaagaggaaggaatgaagggaaagaaaagaaaagaaaaaggagagagggaagggaaaaggcaaaaatttttaaaaatacttttggtcctggtttacaggccaccacaataattcaagtaaattagcataatccagagagacaaaaactttttctattttttactacaccaaaaaagctcataataaaatttcaaagtattaaaaaataaatgaaagtaatcccttcccttcctccatcccaacccatcccatccctcagaaataatcactgttagcactctggtgtgcacatatacacatacacatacatacatatatatttttgttgccaaaattttactgcagatatctggaaaataaagagtagcataaagaagaaaaatatgtaatctatacaaccggaaaaaattttaagctgcaaataagtttccacaactaaatttacattgtaaaacacatgatggggaaaaaaaggtctttacaataaatatggtacaaggacaactgaatatccactatccacaggcaaaataaaattggattcctacctcacaccatacagaaaactaacttaaagtcgatcaaagccctacttaaatgtaagcattgaaactcctggaaaaaagcataggagtaaattcttcatgaacttgggttaggcaatgatttcttatgctgtgacacaaaaagcaaaagaaacaaaaaaaaaacataaattggactatatcaaaatttaaaacttctgtaaataataatcaagaaaatgagaatacaatccacagaatggaagaaaatatctgaaaatcatctatttgacaagacactggtctccagaatatatacaaaaaacacaattcaacaatttttaaaaaccaaataactttagaaatgagcaaaggatctccaaagaagatatacaaatgaccaattaagcacctgaaacgattatcagcatcattagccattagagaaattaaaatcaaaaccacaatgagataccacttcacattgactagcatggctataattaaaaagacaattagaagcattggcaagaatgtggagagaatggaacccacaaatatcgctcatggtaatacaaaatggtaatataaaatggaaaacaggcagttcctcaaaaagttatacacagggctactttatgtgttaaatgctgaggatgcataaaggatcagaaattcagataaagcattcccagaacagtgattgatcctgtttgtttaaaaaaaaaaaaagacaatgtactcaacaattaactaaagtacttgtatttctctttacaaaactaagttatgtaagaactaaacattttaaattgaaaattgtttatctggttctttgaactgaaaatccttttatattcccacctgtgagtgtacacaacaaggtgaagcaaatgcattaaacccagtaggtctcaggacaggaagcatttacactcagaggctatcccacagagcaaaatccacactgaagactaaatcatttcacagaaccctagatttagataaacttggagacaggagagcagctgaagagcccttctctttcctcaaggttgtctacacatctaaatcaacttcactgggggagcataggggctgcttaagggtctaagacaaataaattcttctatgcaatactttacatttatttacaaacggtctatcttacactaagctcaaaatattccactgagctactgcagaaaatctgggtgcgaaataagaaaagacaatcagagagtgtatactcataaaaggaattaaaaagaacaaaatgcccaagaatacagtatcctcacaaaaaataccctaaatgaatctagtaaaaatttggcaacccatattctggaaagatattctttacaagttaacctgtatgtcttatgcaacttccaaagtcccaaagaaagtaatacaaaattaagtggttttgagatactagtcagctttttcggaaagagggttagagaggacttacttccttgtattatgaaacaaaaaacgctctgatgaattaaaagggtagtttctttctttatttctctttttttcagacaagtctcactctgcgtgcccaggctggagtgcagtggcatgaccttggctcactgcaacctccacctaccaggttcaagcgattctccagcctcagcctcccgagcagctgggattacaggtgtgtgccatcacacctggctaatttttttgtattttagtagagccaaggtttcactatattggtaaaagggtagtttccaaaaataaaaacatgtacaaggaaatttaaaattctcctattagtgtctggaaggatgaagaatttctactattttaggttgagaaagaaagctaaaggcaaaagatcaacagacaaaaatttaaacaatttataatttctaacttatccaagtttgactccaatatttttaccaaaggataaatatctctgcttcaaagaatcataaaaacattacaacagcctggcacagtggctcatgcctgtaatcacagcactttgggaggccaaggcaggaggactgcttgagtccaggagtttgagaccagcctgggcaacagagcaaaaccccatctctacaaagaaaaaaaaattttttaataaggggggcataagggtgcactcctgtggtcccagctacttgtgaggaccacttgagtcctggaggttgaagctgcagcaagctacgactatgccactgcactctagcctgggcaacagagcaagactgcagactgtatcaaaacaaaacaaaacaaaacattacaacatatgagaatgttcaacttcactaatactttcccaatgcaaatttaagtaaagatagtattttttatttatcagtttagcaaatatttttaaaggatcctccatgctaattggagtgtggttaaacaaaaaacctgcttgttacactgctggtatgactacaactgggaaccttttggaaagcaacctaacaagatatatctgtagtcttctgaattgttcacactctcttttattcttagattcatacaatataaataaatacaaaaagcaaagcctatgtgcacaaacagcaagcatcagaaagtccatgaaaagaatagtacaagtatatagtaaaggaattaacttatactttgcttttcaaactatgttcaatccaatagatttctaaatatggcaagtttctaaaaatccaactccttaagtacactgtaaagacatttatgcacacagctaaaatatactcaaactaagaagtcctcaaaggccgtaagatacactaaaaatataatacctcccagtgaaataaagggaaaagcagaagtcaggtgagaatatttacatatatgtacccattcagcagttctgtagaagtcattatcttctttgggaggccgaggcaggtggatcacctgaagtcaggagttcaagaccagcctggccaacatggtgaaaccccgtctctactaaatacaccaaaattagccaggtgtggtggcaggcgcctataatcccagctactcagaaagctgaggcaggaaaatcgcttgaacccgcgagacagaggttgcagtgagctgagatcacgccattgtgctccagcctgggcaacaagagcaaaacttcgtctcaaaaaataaataaataaataaataaaaaggccgggcacagtggctcacgcctgtaatcccagcactttgggaggccgagacgggtagatcacgaggtcaggagattgaggccatcctggttaacacggtgaaaccctgtctctagtaaaaatacaaaaaattagccgggcgttgtggcgggcgcctgtagtcccagctactcaggaggctgaggcaggagaatggcgtgaacccaggaggcagagcttgcagtgagccgagatcacgccactgccctccagcctgggcgacagagcgagactccatctcaaaaaaaaaaaaaaaaaaaaaaaaagaagttgttatcttcccagtagaagagatgagaaaatttgaggtccagattggttgagtgatatccgaggaccacagagctagtaaaattatggagctagaacttgaagtctgattccaaatcacatgtttcctatgctaccccaaacaaagggagtattttctacagtggcattacaacagaccaagtaacagcagaggtaaaacaagtttcacatgtctgtggctctttgttttttacaagtttttattactttgtcatgggggggaaaacgaaaaattataattaggtcaaggaaagatataactatactactactatcattctgaaggaagggaaggtataccttctaagtcctgcatagtttaaaaattcccattacttgcgagaccaggtgagactgcacagttctagacttcctatcgtgtgccaaaactctagggataatcaaaaaatgtttgttgaatgaacgctaatttaaaatagaaaaagaaattccagatttcctcctcagtacaagaggcctgcaacaacaaacttctgaaataccagcagtctactaattgcatattcaaatttaaaccacagaaagttgaatcaactctgccaatttctgggactctctaaatgaactcttaatacaaaaatacatactcaggctcagcattttttctaatcatttacaaaagtaaaaggacgtcaggacaagttctggtgaaattttataaacagccatgaattgcagctgtagactgccagatacataacctgtatatgacagggggtaccacgtggaaattagagacatcccccttcaccaaaaagattatatccaggggatactacataataaaaaaaaaatctgaaaaatgtaatgggattaagatcctttagaataggctagtagtgatgattttgctttttcagtcccctcctcacaaacaaatgatgatgacactgcccttagctttctatgtgcaaagacagtattaaccttcccaggccaaacttacgactacaccttttccacacgaaatgcaaggcatttctaactccccagattacctcacattcgttggatgccacacaatagattataaagtatcaagatatatattaatttttaaaagttcaccaggagttggatattctaaactgggtttctgattcttaacagtgagaatgaagtcaagctccttatttggtggttagaggagaggatttggccagaaataattcttttaggattgacagacaagtactacttaagttctatcatctcatccaaaaacttgcttcttatattctgcttttaacccgatctacacaatgaaaagccacggagactagttttgcatgaaagcaaaggacttttctaatatgacttcagagcatgccatgctttaaagtccatgttcaaccacttactatcattttccaactcactctctatgggcccatcccatatttcaactacaggtatacctcctggccctttctatttcataagcttctttggaagacaaatctactgatttatgcaataaactttctacctctacttaaccaatttgataatttaatagctggagataattctaaattccccaaaccttaatcaagaattttggaaaaaaagagctatctagaacagttatcttcctgaaaacactgttgtgctaaactgaaacacagccttttctcaagagctaagcagctacttgggtctacattttaatgcactaaataattttataagatcatgtttgaaaccaaaaaacccaaaaaggattgtcaagctaggtcagcttacaaaaccccttctgttatgaactaggaaatcaaacaacaaaacataagctctaggaaatgagcatggaggtgctccatccatactagcttttccttgtttttttcttgagaggagtgactctctgtcacccaggctggagtgtagtgatgcaatcctggttcactccaacctccacctcctgagttcaagggattctcctgcctcagcctcccgagtagctgggattacaggcgtcgaccatgacactcagctattttttgtatttttagtagagacagggtttcaccatgttggctaggctggtctcaaattcctgacctcaagtgatcctcccaccttggccccctcaaagtgctgggattacaggtgtgagccaccgtgccagcccatactagcttttctgaagcctctttactcattcttttgttctctactctagcagctaaagacatctcctaaagaaacaactagtgtgcctccatacaacccctcagtaagcactcagtattgagactaaactgtgaaaagcactaaaataaatgcatcattcatctatgaccttctgagaataccaccacctcatatttgaatagacgtctagttttcatgagaactttcacgcactcatttgatcctctttaaaaaccacaggaaacagggcaagccatcttatcagctctatttacagagagggaaatcaatttgaaaaggttacatagcttaatcaaggtcacaaagtgactgactggccaagctggtactcagtcttatgatagtccagggctctttcctctacactgatcctaaattgaaaaaaaaaattttttttggactgctcctgcaaggtagggctaccccataggcagagagtagctgaaaaattctgtatgtgtctatcacaagaagttgaggccgggcgcggtggctcacgcctgtaatcccagcactttgggaggccgaagccggcggatcacgaggtcaggagatcgagaccatcccagctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaagaagttgacaggcctaaaaggtttcacatttagatgtttctttttttggaaaaggtgaagatctggctgggcacagtggtgcacatccttaggtagttccagctacacaggaggctgaggcagaagaactgcttgagcccagcctgagcaacacagtgagactccatcactaaaaataagtaaataaataaatcacataaaaaataaaaaattttaaaagggggtaaagagccaatgaattgactaagaaatgtgttgtttcaaatcagaatgaccttgaaaagccatagtacttgcatgcaaaaatatgatccgatttaaaaagtcaatatgcttaaaatacaacagaaaaatcaaccaatatatgtatttcgtattactggtttaaaatttctgaatatgctgtaaagagaaggaggtgaaaaacgtcaaccagactggggtggtggctcatgcctgtaaacccagcactttggaaggccaaggtgggtggatcacttgagttcaggagttcacgaccagtgtgggcaaggtggcaagatcctgtctctacaaaaaatacaaaaattagccagatgtggtagcatgcgcctgtagtgccagctactcgggaggctgagatagaagaattgcttgagactaggaggcagagggtgtagtgggcagagatcataccactaacccctccagcctgggtgacagagtgagactctttaaaaaaaaaaaaaaaaaaaaaaaagagagcgagagagaaagaggcagagagagagagaaagatctcaactgataagatactacataatcacattatctcttgcttgaccaacttaacaaatatttcaaaatgtttataaaaatcaaaatgggtcagcattggaagaagttgtaagtaaaattcaggtgttctccacatgaggcaactgctgttaatagaagactatatgacggtattttctcgaagtttggtacaaagatcaaaaatagaatcacaggcaaaacccttgaaaggcttaggaatctgaatttttaagtactaggttgttgatgaatataaaatttaaagatgtgtatttagggtagaaataaccttgaccttggtagctgtggaacttgtgtggttactcgttctgggccctggttttcccaatggtaaaacagaggaggtagggacacaaacgtcctacttcatagaaaagttataagactttaaaggcgatggtttataaaaagtaattagcacacagttttgacacacactaaataataattagctactatggtggaaattttatttctatttaacacttctgacattagcaaatagtgtaccaaacagacatgctttttacatagttacatgattcttctcaacaaccgctcccccgaaagaaagcagtttttaagagggtcactctcatgatttgaagagaactgggagaggaggaacataaatcagttctgtcacattttaaggattagaatttaaacattaaaaacaattttaatatgttcacatatataactatcacctggttggaccatgacaaaaacccacccctaaccataaacaagggtaacctatcatttatcaaaaacaggaaacgttcctatctctcaagatcagcgctctgaactaattatttaacataaggtcatttttacgagttcacatgctgaatggcttacaattaaaagcctcttctaacccaaatcaccatcctccttcacttacctttttttttttttgagatgggagtctccctctgtcgcccaggctgaagtatagtggcacaatctcagatcactgcaacctctacctcctgggttcaattgattctcctgcctcagcctcctgaacagctgggtacaagcacccaccatgccttgctaatttttttttgtatttttagtagcgacagggtttaaccatgttggccaggctggtctggaacgcctgatctcaagtaatctgcccacctcggtttcccaaagtgctgggattacaagcatgaaccaccgtacctggcctgttgcttacacttaaaaaaaaaaaaaaaaattcctcccctctccctagactcctaacctaatcaagttaccaaattcaaaaaattattttatctcacccattcttgcctctttttttcttttttttttttttttgagacggagtctcgctctatcgcccaggctggagtgcagtggcatgatcttggctcactgcaagctccacctcccgggttcacgccattctcctgcctcagcctcccaagtagctgggactacaggcgcccaccactgcgcccagctgattttttgtatttttagtagagacggtgtttcacgtgttagccaggatggtctcgatctcctgaccttgtgatccgcccgtctcggcctcccaaagtgctgggattacaggcgtaagccactgcgcccagcctgcctctttttttctactagggctatcacaattctggccttcatttcatttgacaggaaggcatgggtttataccctaaccagaacaacaatgaacaggatttctgcctccactcctctaatccaggggttggcaaactttttctgtaaagggccagatggcaaatatttaggctttgcaggccacacagtctccgtctcaactacacaactcttgccattatagtactaaagcagccacagacaatattcaagtgaatgagtatgactgtgttccaataaaactttacttacaaaaacttgccttagactgcatttggcatacagggcatagtctgttgattgtgctaatccaaccaactaatatcaactttcctaaattccatcacagatcatgtgatttctgatttaaaagtcactttccttggctgggcacggtggctcacgcctgtaatgccagcactttgggaggccatggcgggtggatcacgaggtcaggagatcgagaccatcctggctagtagtagagatgatgaaaccccgtctctactaaaaatacaaaaaaaaaaaaaattagccgggtgtggtggcgggcgcctgtaatcccagctactcgggaggctgaggcaggagaatggtgtgaacccaggaggtggagcttgcagtgagctgagatcgcaccactgcaccccagcctgggcaacagtgcgagactccatctcaaaaataaataaataaataaaaaataaaagtcactttccttaccaaaaaaaaaaaaaaaatagaacttaacattccttggcctgatactcaaaggcttcctccatgagtataatcttcattaaccttggtcatttcctttttctcatactagattccaaattgtattccatgattgtggctgcttatactgctctaattccaaacctttgctcaatttgtatacagaatgtcctttcttctttccctctaaacacctacatctcccttgcttcccacactaccacctagaactaaaatccatctatcctctaagaagtctccttccctttacccagaaattcttcttcagcagaacttctatggcacttaatctgtatcttttctgacaatgattgctttgtatcttttaccacagtgaattatatcttagatcccctaagcctgtgggcagaatttatttacaagtcatctctgtatttcccacagcactttacaatcaagagataaaaaaacaggtattattgtttcaaagaaaatattcctacaactaaattcctttacataacatagcactgttaataagaccaagacacacttattctgtattaaaatgttacctaaaaactaatgacactggctcaacaaattaagccttcaaaaattagtctccatcttattacccagagggcagcatggcaaagtgggaaaaggaaaaaaggacaagattgacatcctgattctgccattgttgttaaatttctgcttccttatcttgtgaaacagatgttaccactgcctacctgggaaaactaggaataacgactacagtaaattattatgcattatggcttttataaacagaaatttaagaacagctaagttaactgcaagatccctattctgtcaaaaaaaaaaaaaaaaaacacgagtatcttgtgttcagcattatgaatataaagaataaagacatgagcagtctcataacatagacaagttcagtctactgtagatcctttcacagagaagtaatacaacatactgagtgctaaccttccagctatttctaaaaagatggaagtccaaggttatttctaaattattttaagcataaagctaaatatttaagaatgagttataactgagtttctaccaaattaaaacaacgatgcttacaacagcttacagggctcctgatctcaccttctaccactcattctatacctggatcagcatgcatgctcctgccaccccgggcttactgatgaaaatccaacaaaccgggctcagtcccatcttagggcctttgcaagtgttctctacaccttgaatgctcttcctcaagatcttcacaggtcttgctcacacacttcatacagatctcattcaaactgtcacctcctcagagaggctttccctgaccaccctattaatatagacatctctctcccataaccatcactttcaatctccttaggctctttcctttttatatctctttatagcacttgttaactagccttcggtcattatttacttatctgtcttccctagtaggataaaactccctgaaaactgtaatatcttattggctgctgtactccttgtaactaaaatcatgcctggaacacactgagtacttgatacatattaatttttaaattgatgaataacatttgtgagtgacgaggaatattcatcattgcaacttacataatttcttaaaccagctgcttacaattaaatctagcatgttgaggctactcctagaacaggggttcttaatttggggctttagggaatcattaatacccatgtttctggaaggaaaatctacagcttttctttaaatggtccctaatctgaaaaacatcctagaccagtgatttatgactctggctacatcatggaatctcctggtgaattttaaacatacagatgcttggatcccatcccagagggtgtattttttctcatctgtggtacaaccacaggacttctaaaaaattacccaggtgattctagtgtatagcaaaagttgagaaccatgcaatttgaacacaacaaatgttaactgggtgagagtcctcaaaggtacttacagtgggaagaaaacaaaaattgaaaactatgaattttgagggaattggcattgctggcaaacagatcaatacacaagttcctgaataattctgtatcataaaaacattttaaacaaaaactagtagctctacctccacttaaatactaacctgacattgagattctagagcttactcccagaacacaaataacacctttcacttaaaacaacgtatttcagacaaacattcacttcttaataacttacttataaaaacctaaaactatcaagaaaacaacagaatactttttgaagacgaatcagctatattacaactatgaagctctttgtagttttattcctaaaaatgcctttgaagcaacacatttccaccaattaatgtcctcatttagcctcaactgttacacaggatgacaggccctgaatttaggtgaaactaatactgacaatagacacaaaggggggggggggatttcagagatttatttagatcatgtcaaaagggtttgaaaagagcaggtgtcagactgacacaggtggtaaattgttttctttttgaagtcaaacaagcaaacattgagtaataagcgaattcactgataccaaccgagggtttcataagttactggtttttataccttcatccaagtagcccttttaaaaaagggattagcaagatagagagcaaaacaacaaaatgttaagtatttgtaaaataaataaatccagatgcttaaatccacagtgataaataattttaaattattcctggatacttagaatcacgatgaaactcattccatctatccctttctttctttattcttggctgtatggagatacctgctgacacagaagcaccaggtcatgagcacatctgacataaaacattacaaacttaaagcagtattttttaaaatctaaagggcttagggaagacagccatgctcctagctatgaagcctctgtggcttgacttcctggtcatatcacaaggatttttttttaaagtattattcagttcccttgttgagtaagttaatttactaggaaagtgcaaacaaagacatacatgcaggtacgcagctcatcaacgcattttagttgtggggaaagatcaggcttaggagacacgaataattataaaactattagagctggaagagccctctttaaatttcccttctagaaagatgggcacaaggaaatccttagctttctatgtcgttttactcggtaaaatagtacactcttattagtaactttatcttttatcaaaagcctgtggaaataaatgttctgggattaactagtaaatatataaataaagccacagaaacatattcccaaaatgtgggctggaaatgaaaacagaacagcatgggatacaaaaccccactggctgtttacaaaatgtttcgtgtacatgacttttatgtaataggaacagaacactagtataggaaatgaagactacatggaagggctggctacttggaggtgacggagttaaagatttcatgaaccatcaaaagaccaggtcatttatacactagattatcaaaccagaaaaagtctgagtcccctcattccattacatttgaagaaatgagaagcaccaaaaaaataaagtatcaatacaaagaagagagagaaactaagacaatctgaccctgaaggaatcgcaatgtggagggaaaacccagccctaggagttaattgtctaagtcaggtaagaaaagagtgaaaaagttgaacagcacaacagactatttcatgaacaccagatgcctcgatatgtaagggctttaaataaagagaaaacactctcctcatgagctgctgcttcagtgcctagttcttcactcaactatacccccctctaaatcagatgcagcattttgaaatcgacctcactcccttaaccacacttaatttttggagtagaggttaatgaacacaccaggataaaacgatgtctagtttggcaggagtgggagtacaaaagtaaggggaaaaagacaagaaagaacaaagcactggttcgcacacctctctccaccccagttaagctgtggaaagctgactggcatatccacatgcttaaattatacgttactggcaatgagggaagtggggaaatgctaacattctgatttgtcccttgacaaatgagggaggatattcccccctcagggttgcactttaagaatttctacttgcaatgctcactgcagcctcgacctcccaggctcaagtgatcctcccatctcagcttcccgagtagctgggactacaggtgtgaaccacaacatctagctcatttcttgtggtttattgtacagatgggcgtcaccacgttgcccaggctggtctcgaactccttgagctcaagtgatccccctgcctcagcatcccaaagcactgggattacaggcctaagccaccgtgcccgggctctcaccacaattataaaaagagagagaatgaagggaagggtagaatttcctctttaaaagtggtctgactcaccaaaccatcttcactgcaaagccttaaacagtaccagaatacaggaaaaggatattgtatgcttttcttagagctgggacaaagaaatgagagggtgtggtggggggaaggagtaaacaatcagagcataagtaacccatattatacatggtttatatgatgccatctccaggtttaatctttcccttttattattttatgattattttaatggagatggggtcttgctatgttgaccacactggcctcaaagtcctggcctcctaaagtactgggattacaaggtataagccaccacgagcagcctaatctctcaattttagtttccttaccataaaacagacacaatgcttactatacaattaaaatatgctataaaatagtaagtgaaataactatactaaaaggcattcctggcattcagaaaagttgatggtagcatcctttccccctcaaagataggtacaggaggccctaatccaatagttctcagccagggatttttttttttttttttttttttttgagatggagtcttgctctattgcccaggctgtagtgttgccatctcggctcacagcaacctccacctcccgggttcaagcgattctcctgcctcaacttcccaagtagctgggactacaggcgtgtgcgaccatgcccagctaatttttctatttttagtagagacaggatttcgccatgttggccaggctggtctcgaactcccggcctcaaatgattcgcccacctcggcctcccaaagtgctgagattacaggtgtgaaccgctgctcccagccttggggattattttgaccttaccccaacccccaaaagggcacatataataaagtctggaaaaattttgttgtctcaactagggtgagggaaggtcctactggcatttagggggtagaggccagagacgccatcaggcattcttacagtgcacagaatagcttcccatgacaaataattattagtcccaaaaggttaatggtgcctctgttaagaaaacctgcctaaaaaacattcatttttggaaaaaccacataaacacagaagaggagcataacactctagttcctacagtctattaaaaaaaaaaactatttaaaagatattacaggctaagtgcagtggctcacacctataataccaacactttgggaggctgacacaggaggattacttaagcccaggagtcttcggctgtagtaagctatgatcacgccactgcaccccaacctgggtgatagagtgaaaccctatctctcaaaagaaaacatactctaagaacaatcctttcttgtgatagctattactcaaatgacaaaagctgggggaaataccttgtaaatatcagaaaaaaacttctcctcctaagtagtttaaaaatatgcagataggcgggcacagtggctcacacttgtaatcccaacacttttgggaggccaaggtgggcggatcacctgaggtcaaaagttcaagaccagcctgaccaacatggtgaaaccccatctctactagaaatacaaaattagccgggcatggtagttcatgcctgtaatcccagccacttggaaggctgaggcaagagaatcccttgaacccaggaggcagaggttgcagtgagccgagatggcaccactgtactccagcctgggcgacagaccgagattctgtctcaaaaaaacattaacaaagaatactccagatcatccagaaagtcagtatctgatagtgtttatatggagaactcctgcactggaatgtaaactcctaaccctagatccatctcttctcaggtcttcctatcacctcagcctacagcagtcaatccttccctctaaccactccctcctcctaagatttcagcatttaatgcctgtaccatgtatctaatacttagtacacaatgcctaattcttgttttttaatttttatttaaaatactaaaacgaaacagagacggggtctcgctatgatgcctattctggtctagaactcccgggctcaagggatcctcccaaggaactcggcccacaatgtctaattctaatgcttcctcttttacttgaaagtggaggggaaggctgggagcagtggctcacacctgaaatcccagctactcaggaggctgaggcaggagaatcgcttgaaccagggaggtggaggttgcactgagctgagatcacaccactgtacgccagcctgggtgacagagtgagactctatctccaaaaaaaaaaaaaaaaatcagtcacataaattactcattgaagacaggaaccaagttttcaattcttcttaagtgttttcatcattcctgatctaaccaccagagaagtgtttccttgccctttggtggcaaggttaatcttggtgataaatgatcctgaaaggctagtctccaaataattagaaccttgaaaatgtttatatttttctctgctcggaaaattctggaaccccttttctaggactgccacaaggacacttctgactatcctcaatgatgacacattttagtttccattcagattaccaattatggtaactcccctgatcactgtttaagtactacttattaaaggaacaaacattaagctattgctcttggaaggccagcctgctaggaaacacccaagagcaattctgtaccttatccttccctaaattagtcagccaatcttaccattcaaggatgaaattaaaggcatttatctcatctagtaataccatcagtaaaccatggaagcttaaataatctaacattgctttggacattatggaaatgacaacctcagcacctaataaaatgtaaaaccaaatatatacatatcatgtcaatgtcttgaatgtacaattaccttgaaaatttcaaagtcacctcacatttctcaactcttggacctgagacctgcttactatcaagttatcattgagaacaaattaagaattctcaattgagaggtcacctgttgcactaagcaaaccgcctgcaaatactaaattagcttttctacttacactatcaagtcaaattacttctggtaatgcttgagtgtatttgcatgagatcaatttcatatacagttgggcagaagcaaaatgagtcttaagcaagcttcattctgttttcatcttacaaagaaaagactggcctgtcctcccagccttttgaataaggatcttgaaaaattcactacgcacagggtgtgcccaaagaatacttgctggaaaaatatgctgggagagtgccaatttaaaaagaaaaacattttcgcccagttggaaatctagagaaagaatagttgtagcaattcagctaaaaactctcaagacctgaagaaaattttagaaaaaccccagatctttttgttattggagtaaaattctatgaaaggcaactaaatgaatcaatgaagtattcaactatgctaattttatgcacctaaaaagcagtaactgaaattctgcctttgacatttgacggtgcaaaaagcactaagtaccttatttgttctacataaatgaactttataatctgcaatagtttttaaatcaactgtttctgggaaataatgaaagcattttattttcctttttaaaaaagcaagaataacaaaacttctttattgttttgctttttgggaggaggggttgggggaattgggataaatttttgttttccattagagacttttttttttttttttgagacagtctcgctcagtcgcccagctggagtgcggtggcacgatcgatctcggctcactgcaacatctgcctcccaggttcaagtgattcttgcacctcagccttccaagtagctgggattacgggcatgtgtcaccatgcccagccaatttttgtattttttgttttgtttgtttttgagactgagtctcgctctatcgcccaggctggagtgcagtggagcaatctcagctcactgtaacctccaccacctgggttcaagtgattctcctgcctcagcgtcccgagtagctgggattacaggtgcccgccaccacacccggttcatttttgtatttttagtagagacgaggtttcaccatgttggcaaggctggtctcaaactcctgacctcaagcgatctgcctgccttggcctcacaaagtgctgggattacaggcataagccaccacacccggccaagagacttatttctgaagcataacactccagcaatagcttgattaagctaaaaagatacccatctgttacaggcctttgtcttcagtctctcactacaacacccacccctttccaggtccactcagaaccttacgctcagatttttttttcactgcaataagtgaacacaacaaaaaattacagttactacagggacacactggtcccaggttgcctcatgagaaaagcaggtgagtaggcctgctggagctttgcactaactctatggaccctgtggaaactgcatgcaatgcaggctacatggagggtcaccgggctgctcactatacctcagcaaagcaaaaggcctgcctatgcctatgacaacagcctttcccatcacagcctggtcccaccacaaaacaacaagcaatattcttccaaaaagtacagtcctaattttaaaagtgaggaactcgagcctaggtagacaaaatgtaacaattcttaacagttgtccagaattctttctactctcttactccccttttagtactaataccacaaatgctaagaaaaataacctctagttcatccttcaagttttctggtacttgccaaatcaataaaaataacatgtgaaatgttaatcacaaaccacctactcagacactgaaatgacacaaatacagactaagtagatgaaaaccaatcaggatagtcctcaactattctttcaatatcctttcaagttctatggtaactagatttaccagcaagagttttcttgaggaaaatactaaacacaaagcacatgcttacaattcacctgtaagcacaagttaagaataatggagaaagaacataaaataccttcataactcaaaagagctccttttccagcaactggggaaatagttgtttggggcttttccacataagatataaatcatccctttcgaatgtcaaaaatgtttaatttagccatttgatggggaaaaacctttaatagttcacttctctagagtgtttattacagtaaaggaaaactatttaaacttcccaccatccctcctggtcaatgctggtgtccacccacgtactgtgtggtcagagagctgtctaaaggagttacagcaaacagcaaagctatgtgccttcaggttgctccatttctcaaaatagaatcttttttctgccctctctctatcagttccaggagttatcttctattcagaagatagaacatgtatgaccacaagcaaattatttaacatatctatagtcttgggtctcaactgtaaaacagggtatcatcatcatatggaagatttaaagacaacaaacctaaaccacctaacatacagaaaggtgtgatcaataaatactaattcctttcttttcttccttttttaaaaaaaataacttcaaccacttcctagatgttagtctgccctagcaaaatgtccctcctctacccatccaactttttttaagacaaggtctcactctgctgctcacgctggagtgcggtggtgcaatctcgactcactgcaacctctacctcccaggctcaaagcaatcctcctacctcagcctcccgtgtaagctgggactataggcgcatgccaccacgcctggctacttttttttgtagagaaggggtttcgccatgttacccaggctgctctagaactcctgggctcaagagatctgcccgccttggcctccccaagtgctggaattacaggagagaggcatcacgcccatataacccatccaacttctactccacaaaagaaaatgagtaattttcttttactcatattgtaggcttaaggatgtatctggttaagatacatatggccattatacctttcctcaaaaaatacgtattaccaaattaatgtataatagtcttctgaatataaacataaatgccattattttacatgatggttggtagacctcttttcatcaaccaaatctaatgaacaatttgattctgtttacactaaaaaagctagtgcttatgcccaggagataggtaaagagcctagattattatcttgatctcttattagctgtttgacattaagttacttaaactttccattctgcagtttgagtctgtaaaattaaaattatctatctcattgtactgttggaggattacataaattaatttgtaaaaagctctttataactaaagagctaaaaacaattcaacaaatgtgggctattatttctctaccagaatgtctcaactctgttgtctgcttaggcaaagttggttaaaaacgttgttcccagcagggcacagtggctcacacctgtaatcccagcactttgggaggccgaggtgggctgatcacgaggtcagcagatcgagaccatcctggctaacatgatgaaaccccacctctactaaaaaaaaaaaaaaaaaaaaaaaaaaatacaaaaaattagccgggtgtggtggcagacgcctgcagtcccagctacttgggaggctgaggcaggagaatggcgtgaacctggaagttggagcttgcagtgagcccaggtcatgccactgcactccagcctgggcgacagagcgagactctgtctcaaaaaaaaaaaaaccttgtttcctagctcacccaaatcagttcggtcaaaatcctcctgggttctcaggtttaagactaattcagtcccaaaggccctaaactctgccaccctgtttcttcccaggatacatctcttgtaagtacctgagaaacaaaccggaaatagcaattaaagggagagcaaggaaatggcactacatatacaagggtattcaattccctggcacatgccctctattcttttaggcctaagtaaaacaacttataagaacatgattttaaatgaactatgacacctctctctagttgccattccccaatctccccatttcccccgcccccaaaacaattttctctacaattcctcttacctgagttctgaatataatctacatgattactacaatgctactaaataggctgctagagcaaaccacaacattcacaatttaatagcaaattttcagtatattctgcttgcagagcagaccctacaactttcatcaggcttaaaataatttcaaagcaattttgtctaccatggtacaagaaacctttcttcacacttatagaaatataaaatcaaacaggacacagttgccacaaagccttaactaatgagaatcaaaactggtaagatttattcttatgtttactatatactaaacccccttggtttcaaatctatataaactcaatgttttctttacattggatatgtaagcataattttcccagatgcacaatagaaaattggagaaagataattcactggtaaacatgaaagggcatgaccttaggcatgaatttctacccagcttgcaaaataatctagtccactttggtccatgtttagggaggtggggaaatgaattaaagtaccatccatttataacagaatgtggacccatgctttcccttttctagttaaaactatttgttttatcacactgacagagcctaatcgggggctctacaaaggacactccaggtatacccaacaaaggaaaatatttaaataaaaattaatgaatgcctacctcatctgctccttctccatcttgacatatccatccaatgtagttacccctgccaaacaaaaatctgggaatcacccatggcacctcttcccttttgctcaccacatgcaatcagccacaagccctcatcacccctacttccaataaccaattctcttaaatctttcctgccaaaggctgagtccaccattcagctaactggttagcctaaattcacctctattccccttctccacacaagcggggtctgaaaaatacaaatcatgtaagccatgtcaatggcttcacaataaaaattttaactttatataatcaacaaggccatctgtatgatctggcaactagctacctctctggtctcatttctcactacttgtaaaatacactatactttgctctgttctttgagagtcaagcaccttccatttccaggaccttagcatgtcttgtttcctcaatgagcagcaaagccccttctcacccaccaattccttcttatccttcaggtctcagcttacatgtcacttccttcagaagactcaccatcacatccccatcacatgctgcctagatatatccaatatgcaccctcagatcactctgaactttgttcctgtagcacccacaacaatcataaatatatcatctatgtaattacccgcttaaatattaatctctctctaatctatattccccatgagggcaagacaaggattgtatctttcttaaccactggatccctagcatcccagcatgtagcaggcattcaatgtagagttaatgaatgaattaatcaaatccaaactcctccaatgaaggttttcaggtctctacagagcaactcctcccccatttatagaagattatttggaagcttatttcctcactgttttttattttttcagacacagggtctcactttgtcgcccatgctggagtttagtggcacaatcatagcttacccaagccttgaactcctaggctcaacccatcttcctgtctcaacttcctgagagctgggattacaggctcaagctactgcacccagccatttcctcatttttaacacttgctggaacttgtaaggaatacagaaaccttcatttttaagactctagtaaagaacctggactctcatgagctcttaagattattttgcaaactgagtactgaaatgcttctggtaaccatctattgctgtagtcagccaggcttaaaacttcaatcacctatgatgatccctcccgtcattgcccccacacatcacagttattaagtcccattcaatttacctctacatcatttctggaattatctctttttcttctcacattacatttaccatctgtacctataatactatgtcttcaacatatcccattcccatggtgccaccaaagccctatacctttcaacttgtcttctctgtgtgccctgtgctttctgcctatactgacctctcagtaggtcacaatcaaaagaaaactgtctatcaaaatctttgccaaccttcaaggttcatttctaacatcactaagtgccaggcactgttctaaacattcatctttgtcttactaagttcttcactcccttcactctttaaacttcttgaggatacaaacttagcttattcatctgttatctcttgtgtcttacacatttacttactccataagtacttattatatgactttaacactaccataaaagagtacgttcacttcagagaacaaaaacaacaatcacaaggtggcagaaaacactatagcaactatatctacggtaaatgggtaacacccaaattcctgatgcctaagttcctttcttcagaatcccacaacaagcactaagaatgattttcactacctacgtttcttctcaggaaaaaaatgagaagagaatagaagaaaaaaacacaagttcctacttctgccacttgacgtcatgtgcagattaggagaaaagccaaggggcattaaatcaaaggtgttcaacaaatgaaagtttactcagctctgaagtaaattctgtaagaatacaatgaaattattcccacatttctatcccatacatcaagaaataagataatcactttaatggactatgaaaagtaaatcaaccaaagaaatgaatgaaggcattagaagaaccaaagctttaagtcacaagtcaagaaacctgttttgtttcaacttataccagtgctttgctgggttctttgcctcagcttcccccaatgcaaaaaaatggtgatgagaatagtttcattcatgttatttaaagataaacagtcacatttcaaagtagtttgagacctaaaggtcacgtagggtcagctccctcactttaattagaaaaatggttacattagtcctatagctagtttttagcagaagaagggtttagctgagaagacttgggtatcctggctgatgttcctcccaacccaccactttatgaaatgataaagagtagaaaaatgatagccgggtgtttggtgcatgcctgtagtcccagttactcctgaggctgaggcaggaagatcacttgaacctgggaagcagagactgcaatgagctgacatcacgccactgcactccagcctgagtgacagaacaagactctctctcaaatatatacatacatacaaacatacataaaaagtaaaaaatgacaaagcaatttgattgccactttggcaacatcatctgtgtattcttaataaattcaagtaagagttacttttttttatttttatttttacttatttatttgaaatggagtctcgctctgtcgcccaggctggagtgcagtggtgcgatctcggctcactgcaagctccacctcctgggttctggccattctcctgcctcagcctcccgagtagctgggactacaggggaccgccaccacgcccggctaattttttgaatttttagtagagacggcgtttcaccgtgttagccaggatggtctcaatctcctgaactcgtgatccacccacctcagcctcccaaagtgctgggattacaggtatttttattttttttttgagacacagtttcactctgccacccaggatggagtgcagagctgagatttcagctcactgcaactcctgcctcctgggttcaagtgattctcgtgcttcaacctcccaagtagctgggattaaaggcgtgcaccaccacgcctggctaatttttgaatttttggtagagacggggtttcaccatgttggccaggctggtctccaactcctgacctcaagtgatccacccaccttggcctcccaaagtgctgggattacagacatgagccaccaagccagaccaaaagcaacaatatagaacattccaaagtatctaaaaagcaaaacctataaacacactagtaattcattttaccatgaggtcttcataaactccaagaggataaaattccccaggaggggctaggcacagtggctctcgcctgtaatcccagcacttcggtaggccaaggtgggtggattacctgaggtcgggagttctgagaccagcctgggccacatggtgaaaccccgtctctactaaaaatacaaaaattagccaggcatggtggtgggcgcctgtaatcccagcttactcaggaggctgaggcagaagaattgcttgagcctgggaggtggagattgcagtgagccgagatcatgccactgtaactctagcctgggcgacagagtgagactctgtctcaaaaaaaaaaaaaaagggctgggcacagtgacttacacctgtaatcccagcactgtgggaggccaaggcgggtagatcacctgaggtcaggagttcgagaccagcctgagcaacatggcaaaaccctgcctctactaaaagtacaaaaattagccgggcgtggtgacaggcacctgtaattccagctactcagaaggctgaggcagcagaatcacttgaacccgggagccagaggttgcagtgagccaagatcgcgccactgcactccagcctgggcaacaagagcaacattcggtctccaaaaaaaaaaaaaattcctgagggtgagaaaactcactgcaatcaagaccatccaaaattcaaataagcgctttagtgtcactgaactgcatccatagtctatttttacccaaccctgatctgaaacagacttcaggagactattagacaaaacacaggttagcataaattcaaccagaaataaaaacatgaaaatagggaaacaaaatgaagctattaaaaaggtacaagcttagctctaaatttccagatgtcaataggaaaaaagaaacctagtgaacaattacagcacccaggtaataaaaacagactaaaagcttagacaaacatacaattattcttggctgcacatctttctccctgaggtctttataaagaaggcattgcagaatacagagaatatcctcaacaatatttcagtaatcacaatgaaatgttttatgaggttatttttatactgaacttcaagataagcctagagtaacggttgggagaaaaaaaagaaaaaaaaaatttcggggacagagagaaaaaaagaaaggaaaaaaaaaaaaacttaggagagagagacctacataatgtggtccaggtacccagaacactgctgatttaagagcacaattaagagaatttctggaaaaaaaatattattttaacaagtagttactatatagaagtttataagcacaggacccagaaaatgaaaagcaaatttagcaaaatgtggaatgggtccaggaattaaacaaaattgcagggaaaaaaaaacaactctaagagggaaaaacaaagaatataaaagaaagaagagcaagcacaactcagcaagtacattacatacatatgataattaaatgcttttatttctacatctacaattaagaattaaacattaagatatttacggaagcatgcagcttccttcttaatcccataatcaaggagataaaatttaaattcctgtaccttccacagtgatgaaatatcattgtttagtgacatcatatcaaacacaacgtactgcagaattttcaaagcagttatatttccactgtaccaagaaaggaagatatgtgaaatatttcatgaaaattttccaagaagagtttaaaacaaaaagggtaagagtttttaaaccagacataaaatcagtcaaccataaaaattaatttaaaaaactctctctaaagtctcatttagcaatatagtttactgtcaagcataatacaatgataaacatacaatttgctaaacattcaacaacatagaaaaattaatcattctatagctagcatgtaccaacgacacagaatggatcactgtttctcctctgggaggtgggaaagaaaaaaacaattgaattcttagtgaagaaagggattataatttccacagaactatccacttgtaatttaagcaacatcatttaaaaacagctcattccaacagtctcctctactaaatattttcatcagggctgcctagacgaaacctagcccaccactctatcttgggcaaaagagtaaaatacagaccagctactggaagggtggggggagccaaaattcaccagctgggtcaagttcctgaagaattaactaactacattctaggattcatttctcagcatcaaagaacaactttttcttcttctttttaaattaaagcaatgcctccattctcattgtctggtcaactgctgaaaacctttaaaacactcagaagatcaacaaacacttggctaaataaataccagccttaagagtcaacccggtgatcttgctcaacaagaactttaaagtatttatgctttactggtggttttagtttaaatacaatttttttttttttttgagacggagtttcgctcgttgcctaggctggagggcaatggtgcgatctcagctcaccgcaacctccgcctctcacgttcaagcgattctcctgcctcagcctccagagcagctggatgtagaggcgtgtgccaccacgcccaactaattttgtatttttagtagagacggggtttctccatgttggtcaaactggtctcgaactctcaacctcaagtgatccgcccgcctcagcctcccaaagtgctgggtgggattacaggagtgagccaccgtgcccggccctaaatacaattacaatgtgcaaaaagagcatgtacttcagagtactttcagtacccaaatatgatctaacgcatgaaaattcaactttttaaagtatcagttgatttaattgcaagaggattcaactgatcccaaaatgtttcctaaaagccatcctttggctgttcttatacacttcacacccttccaaaccataaaccattatgtgagaagaatgctcagaactaagtagtgaatgaatggccttaaggtttttccaagtcattaaactatcctacagaataagaaaaattctcaggtacttttatttcattggtttgtaacgcttacctacaacagtaccaaaactcagaaatgttttcaatgcaacgtatcctgaaaacaatacgcttatagtgtctaggtgcttttctgttactcaaaataagtgcatgcaatttaaaatcctttaactacagtgtttattatacctctaagcacaaaatatttaacgttaaccaagatatttttaaagcggtgatttaaacagcaaagttagtggggataatgccatgaatattagcaagctgaattaagctactaatccatttaaagaaagatgggttacggaagaagcaagcctctgaagcatttgctttaaatctaaatacagaagtggacttgagcacagtgaactaacaaatgataatagaactaggtctacaaggaagaaattcagcaaaaattatccatttcttccttcaaaatagaaaaaaaaagtttcatttcagatacaatatccatgcagataatataaacaaaattgggaaaccagaaaatttacttttaaaaatcatagctgtctcaacaaccaaacactccagtgaaaatcttcatcaccttttaatacagtcaaggaaacaccaattcttcccacatattcatctttttcagccttctctagtaagccagcctctagcaaagagaaaatgaaagatctgctagtcaattatcctgcccctcttttccaactcctcatgctctctctcaaatctgatattcctaaggagataaatgcacttatttaacatgtatctttaagtatgttataatatagtactgctttatttaattaagtacatagatgctgaattgggagtgacaggaatgaaacgtctctgtctccaccatgccaatttggagtgccacccataaaaagcttatgtaaaattttctcaaaccaacagatttagaaaaaccagtaagatgaggtgggcggatcacgaggtcaggagtttgaggccagcctggtcgacacggtgaaactcagtctctacttaagaaaagaaaaaagaaaaaaattagcctgacttggtggcgggtacctgtaatcccagctacttagggaggctgaggcccgagaatcacctgaacccaggagccagaggcttcagtgagctgagatcgcactactgcactcctgcactccagcctgggcgacagagcggaactgtctcaaaacaaaacaaaacaaaaaacaacaaaaaaaacaacccagtaagaatttattccaaatacatcaatacatttaactcagcttaacaaatctgcttaaaatgggcttttttttttttttaataggaagagagtcaggttgtgaaactagactgtgcttggaggcgatgtattaaatattctgaagcattttctaattgtcagtccttaaaatgtaagaaaatctcaagtgttaaaattgaagactgggtgtgctctctgctgaaagttcaatcaaaagcaactgtaatttcctacaaaggtaactaggtcaactcagcatttgtccctgcttactggaaacaacaaaatctcaacaatcaggccattaacttatcatgtcctatatatagtttcaaaagaaatctaaattcactcttaaagaggtactagtacaattttacacataagatgtctcctagttatttttcttagacttcaaaaggaaattaccaccatttagactacaacaatacaaccctacagcaaaagtatcttccccttcttcactagcatgtatatgcactcatctacccaacatcagggaaaaaacaaacagaacctagacacctatgtacaaagaatcacattctctccataatggcgattcattcattcttccttgtgccaacatttctcaagaatgctatcatgcatgaggtctactcacaggggtacatgacgctgctcgggatcagctctggtcagttcttcctcttcaatatcagactcccctcctgaactactgtcagtgacatctgaatcaaatgcctgttcactgcacctcaagttggctatgccactagctgtaaatctctccaattcttctgaaattgaattgcttttcagaaagttgctaagtccctctgaagtggtggtctcactggcagcttttctcaaggcagcttcagcctttcgagtcagcatcaactggctccgtggtctcaaggattccaagtttggcagtttgctcaaagtcttctccaaaaatccacccagctgatgttgtatatgcctctcaacctgcttggcttgcacaacctgtaagcgcttttgtaatctgcgggcacggctctcaatgtcagcctgtcgccgcagtaaagctgttatccttgtgtcagaatctaaagcactgaaaagaatggaagacaggggagactttttaccctccaatttgacaccccccaagttagagctggagtctgtaccaggtgataatctactgcttccttgaagtgccggctgttccatggaattgacagaggatttgtttgcagtgctattattgctatacaaagttgtgtgttctacatcaaggcttctatgtggaagagtgcaattggtcataccccccttcaagtccccagattcagatcctcccatttcacccccatgaagagcagatgaagtgagagcccgttttcccccattgagggaagtggaattgtcatgatcagaatgtgttgaacttttagtcaatttcttagccaacccatttacaggtgcttgtggcagagctgtctgaccactcgtattcatggttctaagattttctaaggaaaactccaaaactggctgtctccccaacagctcagctcggagttcataggactgagataagagaggatgagatttaaggactgtctgcttgctgaagaccccttgcaacttcaaagactcctttgagggaacagatgttacatcagagcagagataagatgccaccagtggttgcagctttcccaagtcttccttggtaggattatttcggaaatctaggctgggatcctctgcagcaatggcttttcttttggttccgttggcagcaataaggatgttggcgttgccgttattttcggcactgccaggggacaaggtagaggatgggggagccagtttgaaccggatatggtgtgcttcagctgctgcgtcagtgagagcgggcgccatcgcagccattcagcacagagagacaggaagtccagcctctcccgatgccgaggccgaggccagctccacggccccttactgcctccccagagaacagactagaagagaaaggagaaaagaatattagaaatacaagcacttttaaaaacatgtatatttttaacaaaagcactacttgaggctgttgtctaaactgcctccagaaagaaaacactctggagctaactgtaccacagttattctagagacccaaatatctttcatctgggagaaagggggaggcaaaatccctgcacaagggaaggaagaattgcacccttcttgtcatttgttaccacagattgaaaggtgccaaaacacaagttcgattcagagaaaatcacagattgttaaaattaaatcatctccattaaaaaaaaatctctttaagcttgttgaaataaatggatttaaagcaagacacatcaaactaagcaataattaaacagaaaaaaattagtaaggaattcccgtgttcactaaaaaaagtatgccaaatatcacaggtctgtgcatttttctggccagggaatccagttttcatcagcttctcacttctctagaagtatagattatactacaaagctaactgtaccacatctgtaataccaacttgtttcatcagttttcttttctttcagatcaaagtggtcatcaatatcttctctactggcttcttcctctcagcctaggaatttactcaagtatcttctgccctcagtacagcctctctctcatacttaattgcccaaatatctctctttccctttaccccaaaacttctctaagaatagtataaataactgtctctgcactcttcactcttccataatctggatttcaccccctactgctctggcaaaggtgaccagtaatcttattatcaaatccaatggtcaaacctcagtccccattctatctgacttctctgaagcactggacaataccgaccttcttctaattctttcctgatgtccttgtactatcatcctcttctcttcctcctggacccttaaatgctggtgctgcacaaggtcccttctgccctcttctctctcaacaaccactagtatggtgaggtttcttaaccataagaaaaacttctgagctgcactaatcaagattcctataacctctatgttcctcaagccccctgaagctcagaattcactttctccttccagcacactattccgcatcctgtttcattaccttaagtaatgacactgcttttatttagtaaccaagctaaaaatctcagtcatttgcctctgtttgatcccccttgatctatgtggtctgggagccaaaggaaacatacgtaaagaactaagccagttgttctttaaagtgtggtctctggacttctggggatctcacaggctattttggaggttcgtgaaatcaaaggtattttcatagcaatactagaatattatctgccttttacactgtgttgacatttgcaatcagagtacaaaaacaaaggtgaacaaaactgctggtacattattagcacaaatcaaggaagaggcaccaaactatactaatagtcattatactctccactcagtttttctttttttaagggagttccacttaagatgtccttgatgaacagcaaaaattatgaattatcttgagcctttagtgcattttttaaaaatattctttgtgatgaaagggaaagtatgcataaagcactctgctgctttatgaattctcaggaaaaagcacagtacaactgagttgcaaaatgaactagagctttgttcatggaacacgatttttacttggcagaactactgacaaacattatttgaaacctgcttcactagcagacatttccttgcaaatgaacaaagtgaacctgtcacttcaaggaagaccactgacgatatttgctgccaataataaaatctgaattttttaggcaaagattagtgtttttgaaaacttgtatcaacaatcatgaacttaaacattttcccaatattttatttggtgggtgtggatgtgtgtgtgtgtgtttaacagagtcttgctctgtcgccacgctggagtgcagtggtatgatctcagctcactgtaacctctgcctcctgggttcaagtgattctcctgcctcagcctcccgtgtagctgggactacaggcacgtgccaccacgcctggctaatttttgtatttttagtagagacagggtttcaccatgttggccaggatggtcacaatctcctgacctcatgatccgcccacctcggccttccaaagtgctgggattacaggcctaagctgccacattcggactttctgaatattttaaaagccatttctgatttaacagacttgtgacgatattaatgaacgtgaatttttgattgcatataatgtaatgtgtaacatttggaagatctgcataacccagtgaacgataaaatgtccagtgaatgtcaggaaatcatgcatgggtaaaaagtttaagtgcaagacaaatcatttatttgttgctgttattttgaaacagggtctagctctgtcacccaagctagagtgcagcggcacaatcatggctcactgaagcctcaacctcctgggctcaagtgatcctcctgcatcagcctcctagtagctgggactataggtgtgtgccaccatgcccggctaattttttgaatttttgtagagatggaatttcattttgttgcccaggctgctatcaaactcccagcttcagccttccaaactcctgggattataggcataagccgccatgcccagcctgaattacttattaaatattttttaaatttctcaaagtttataagaaaaacaatttatttgctgttctcaacaaattttaagagttaaaaaagggtcctgagaccaaaatgcttgtgaaatcactggactaagcacccccctccctgccccaaatgagggcaatctccaatttaatcaaaaatgcttatctttggagcaataccaacacaggatggtaggccctacaggaccacagtaagcttctttatagtatgacaatttgaatcattaacataaaaatactcaaataaatgactgagaaaacattattcataaaagcaccaatatacatatgggtcgaatctgtcttattgctgtgtgtgtgtgtgtgtgtgtgtgtgtgtgtgtgtgtgtgtgtgtgtgtgtgtttctgagatgtagtctcgctctgtcgcccaggctggagtgcagtggcgtgatctcggctcactgcaacctccgcctcctgtgttggagtgattctcctgcttcagcctcccgagtagctgggacttcaggcatgtgtcaccatgcccagataatttttgtatttttaatggagatggagtttcaccacgttggccaagctggtctcaaactcctgacctcaggtgatccgcttgcctcagcatcccaaagtgctaggattacaggtgtgatccactgtgcctggcctcatataattattaacaccaaaagtttcttgttccagggttgtattttaaccaacactctttatgaactagattttcagggcttatgtagttttctcctgtgggctttctggcatatggcattctgtgtggcacaaattattctatgttgtcttttcccatttctaactttaaatataatactaattactaatatattattaaacattgtgttacagaccagttgacagtactaattcctgttattaaacattgtgttatagaccagttgacagctggaccaatatagttgttaaaaatattttgagtcacttttataatatgcaaagggtttttcccatggacaaacgaaaatcactaccagataattcccatcaattcaatctcctccccttttgaatgtcaatatgtagttgatatgagcaatgcaaggaggcatattatcagtgccagatgattaatacaacatgtgaagagtaattgtaccctactgcctgacagcactacagtaagacttagcaagggcaggaaacagcttccctctgaggacccaagcaagggcacaaatatgctttatgacttacataaaacttaggaaaacccaggctcactccagcacaaatgaaaaagagggtcataattaacatcacatcacagaaggtgcttaagtagtaaacttctcaaagttattctgagattattcaattctttaaagcttacaactttaagaaaaaatgccggcttaaatcccatctactccagctgggcacagtggctcacgcctgtaatcccagcattttgggaggccgaggcaggcgtatcacctgaggtcaggagttcaagaccagcctggtcaacatggtgaaaccctgtctctactaaaaatacaaaaatcagctgagtgtggcggcgagcgcctgtaatcccagctacctgggaggctgagacatgagaatcacctgaacccaggcagcagaggttgcaattagccaagattgcaccactgcactccagccggggcaacaagagcaagactccatcttaaaaaaaaaaaaaaaaatcccatctactccaagacttctctgaaatgatgtctatgaacttgacattaacatatacacttcaaagacaatagtttatttgatttgcactttatccttggtctcaatatccccataggatacacagcatagtgtagttactaaaacaatcatctaagtaagggggtgggggaggagagagagtgcagagaacaggaaaaagtgaccactttttccgaaaaaattcccattcctaattcctaaatcttgagatttctataccaaagaaataccatttattgacttgacatacctttattgactcgaaatactatgctaagattcaacattactcccaaagatattcataagtaagaggagcactgactcaagtgagcaaatctcagttcccatcctggctccacctcctgtaggttacttaactattctgttctttaagtctcctcatctacaagtaacagagccttcccgacaaggatgctatgatgatgaaataagatactttcaattacttggccacgtacctggagcaaccacccagtattatttgcacttttattacactggaaacaaaaaggaaacatagaaggaatgaatttccatggctttttaatgcacctagtttgcaattagctacaattgccataaaccaccacctaagtttagtactttaatcttttccctgttatgtctagacttacttttaatatttcatgatgttgtttataataaaaagaaaactgaatgccaaaaactcggttaaattattaaatatccatacaatggaatactgtgcaaccctaagtgtggcagagctatatttactaacatagaaaagtgcttgcttcattattaaatgaaaaaaagttacaaaacaaaacacagtatcatctcaattttgctttaaaaagtcattggttaagattcttttgtcttttgtttcttggcttatgtaaagtctccaccataaacatgtattacttctataataaaatggagagaaacaaaaagaaaacaatggaaattcttaaagagccaataactaagtaaaacaaaatcacagtaacattctttttttttttttaagagatggagtctcgctctgtcacccaggctggagagcagtggcgtgatctaagctcactgcaagctccacctcccgggttcacgccattctcctgcctcagcctccccagtagctggaactacaggcgtccgccaccacgcccagctagttttttgtatttttagtagagacagggtttcaccatgttagccaggatggtctccatctcctgacctcgtgatctgcccaccttggcctcccaaagtgctgggattacaggcatgagccaccacgcccggcccatagtaacattcttaaatttaatatacagagcaaaacaatgattcctatcccacttgacccctacaaaattcaaaaagcttcaatctttgacaatgtaaagcagggaaagactgtcaaatttaagcagttcttagagaagctcagggctaaaggaaaaaaaaacgaaaaacaaaaaaaggaagcagttctacacaaacagcacaacagcctatctgataaatcatctttctccaaagaatacaaagccttaaaagctataattaactgattaatcctcataacaacctgggcagtagaattagggctgagattataatttctaatttaccggtggggataaagtcagactgtacattcagaataaaaattcaagccccaaatatcccaatttttagttcattcagttagtaaactataatctgacaaatacagatggagctgctacacctgctgtcactcacacaaattgagattctgcagtaagcttgtacagataaaagaaaaggctacctattcaaggtcatttagctataaaaggttgggctagataatcaatagtttctctctcagtttcaaagaagtattttagggtctggaagatgttaaatgcactcagcaagcaaatacatttcggaaaaacttcccagatggagactcacaacgtattgcatcatactgaatatgcaaatgtttacctttaccaaacttttttaacaagcacctttttccattacatctattaatatcaagcagaaacatcattgtgagaaatacaagttgggataaagttcaaatatgtgacctctagggtcccttcctatgttaattctattattctaaattgcaccatcggtccaaggacaaacttctacctaacacaagtggcacttgggaagcaaaaatatacttctaggatagagtttctcaacctaaccactaactgacatctcacgatgagtaatctatcacagggggctatcctggcagtagcatgtttagcaacatctctgttttccacccactagatgctagtagtgcccttctgaaaattatgacaatcaaaaatgtctccagacatgtcaaatatgggagctggggggttcaacatcacacctcccaacagagaaccatatcctaaagattatacacacacatatatatactctttcaaaagcaaaacgtatccagctgcttcaaatactgtaagtcagaactaactccacacccacaaatgaaaacctcatttattcccagtcaatttccaagacaagactccagatacacaagaataacctggaagcatccaccttgcaaaaatatttagctgcagagaacaaaggggaaggaataggtcatccaggtggccaacaagtattacaaccacacttgcactgaaagcaaaagcaaaaatcagatggggaagaaaagtttgcccataatgtggcttctactaacctcttccttcaccattacctcatttctctacacaaaggacggaaagaaacagcaggaaggatgattagggaagtgtccatgaagttgccgcaattttagctgagacttgaaaattagctaaaatgtcattatgcaaaaggctaggacaagagaatggtaatgtggcattctagtgagaggaaatggcataagaaaaggcaacgctgtgtgggaaaaggcgacattctgaaggttaaaagaaatgaacaatttgggccgggcgcagtgactcatgcctataatcccaggactttgggaggctgaggcgggtagatcacctgagatcaggagaccagcctggccaacatggcgaaaccccatctctactaaaattaccaaaaattagccgggtgtggaggcgcgcacctgtactcccagctacttggaagactgagacaggataattgcttgaacccaggaggcagaggttgcagtgagctgagatcgggccactgcactccagcttgggtaacaagagcgagactccatcttaaaaaaaaaaaaaaattaacaatttgcttaaaacacaaagcatattttaatagaggaaatagtagaatgaaggtggaaaggcagtttgaagccagatccttaacggacagcctttaatagccttaattcagacttaaagacagtagaggggccaggcacagtggctcacgcctgcaatccccgcactttgggaggctgaggcgggtggatcacctgaggtcaggagtttgaaaccagcctggccaacgtggtgaaaacccgcctctaataaaaatacaaaaaaatcagctgggtgtggtggcgggcacctgtaatcccagctgctcgggaagctgtggtaggagaatcgctgaaacctgagcggcagaggttgcagtgagccgagatcgcaccattgcactccagcctgggtgacaaaagtgagactccatctcaaaaaaagaaataaataataaaaataaaaataaaaaatttagccgggcatgatggcaggtgcctgtagtcccagctactagggaggctgaggcatgagaatcacttgaacccaggaggcagaggctgcaatgagctaagattgagccactgcatttcagccagggcgacaaagagaggctctgtctcaaaaacaaaaacaaacaaacaaagacagcagaggccaggtgcagcggctcagacatgtaatcccagcactctgggaggccaaggcaaaaggattgcttgaggccaggagtttgagaccagcctggtcaacatagcgagatcgagtctctgaaaaataaaaagtatatacatatatatatacacacacatatatatgtatatgtatatataaaataatgacagcagagtatcattaaacactttttaaatgggagtgaaacatcagactgtgctttagagagatcagttgggtaggatggattgaaagtaagtaaaaaggcatctatagatggcaaagaccaataaaaaagctaccacaataatccagataggatgcaatgagaacttcaaccagaaaataatagtcaaagtctctaccaaagcttaaatccagaaatgtgaaggggccagtctaacaaaaaggccaaatatatgacaaacaaaaacatgatggcttataaagaatggaaagaaagctctcttttccttcataatttcatctcctttgtgacgaaatccttcttttctcacgaagcttttcaggtttggtatgtcctctctatacttctaacactatcagtctagcccaggtcctcatcagctcctgtctagattatcacaacagcttcctgactagtgcctcagtgccccaaactatcctttacctttttatcatctcactttcctactctgaacaagttcctcacactttttttttttttgagacaaagtctcgctcttgtcccccaggctggagtgcgatggcgcgatctccgctcactgcaacctccgcctcccaggttcaaacgattctcctaccacaacctcccgagcagctgggattaccggtgcctgccaccacagccagctaatttttttgtaattttagtagagatggggtttcaccacgttggccaggctggtttcgaactcctgacctcaggtgatcgacccgcctcggcctcccaaagtgctggaattacaggcatgagccaccacacccagcccctcacacctttttaatgagttcaaattcttcaagatgaaacttaacgtcagggcaagcacatcaattgatacggacccagaactccccacagattcccaactccgtatctttgcctatgttgctacctctacctggaaggtccttcttctactttttttttttgtccccaaacttactaatttttcaatacatagcatctccacaaaaacttcttagactcttccaattcatatcactttcttcctgcttgaattgtataatgcacttaaagtcactgtcattcagttcaaattatctgaattttccctaattgttaactaattctatttccaagacaagcaaaattccttaacagcacccttctttagcgtgctaactttatcgagagcttggtacatagtaagtgctgtaagccctaaatgactggactagagaagtcaaaaaggcctcgtgggggttgccctcaagtgtaagattttactaagaagagaaaaaggaggaaacacgaatcaaaaaattgacacaatcaaaataatgggaaagacgtggggcatgatccacaaaacaacttgcatgaatcaggtggtatatgtacagcttctcaagagaaagagaggaaaagaacagtgatttgtgatgaagtactgcaagctacattatggaatgcactgcaaagtatttattttacatatgaacaaaagtagatttgttgtggaatacaatggggaaggagagacaaaatttttactataaaacaaagagataatgtgtgtcacccacaagaccattatcaatttccttggccaacagggcttcttaactgaaaaagctttatattactaaaggaatcattcctgagtgcaggataggttattacaaatgttgttcactaacattaattagcgttttactatgtcaatcactatgctaagtatcttacatatattctcttaatcttcacaataacaatgtaaggtaagtactactgtcctcattttatagatgctcaaagaagttaagtaatttgcccatgatcacacaactatgaagttgcaggggcaggatccataatgctaaagccgatgcttttaactactacactagatagtttaaggcttaaactgaaacggtcttaactgcctgacagtaaattctgaattttagtctttagaggaaagtcagtcaaagaacaccaactacctactgagtatctccaataaatattaaaatgcctagagtattcaaagcaccacagtaagtacatacaaggatgacaagcagcagtaaagagagacactactgtgtgatttgggggatggaggcaatcctcatacaggctgagaagtaggcggagtcagaaaatgcttttcagaaaaaagaacatccaggctgaaacctaaagaatgagtaggagctgggtgcagtggcaggcgcctgtatttccagttactcaggaggcaggaggatggcttcaggcaaggagttcaaggccagcctaggcaacatagcccccatctaaaaaagccacccaaacaaaaacactaattttttttttttaaatgatggcctaccatggtagctcacacttataagcccagcaccttgggaggccaaggcaggaggatcgcctgagcccaggaggagtttgagactagcctagacaacacactgagacccagtctctaaaaaaataataattagctgggcatagtgggagggtcacttgagcctggcgggtggaggtcgcagtgagctgttatcacgccactgcactccagcctgggttacagagcaagattctgtctcaaaagaaggaaaagaggagaggggaggagagaggagagaggagagaggagacaggggagaggggagaggaggtgagagaagaaaaggagggaaagaaggaaggagggagggaaggaagggaaggagtagggccgggagaggtggctcacgcctgtaattccagcactttgggaggccaaggcaggaagatcacttgaggtcaggagtttgagaccagcctggccaacacagcgaaaccccgtctttgcctgtaatcccagctattcagaaggctgaggtacaagaatcacctgaatctgggaggcagcggctgcagtgagctgagatggcaccactgcactccagcgtaggcgacagaatgagactgtctccaaaaaaacaaaaagaaagaaatgagtagaattcagcattgcctatacaactacttcaagcatcccatattcaaaacccattccctgccccaacaccaaatccaaaacttcctcctgctcctcaacattgtctatttgagttaatcatgacctcaaatcaccaacttactttttaccataaatatttaatttaaacatctactaaatgccagatacaagatagtaaaatataaattaggtgtgaaggtagcctagcttgataaagtactgtatttcacctgaaggggtcaaggaaggcttctagaaaagatgacatactgactgaattttgaaaggtgaggtggtgcacagagggtgagggttggcaacacacagaatgacaggcacattcattccatccttggtgccaatgccctagtgcagaacctcattatgtactatagtaattcaggcagtaataatctcccaactattcttccttcttcctgtctcagcaagcctctaatctagcgtccactaccaaaatgattattagaaagggaagaaaaaaggaaaggagggggtaaacctaaatctaaccatttaaaatctttcactgactctagagtaaggatgagtccaaattccccacacaccattatctgtcccctttttacattagacctcatctccagcctgtcctcactgcagccacctgaaacatatgtttcctggctcttctatgcccctgcacctttactcatgctactctttcacggttcagctcaaggttacatgctctttcaagtattccccattactcccaggttgaggtggggtccctccctctaggctcttacctgcacccccatgacaccctggctattgctcatggtacaatataaactcacaattttgtcttgtctctttcttccccagagtatgtacttttttttttttttttttttgaaacagagcctctcattgtcacccgggctggagtgcagcggcacaatattggctcactgcaacctccacctcctgagttcaagcgtttctcctgcctcagcctcctgagtagctgggattacaggcacccgccaccacatctagctaattttttgtcttttttagtagagacagggttccaccatgttggcctggcctgacctcgtgattcgccagcctcggcctcccaaagtgctgagattacaggcatgagccgccacgcctggccaactatgtacttcttaaaaaaggagggttatagcttgttttatctctgtcccctacaagcagcacaatgcctggcagacagcagaccaacacacgttaagcaacctgagcattctatgctaaacccatcagatgaagatccattaggacgttaatggggatgtctgaagtgatcaaccacctaacaagaagaggcatcaactgaacctaggataggcttcacccactacaagttccagttatttacttgaccaagcacctgtacccagactaggaaactttttaactacactttttaagctattattaaatgtggttacacagcattataaaggtaatagccatcaaaatcacaaatgtaattgctcaaacttttacccagcaactgcacttctagaaatctattcaacagaaatattctcataggtactcaaagatgtatacacaatgctttcactgaagaactggaatacaaaaaaaaaaccctaattaaaaagatcaagccatataacaagtatgatcccattaaacatatatatatacacatatatatacacacacatatatacacacacacacacacacacacacacacacacacacacacacggataggctaggccccatggctcatgcctgtaataccagctactctagaagtcaaggtgggaggactgcttgagcccaggaattcaagaccagcctagacaacatagcaagataccatctcaagaaaacttttttttctgaaggatgtctatatatcaaactattaatggtgttaatcctacttctatgctagcactgaattcaaatttcctaccactctttagctgacaaaagacagaggaaaaaaaaatcatactttttatcatatctctttccaacaagccctaatggttggtgtaagtgctcctgaacaatcctaaaatcagcgacttctggaagattttaagaattctaaaggaggccgggcgcggtggctcatgcctgtaataccagcactttgggaggccgagacgggtggatcacaaggtcaggagatcgagaccatcctggctaacacagtgaaaccccgtctctactaaaatgcaaaaaaaaaaaaaaattagctgagcatgatggcgggcacctgtagttccagctactcgggaggctgaggcaggagaatggcatgaacccaggaggcagagcttgcagtgagctgagatcccgccactgcacctccagcctggggcacagagcgagactgtgtctcaaaaaaaaaaaaaaagaattctaaaggaaacaggttattctgggagggtccatggccaaattcctgagttcccactgaaacctaccttatacctttagagaaaagtcaattaatgacttttaaaagtacatttttccaatgccaataaaatgttaagtcaatactaatatccatttttcattctcttgggaggcaaggggtaaggagtaaatcactaagtgcaaaaaaatacagtccaattttttggagacatgcttaaggtcttcaaagagcttcagttctccatggtaacatatggagagtttaatgaaactttcctgacagttcaacttatcagactggtatttcttttttcttttttttgagacgaagtctctctctgtcgcccaggctggagtgcagtggtgcgatctcggctcactacaacctccgcctccaggttcaagcaattctcctgcctcagcctcttgagtagctgggactacaggcatgcgccaccatgtccagctaatttttgctgtttttttttttagtagagacagggtttcaccatgttaagccaggctggtctcaaactcctgacctcaggtgatccgcctcggcctcccaaggtgctgggattacaggcatgagccaccacacccagcccaggctggtatttctatgaagtgtctctcctatactagaaaccagaaactagctacagtacttagctttgagcctctttcccttcacaccctctggtggaggtgctaacaaacagtcacaaaggccaaataacaagcagcaagaggaaagtctagatatgagttcttagcaatttttggtttaacatcctaacaacaaaattgttattcctcttttttattccctaatacttaccttccaactgaatttaaccaagtctaaccttaagctctcccctttttaaaaaggaattaaaaggtgagggactccattaagtttgatgtcactcaagcaactttttccaaataagagcagaatctgctgtaattaaaattcagagtaagatctcattttggattcctggttcaggttacaagaaccagagtttttaaaataacatttagataaaactgcactcaatctacctccactttgcatttcctgaccctcaaaatcttggaaagaaactttaattctaaaaaaattacagccaggaaaaaaaagggtaagttcacagtcagcaacaataaaatacacagctaaataatttcctggtagagggctttcaaatgttaacactgtggaagcagcttaaaatcttggaaaagcaaggcttgcagaaagtaacatttattaaacaactattttgccgcattgtgctactaaatggggaaggtctactctatttaaaaggtctcttccaccttaaagggactctttgcataaaggtttaaaatcttcatataaaatgtttgatttttttctttcagactgcccaaactcatttgtttttgattcataaacatgagctgtgttttctactttggtcaagtcagtttccgcactctattttagctttacctttattctaccaaagacaagaaaatgcttaataaaaaaaaatatatattgcagctctttttggagtccaagtattttggtaaatcacaccttttggcttattttctcctatgtattttgttctacatcctaaaaggcacatggcttaaaaaagaaacaaataataatagttaccccctgccatactagtcatctcctatgacccacaatcctcccctcaatctgcaagtgacacccaaggatatcacttacctcctatatcttctgatagccttcaaacgctggtgaactctagtacagtggatatttgtcttttctaattcatactgtcttctacagccatagtgtggttcaactgagttttgatctcacatttcagggaatgggaagtactgatgagggaaacttatcttgtcatataaactattgttctgcacaacttttagtatgcccagaggtatatacgcaacttatcagcatagaaactgtaatttaaacatacatcttcagaagcaacatgagaactaaaaaagtcttaaaacagacttccaagaaacagttatgaagtccaattttaggaaaaagacatgatccaagtgttctttgcactgacacagtaggcaagccaggtgtctggggccattttacttaagaacctgccctgtactcctttcttaaggtaagtaagtaaagaggcactaaggtaaaatacgcttcccaagacatagactaatcaaatcactcaaggcaggaacatttaaaatgaagaaagagtacaacgaaagctgctttaaaactctaaataagacaagcaaggggccaggcccggtggctcacgcttataatcctagcactttgggaggctgaggtgggtggatcacctgaggtccggagttcaacaccagcctggccaacatggcaaaaccccatctatactaaaaatagaaaaaaattagccaggcgtggtggtgggcacctgtaatgccagctacgcaggaggctgaggtaggagaatcgctagaaccctaggggtggaggttgcagtgagccaagatcgcgccactgcactccagcctgggcaacagagcaaagattgtctcaaaaaaaaaaaaaaaaaaaaaaaaaaaaaaaaaaagacaagcaaggttatatgctcccgttgctcaacctactcaggaggctaaggcaggaagatcacttgagccccggagttcaggcactctaaactgtagcgcacaatgattacatctgtgcacgccaacctgggaatcacagcgagaccccgagacctcgtctctaaaatgaaaaagaaacaaaatctctaaaccactcaataagatttactctggggcaatcaacagacaaccacttattcagtttaccctagtccctcccctctaaactcaaggaatggaacggagaggtcctttgttggggggtggagagggacaataaaactatatacatctatctagcaagaaagtcgcttatttctgtgtcttaatggactcaccaagaagaaaaaaatagcccctacccatctccccacaagctgaaaaaacataaaaggaatacgcattactctttaaacatggcgtttactatgtttagaaaatccagtgtggattagtttggtgttttatagcacattttaaaaattgcttgtctaggctaagcgtagtggttcatgcctgtaattccggcacttctgggaggccgaggcaggtggatcacttgaggtcaggagttcgagaccagcctggccaacatggtgaaacccccgtctctactaaaaatacaaaacttagctgggcatggtggcacacgcctgtagtcccaatggcacatgcctgtagtccctgctacccaggcggctgaggcacgagaatcgcttgaacctgggaggcggagactgcaatgagctgagatagcaccactgcactccagcatgggcgacagaacgagaccctgcctcaaaaaaaaaaaaaaaaaaaattgcttgcctgatataacaaggtaactaagctttactcgcaaaggggcctaatcagaacctctcaatactaaaataccttctcaaacaaccacaacacccctatgtttacagagtacacaaatcaggtcataacgaacagaacaaacctaaaacttcttattcactttaaaatgcaattaaaacctgtggtcaactcaatcctctacagaagacgcagagacactggttacaatgtagcattactagagatggaagagtagccttagtgacagtgaagaaaaaagtttagtatagttacttcactttcttctcaccttgatatgagttcacaagtgaactaaggcctactcattttctaacttccagaattttcctcaacaggaaacactcacgtaacaaagagtgctctgcaggtttaaccagagaaataacatgtgtaggcaggaagaaagaaaatcagacaaaaatttaacatctcacgttggtaaagcaccaaagtcaaatacgaatgttctgaacgtggctttcagaaaagatgcaagaaaacttctaaaatacttcacttcagtggactcatatagatggaaagaccgaaaatcccaccctaccataaaggctctaataattcttaactgatcattcttttaactggtcacaatcacagacactggtatatactcaaatgaggtggccatcagtgacaaccatcttcaccataatatagacattaagaacctttgtaacatttaatgtttccctccaagtagttcaaaaaataaaaagtcaatcacctcaaattatgaggtactaacaaatacaccaaatatgctaaaggtcgaaggaacggcacactttgttgcataaacctagtggaaatccaattcagaatttcatgactgaaggtagttattccacatttataatacattttttaaattcccaagggatgagcatttttaccttgccttatttttagaactacacatcacactgcacatatcacatgacatgatgtaactgttagcaaagaaaatggtccaaaccattgacaatgtacatggtaaatcaggatcaatgcatactcaagaaccacatttcgtatttactttaaaaaaaaagtttcttaattcaaaatgttttttcaaattgaaaaaatgtctagtaacctatgtagaaaaaaccagaaatgtacttcgtattttataaaataggagtttacccaattatgggaaaaactgatataaagaaacagataaaggaataacatacttctaaaactacaggattaaaagtaaaaattttctagatcaacaccgaaatgctaataaatacacttagcattaggcacaaaacaattactactcaaaagtattcactgttgataggttaaaaaaatagttttaactgacaacgcctgtagacaattgaaattttctaaattggtcagacagcatgctagaaaaggaaccaagtagagcctataggaaaggggaaagggaaaacacacccacttaagcctttgtaaatagtggtcctttaactgacccaaaaagcagagaaaacagaaattacagaccatcctgacaaatggaaaacatattctaacgtactagtttccatacttgaaaggactttcaaaatgaagttcagtagcaatctataactatatcatgattatgcaaggcaaagattatgtaattttatcgtttattttaaaatgttctccgactctaaaactaaaacaagtaaaacgttttgatctctccaaagcgaaaaggaaaggttcctctgagctgcaatttaaaaatataaacacacaccccaaaacaaacaaaaaaacacaatgattgctagccacgtgacaaaggagatggcaacaccaggattgtgaatggaggggagggaggcgaggctggaggaagagagatttctcggaactttggggaccgcggcagtcggtctgccgaccctaggagcactaaactccagcccctacgagttgtgcttctaacaccctcaagtacagttttattaataagtcacagaaaatgctccagtgacctccaggataaaggggggtgggggggaccgaggaaaaggaaagagagcaatttaaagtggcgccatcatgtcaccccttctcccctaaagcaatcagtaagcaatagttaagtagcacgtttctctataaatccacattgggattccaacattggaaaacgaggatttttaagtaagacacgggagtagcgctgtttatcgtatggaaaacaaactatttgctaagaatcaaaagaccgtcagccggaaaacaggcccccaaaaaggcagttaagattccaactcacttaaaagcaaataaatccctcttcctctttagtttaaaaaaaaaaaaagtccgcctgagggagactacatctgaaaacgtaagtgacctgaatttacaggcaacaaaaataataaatgaaacaatcagagttgtgatacaaaccgtgcaacgcgccaagatgtgtgtttcgagcagagaaaggccttttgcagtcaagagaagttcaaggcgagagccagagtttgtttggggggttcttttacgggaataaatcatgttcttcaggccgcctttttaaatagaacgccaaaggaaaagctggcgaacgaggcggcagctcctggggaagggcccccgcacacccccgcccttggggcgactcccagcccggacccgcagcagggaagcccggagaggccatttaaagttccgggggatttttctaccctgccctgcctttctagttacaactaacaaagagagagagaaatgggagccacagggagagcgaggagaaggagaaagggcagcaggaggaggagga

SEQ ID NO: 689 - DNA, 195390 bp, Homo sapiens
attctgtaacttttttttttatttttttcaatttttccttcttttttttttttaagcactagtctgtgctttgcgaacagaatcaagacattaacaaagatcagcttctctgaagaaaagcatttctatagaacaaagacagctacatgtttcgctgccattacacagctccaaagcaggaaaagaaaatatttacaaaatacaaggttttttttttccattttttgtttttgttttttttttcaatgctaaaagggttattcagaattttcaaccttataaatagaagaagcactttatgcatagggatatggtgcattattgtatttttttttaaagaaacaatgacaaaccctttaacttgcaaacagaaaaaaaaatcactaatgttgaaaattgtgaaaaaaccccaaccattaagcagttgtctactatttttatacgattacaaaatggccaaaaaaaaagagtcttctcccccctccccctttttggtgatgtgatcatacaggagacaggcacaaggttaacagagaagggtgaagggggaacaatgggaaccacagctaggaccagacaatgttccacaggcaaggggagcgtgaaagaccaagagtggaactaacaccgacagggatctggatgtgaaggaaacatggcaaagtgaatcagagggaaaaaaaaaaaaaatcacacagggagatggctgctcacttcccacaacccccagtttgcaggggagtgggaatagaggttaagtagtcctaaccctaccttcaaagatcaggataggtggtaaaaatattccaagtggaaggacgggttgtgggtgtgtacatggcatgggagagcagacagggaagggtaccaaggggcatgaggaggggaacctgagcagccacagccaggttactgcagtgaaagagtcaaaacagagaagaccaaatgcagatgaaacaaaaaatcagtctcttaagttctgggtgagaaaggaaaggtgttctgccagctgagcactcggggagagcagctggcagttatggcagagaggctctggtggggatgttccagcacgaaaaaccaaggggacccagccaggagggccacagcagagccaagccacagatgggaggggagggggtaagagtccagagcaccctgccccattccaccctagctcaagaaggccatgctaaactgtagcccgccaggctgttctgccctgcccacaggtgtgagggagggggtggtcatctaagatcagtaagtccagtgattcaacagtgcagaggatgtgccaggaccaggccagcagggtctcatcctgaacttctgtttgccaacgggaggaagtgctcaggtgtgtgacaagaaaacatggaaacaaaaacaaaacaaaaattaaaacaagaaaaaaaaataccaaagtaggatctaaattccttaagttcactaaaaactgtgaaaatttccggcatatgatgtttgaatatcaaacgcagagatttctgaagctttaatgccaatagttagtgagtctgtttagatggctgtctcccgctcatctgtgagtcgggcgctgagctgtggctgctgccaccagatgccgactcttgagggggacaatgggaggcgaggtgggcgctgcctctgtctcccggccagtcttgctgcctgaggtgcgtcgagtgcagcgggctgctcgctcctgtgcatccagctggtcctcacactccgcctggggactgtgcgccagggggaaggtccgccgctcccagggctggacagactgtaggcagacaagttgctctttgaggacccagtcccagccagcctgcttcctgctccaaggccctgccacaaaccttgtggcctggagcctaggaccagtctatctagtgttcctgcgacagtctgggaacacccctcctagggtatacccagacaactgtattgatcatttagcagtgatcaatacagttccactgaacgttgaggagatcaatttaagtgcagccctttgtcccttcaaaagggggaggggatggctaggtccctcttcagcagatgctgccccttcctggttccatcccccaaccatgccaaccccacccaaaggctgcgtcccttacctgttcatccagccccagctctggtgtggaacaacgggtatcctcactggctaagtgtcgcggagtgtcccgagccacaggggtgaggggtgctgagtgcagttccgggctaatggggctcctaggggactgaccatgggagtattctgacaaagagtggctactgctgacatcaggggaggcaggctggggggtggaggggttggcactgcccagctggggggttgtccggccgtctgatgacctgtaggacctgcacaccaaggaatgcaaatctgagtgcctgggaaatgtttacttatgggggtagagggcatgaaaaaagcatccccactggaggagttgaggcaaacaaacaccaacagattttccttaggatccagcaactcccatttcttcccactattctctggaggggtaggtatacaacatttaccatcccaagaaaaaagcatggctgaacaatgccaggtgagtccatagcaaagtgcctagtgaattcaggaggttagggagattcgtgtagactttgaaaactgtagtcaaagaaaaaaaagtaaaagtaagagctcccaaaactttctacttgagaatcccgagggtttctgccactgttaacaataaatggagacagggtagtgatggacgttaagggggggcagtttcttcaagtggcatcacaaagccactgtccaaaggaaggttaacttgtagcgaggccttccaagctccccgggttgaatcaccatgaccccccaactgtcttccaaatgccacagatcatgggaattcagaattacatagtgacttctcagcaaggatctagcacttggctccttatatctccactagttccatgtatctccactagttccaacaaacaccaaggaaattctgagctatttgccactgccagtagatgagtatgatgagcaaccaagaggcagtagcaattccatggactcaagtagggcccaaactccctgtccaccctctctccacaggccctggggacccaagcctgccccatcacctgctgccccgccgctggggtggcacactcgtggtccacagccaccgtgccctctccatctcctcacatttggcatgcagggcggcgaaggctgcgtcggataggtcctcaatctgcaatagagcagcttcatcgatcccctcttttctccaggagttaagaaccagtcccaccccattctaggttcttcccggtcacgacaggaatacaaggagcttgcacttcacacccacaagtcttcaggccatttagggtgtgtgcactcatatgtatgtgtgcatgtgtacacacgtgttcttctaacagaagaaccaggccattacctcttcattctcctcatcaggactccccttcagagactgaagatcaacctcccgccagctgcaaaaccaagaacagacaatcatgagatggcaagcaggctaaaactgggggcagggtcaaagtgtccatgcaaggatgagaatcctgcacctgtgggtgacactgctctctgccgggtaggctctgccctatcacagctcagtctccctaccctgtcaaggcctgtgaaattggccacctactcaaatgcccaagaaggccagaaatgagagaagcggcctagggtaaggctgaggctgagagactgtgacaaacacaagaaaagaaacctgtttaaagaggaccaccactgttcaggaccagctgattgctcccatatggaaatgcatacccagggttgcctaatcttctgtttggcaacaaaagctggaaacaaagatttttatgtgaaatcctgctttgatgttgacaacaaattcagtattttaaaacatactgtatgtgttgacaaaaccggtctctagaccagtaagtgaatggcctaccaggctgtgactgctggttcgtttggtgtattcctataatggaatgagagagaactatatacagaaataatttcgttcttatcagataagaatttctcttaatgagaagacagaaccaaagactagggcccaactcttggtcagaagagaagagggaaaaagggcaatagcaggaagaatggggagaggagccaactattctgagcttctacctgggcgtaaggatttccttgtattgcagtttctctacgcgagttgttgcagcaacagacattgggatgacaatgttgttaatatcaaatgagctctctccccttctcctccttactggctgctgctgtaagataaaaattaagtttaaaaggaaggtacaattttacagacatcaaatcattcatctaagagttaaagcaggatcaccaataaccaagcatctgggtccttgggttgaagctgagtaatgaccatagcagctgctcccacctaggagtcagtctccaacagcaaaaaacctcacggagaaataccaggtggtcatgaggagttagtcccattcataagtcccactggtcaccctcttccttcaagggctcatgcgtaaatttcataggggtgggtacctgggatcttaactgttggggttcctactctatatacacctctattaacctcctctccttttacaatctttatttccttcctttatccccgtttatgacttaagactcatagtggcccctcccctaaaagcaatgcttgaaagcttatgctgaaagaggcccaaaggataggcccatctcaatacatcatctaaccttggttgtcatgaatgcacctccttctcaaagatctgaactcttcagctaaatctgcacccaccatctgcccagtctttatgtgatttcccctcttttgatgattcttggggaaagagctgagagctttctagctgtatcaaaggagatgaatggagggaaactaaagaggagaacctgactatacctcacattcctggtgaaaggaaatttgcttctataggaaatagttgagaagaccaaactcttggaaaaataagacttccaaggatcgaatatcagaggcagaggtaagcatctacagtagctgggagactagggaactaaatggcttagtctcttggatggaggaagaagtctactagctgctgctgcccagatagttaataccctatcctgaaacagagactagcaactgagctgtgagaggccagaaggaaacagtggcataacaaacacgctgccatggcaacaaaacagctggaaaacacctaagaggctgcatttatacctaaaccaccaagtgtggtcagtccacagggaaggggttggaggagtaagaagtcccctataactaacccctctatcctctgttcctggacggtgagataccctttattcatcctatcatcttaggacattctcagagaatgttaaaagtcagcacttcctgggccagagtttcagtcactgtcatttataacttcagatgaccacaatgcccttttcacttcaatttctttctctatcaaatcagatgactgccattgacctcagaaatttaggatatctggttaaccaaaatggttaaacagacttttggggatcttgcctgagttctgtagctgaggattagtgatctcatacccagagacctctgccactgccagatctgtgctgaaattatacatcccactacaagaaatgcatcttaagaaagcctcaagagagacagccttcccagtatcttggtcaagaataaatgtgaaactgctggcagaaacaggtatacactttccctgaaacttcttgggcttgttgttagtaccttcgagaaaaagatactggagcaggttgtgggatggttcaacgggctcttatctcatcctctgcctagacacaccccctattatgttagctactcattaggtctaaattaactactatctcctatttagagccagagatagagagcaggtgatgagaataaaactggttcccaaacttggttgtatatcagaagcaacattaaggagtattttttaaaaaaaaaaaaaaggttctaggactcccccccgctcttttataaaatcagaattttgtttgtttgtttgtttaagagatgaggtctcactatgttgtccaggctggactcaatctcctgggctgaagagatcttcctgagtagctggagctacaggcatgcaatatcacagccagcaacaaatcagatctttagaagtgtctggttggttggttttgttttttaaagctgctgaggtgattctgatgcagctactggcttttgggaagcactgacaaaaacactcgctctcctccctacctttctccagtgtcctctggcttctttacttgatttcaaggagagctggccctttgtatccatgggttcaaccaattgtggattgaaaatatttgggggaaaaaaattgtgtctgtactgaaaaggtacagatttttcttttcattattctctaaacaatacagcatactatttttatagcatttacattgcattaggtattatcagtaatctggagatgatttaaagtatatgggatttaaagcatacacataggttatatgcaaatactatgctattttatattagggacatgagcaacaatagcttttgctatctatgggaggtcctggaaccaatccccactgcagatactgcagatactgagagcctgctgttatctggcctatcttctttctttttttttttttgagacgaagtcttgctgcgacgcccaggcttgagtgcaatggcttgatctccgctcactggaacctccgcttcccagttcaagtgattctcctgcctcagagtagctggaactataggcacatgccaccacgcccagttaatttttgtatttttagtagggatagggtttcaccttattggccaggatggtctcgaactcctgacctcaagtgatccacccgcctcagccgcctccccaagtgctgggattataggtgagcgccactgtgcctggcctatcttcttttacataaatccagagtctttgaaaaaacttggcaatgagagagcctcaggggttagcatagtgctatacacaaaatttttactcaataaatggtaaaaatttcaagtgatccaggcctaagttaacattctccagacacagaaatattgaagtgctcaccaagtcctgaatctctgagttcagattttctatcagaattagtttagactcttttttataaatactttggttatctgaaaccctttgctgctggataactgagtatgtgagggacactacacacctatttagataaaatttgtgggttacgggggtaaagaaagtcgaagagcaaagagaccatttggaaaagattgatttgtaacagcaaagagagaacaatgtgaattcctacctgatcacaggagcctagtgagtccattttatgagcttggaagtttcctgatctaggctctgaaggaacttcctaagttgcctctgcaataccctcacccaggcttagcctgtgtagtgtaatggtaaaagagctggctctacagtcaggctgcctgagtttgaatcataattataaccctcacaagttgccttgacagttttcatgcatataaaatgaaatccacagtaccaacctacatctcaaaaggcattataacatgtaacacatgtaaatcactgatcactggtatgtagtaagtgttcaataaacattacagttgcagacttttacatttaccattacattacattgtaattattatacaaaaaggaccctttgagtaggtccatagcagctacaggtatgtatgttccaagagggcacacttgaggaattaaaatattagaatgaaattaaaggaaatgtgtctggaatagctgtgcaaactgcttccagatggagtgtggtatcgtaaaatctggtgtgtgcatgccaaatgtcctgccatgggggcctgctggatctgtaattctgctctgtatacctaaaaagcatggactctgccttctcccttcccttctcttctggtaccctcacgcctagtgtttattcttagtacttcacctccactcacccagagagtaaaaccaaggaaatcaaacactgcttccaacgcccatgggaatctcccctctacccacccctcctctcttgttcacttcttgggccaacaggattagggccacggaactgttgagtcctgtgtgaaacttagtccaacagatcttgaatagtcacagatcaccttaagagtttgtccctgcatcaagctttctatggatggctcagcataaatccatctctgctatgaaaaacaactcaagaaaaacaacagaaggtcaagtaccatgactttgacttaaaaatggtacagacatacatacatatgtcatgatgagctgagatcctataaatgccctgggctttataacccaccctcacactgtcctctggagccacttgagtgagctgtgacctgcagagggggtgtccggccaaccccacacaggtacttaccgatgtgctggctgtaacctgtgagctagagctggcgggtgcaggggaatctgaggaggtggagagctgtcgcaccaagggactgtgtggaggatggtgggtggctgccaagtagctcgaactgctcatgtctgtgtgatgcttcaacactgcagaagtcaacagaaaagagagaaatacatggctatcttaaccagcgttacttctaacacaagcttggaatggcagcaatacatactaaaggcaaaaatgttttctatgcctagaggataaaaaggtgaagcacactagctgtgggaagtaggggcagggcagaggttgctgtagcagttaagaagtgacctccatttagaagcagtagcgtccctctactctgctttcctagaaagtgaaggacaaagctgggggtaattaagagaagcctaggctgccccagaaagccctgagcaggtgcagttgcaggtagaggtgccatgggcctggccctaccttcacttctctcagatgaatggtctcgcaatctcattttgctgtggtttgggtcatgcacgggtggtggtgggttgagcaagcgctctgcttttggcgctgtcactcgctccaccatgggcacggcccccacatcgtctaagtgctgcctgtgggtcctgtcaggccgggtttggtgatgggacagctctgaagaggggaacagaaaaagagctgtgaaatatgtcctctcaaatattttcttattcgagttccaagctctcgagttctctctaggccaacgccgtatacccagggcagcaggacagtccttcaggactgaagtttctagtaatttgcacaatggctaggataggcacagggagcccagaaccagagaaacatgtcaccaggatacagaagacacctgcccgtagatgaactcaatgccatgccattgctggctgttcactgagcattttgggtcttgctccaagatccatggtgtctagaatagctcccgaagtccatctgagagcatccaagacaagcagaagcagtcactgtgagctgaattttttatcggtcaactgcctctcccaaccccaacatgcatgcaaactacaaatttgagaatataaaaggaatgaaaagtcactgatactctgggggacttcccggctccctgacacttactggctgttgttaggaaggagctgaccaatttgtgcctgtccttacgagctgaatctggcagactgcccggcatgggtgctctgtgcttaagcgataactttttgggaggtttgattttgtcaaaaggcttgttctgccactgagatttcagcatgctctggaaatgcaggcttgtgggaacatctgcaagaaacataaaatgctacaggttagtccaaacacctggcctctctagtgttcaagacctacactccatcctcctttaatttgcccagtggcctgacacttggcagggcaagtgctgtcatatggaagatctgtttacgtgaacattactgaaggtcattcttctatttgcaagcaggtcactttagctttttactttcaagtcccaaagggaaacaaaacaagacacctttttggtttggttgatggagtttttgttcttgtatccttgtttgttgaatttactggtttgaaaacatcctgtttctattctagagatttaaaaacatatttaagcctacttcttttctatcaatataaagttaatcaggatgcaattattcaacaatattcattatctatgttatcaggcactgtactgagtactacatactctctccaaataagaactacataccattctctctttccttcctctgtggctccgccaattcccatcatgagattatcggggatttttagctgactggttaatgttcaatatcacaaatcaacatcttttggactgaattttttatgctgtttcttatctttccattttcttagatttttcccaagaatatatccttgagcaattcctttagaaaaggaatttctagatttaaaccattttcctctcaaacatttaaagctattcaattcttccgtgtattctaatatccagtgctatatttaagagggaatcggattctttcttacttgtaggtggtctggtttttgccttttaagcttctgcaaaaaacaacaacaaacttgtggtattacactgactctacagatcaatttggggacaacttccatgtgttccaccaccaatactgaatctttcaatcgactgacgtggtatctctctctccatctatttacgtttgtcttgattttctcttgacagcgtttagttattgttgacataccggtcttaaatacaatttgttaagtttattcctaagaattagtgttttctgatgggcagaagttggaagagtttgcagggttcagaagaagacaggaagatgagggaaagtctggaacttcttagagatttgttaaatggttttgaccaaaatactgatagaaatacgggcagtgaaggccaggctgacaaaagtctcagatggaaatgattaaagatagtaccttttaaaatttcaacttcagttcttcattactagtatatagaagtacaataaactgctatataatgaccttgtagcctgtgaaactacttcgttatagactttttcttgtttattcagtaggattttctatagacataagtacatcatctacaaatggagactgttttaccttttctttccaatctgtattccttttttacttcttgcctattactctgactggaacctctggtgctgatgtacaacttttagattttccttttcatgttttcaatattctgacatttcaccaccatggatagcggtgtgagtctgttttcaagcttctgcaaagctttccagggatattcaaatctaaaagccagcacatttttcctcacctcccagttcctcctgggaatcggtaaccacttggggcatgctcagaagttcccgccagagtccctatccactgcttcagaatagaatgaaacaccactacttcaaggaagaaggctctggtggggtgagaggacaggaaaggaaaatctaacctagctattccaaaatgagtccaaatttatcacccagacaaatgcccaggtcctatcactactccttctgccctttaattctgggtcaaaaacctcctgtaatcagttcccacctcacagcaacttactcctggcatgtgctttgggctatctttctatttatttcttcacagttatcttgtctttatccatctttcaaaaataattacaaattccagtcactgatagcatgtcttctagaactattagaaatttattttgtgtgtgtgtgtgtgtgtgtgtgtgtgtgtgtgtatatttttttttttttgagacggagtcttgctgtcgcccaggctggagtgcagtggtaccatctcggctcactgcaagctccgcttcccgggttcatgccattctcctgcctcagcctcctgagtaggtgggactacaggcacccgccacctcgcccggctagttttctgtattttcagtagagacggggtttcactgtgttagccaggatggtctcgatctcgacctcgtgatccacctgcctcggcctcccaaagtgctgggattacaggcgtgagccactgcacccggcctgtttaatatattttctaaaagcttatggggttttgggtcccatagagcacagaggatatgctcaatctgaactgaggataagaaggcagggaagagacgtctaaattaacattactgaacccattattatctgccaggcactgtgtgtttatcatcatgcgtgtgccacttaatctttgtaacagttccatgaggcaaacacaattatgcttattttaaagatagggaacaggtgcagaaaggtacattaactatgtccaaggttacatagtttaatgagtaacaaccaactttcaaactcaagattatacaaccctaaagcccatactcttagacaatataccttgaggctactcactgatccagaggatggagaggattctgtagtaaagtcaattatttctcaaattactcccaagaaatagacagtacaaaatattttccaagccagttctgcagagtaaaagaaatttagccactcctgcctatggtatagatgatgaatttcatgacactgaatgttatgccttcgaggactgaatgttaggccttccaggactggaataaaaatctgagttggggaaaaaaaaaaaaaaaaaaagctaacattctcagggatgatttttcccagtgggtaagcaccctcagctccatgattgctgggctttatgacagtgaaacaaattaggaaaactattaaagttttaatgaaaacataacatttgctacctgtccaagtgtaaaaacacagtctctgaggacagtgctgtcttctcaaacatttttcataatcactcttttccacacttaaaaactcagctataccaaatcctaggaaataaagcattgtctagaagcattcggccctgtaaaacaatctgaaagctgggctgagctggaatgtataaaagaggctcaagaaaggagacgaggtcacttctgcccatcccacaatacccctttgtcagcagaagagttactcccacttggcaaaggctgtgtatgttttgtatatatatgtaatggaactccaaaaaacatagattttattttttccttttattttcccccatcgttctcccaaatctgaaaatgaagccaggaaaaaaaaaagggacagggatatgagagacctggttatagtgaaaacagcaatgactagaaacaagtaggcctggattcaggtcctggttctatctcgagtagaaggagaaagcaagaacaaatcattcagctgggctttagttccacctgtgaaatgaggcagtggggctagatcagggctggcaacattctagcattcattctctaaccctcctgttgtactggaggtacaaacacagctgtctttcctgttgtactggagacctcagattcttcccaaacaatacattaaataactccagacagttactgtcaattcatttgaataggcacaagaaaggacatctatttgttactgctagattatatgactgctatgagtctctcaactctaaaatgtttagtcaatgactcttcaactggaactccactcctaaacccttcccctcaactaaatgctcttaagtgcaagttggcacattgtagaacccaagtcatggaacactaccttgtactctccagttgacgtattaagcggaatcaagagcgattcctctttaaacccagtataaacagtttaaggaactccagctgctagactttgttagaagtttgctgtgttgccttttaattgcttccatgttaagagtgaacaggaacccagttatatcccccagtcagtaaaaaaaaaaaaaaaagatatcttaggaattgctggttgagttcatatactaactagtaagtgataatacctaggttctgtgaagagttaaaaatctaaaatagactggatacgggacctgaaagtaagcaaaaaaagggatatgaaatggaagagaacacaccagagatccattcagctagaggtctcctacattccatacccacataggtaaactgctattttcagagaagagggtgctgatccttatcaggtaaataacaggaaaataagacgaattactaatgtcatccttaagttactgtttcctcaaacaaaatgaaagatgaatgagaagaccctgacttcaggatgactagggtctgacattccacgattcacctggctgtctggctccttactttccaccattttctcaggcgcactttttccgggtgttttgtaatgctcacttcttcctcctgctgggaagttgctgtagcctcatgtgcagggtttggcaagctctctcaaaataccacagatcttcatggccagcaggtggtgctcttattaagccccttttataaagttaacaagcttttctccaaggttatatatcctctacatttccaactaaggattaactggatttgattacttgaggtgataaaacaaagcccccttcctgctggaatactaacaggttattataccctagtctctccaccttccacagccaggcgtagagttggctataacacagtccctcaatttctatcacccacacacacttaatgagaggggctgaggtacagtcaaggtgcgaggcacaactccaggatgaaaagcagcagttggttgttattctaacaaactacacaaactggttaggaaacagcactaaaactacttaaaaaaatatctgtcctatggggccagaaaacagctaagtatcacattcaaacaattttctgcctttatgtctggtataaatgtaactatatggaatcaatgaatcaaaatcatttttaaccttgttatgaaaaaaaaaaaagttggaaatcctgccactttaaaacatcttctagagaagaggttgtaagggtggcccagtagtaaaatctaccacacaaatgtttgacctacacagtcgtatgccaagctgctagccttcactgttatttactgctatacaatgatgtacagggaatcccaagacttcagggggtgtgttatttacacgggatattatgtgaatggtgccctttggagttggctatctctgcacccatgggaatcttctgatttccaaatggactgcattctgaatgtggcagttgtttgggtcaaagcaaaattattccaacaggaataatattagacatggtaatcaggtcttcaggtcaaccaactgaggtgtaattaatctacaggcaaatacagtagttaatagagcctacatgtaaaaatatatatatatctccacagtctcataaggagaatttaatgaccaactttttcgtccaaaccccagggccatagctagaagctcttcgtgtgtgtgtgagacatagacagaaaaacaaataggattagatgcaggaaaataaaaaccataaagaccagaaaagggggagtgttccctatctttctttccattccccctcattgctgcctgtagttgctctgaatgatggtgtgggaggtgtaaggtatgcggcagggcagcattcatgtcagatctatagtgtcctgcagtcagcaggacagaaaatgttcaagggaaatggaacctcttagtagagatgctgaatgatggaacaggagctgagagacacacagtctgggtatatctgagggtgggggaggttatttgcaactgtatgtggtaatgctgttgacaaagaaatgactgttctgtttagcaggtgatatccaatgagtgtgcttaagtgtccgggcttcctgtccttcttcaagtatgagactatacaattcaacacagtaattcagagagtaacccaacaaacattcctaagtcttcctagtggcgctgtctgtagccagaatcccaaaaagggtaaaaatctgactcctcttaataatctgtctggaaaggaacttgaaatatagtaaaaggaaggacaggcatcagataatctgggtctgaactgtgaaggcattcaaacccattagccatttagttttagataagccacaaccttaccaagcctgttccttgagcactaacactgaagtaacaccttacaaaatttctgggccgggcatggtggctcatgcctataatcccagcactttaggaagccaagatgggtagatcgcttgggcccaagagtttgagaccagcatgggcaacacggggaaacctcttctctactaaaaatgcaaaaaattagccaggcatggtggtgtgcacctgtagtcccagctacccactgaagtgggagaatcacctgatcctgggaggccgatgctgcaatgagccaaaaaccacaccactgcattctagcctgagtgacagagtgagactctgtcaaaaaaaaaaaaaaaaaaaaaaaaaaaaaaagccaggtgcggtggctcatgcttgtaatcccagcactttgggaggccaagacgggtggatcacgaggtcaggagttcaagaccctcctggccaatatggtgaaacccccatctctactaaaagtacaaaaattagccgggcgtggtggcgcgtgcctgtagtcccagctactcaggaggctgaggcaggagaattgcttgaacttgggaggcggaggttgcagtgacccgagattgcacgactgcactccagcctgggtgacagagcaaaactgtctcaaaagtaaaaaaaaaaaaaaaaaagaattttgaaagcagcatatgagacaaatatgagaagagtactacaaactttaaaatgctatacaaatagtaactgcagttacatgggctacataaatccaatggcaagggaaggtaaaagtcagtgactctggaatctgaagcacagaggaaaatgttttagtgttttccactcattgtgttcaagtttatttattgctccaccagctcctgactatccatgtgttccaggttttctgtttcctttctcttacaagaaatcacatggccacaggaatattacaccacatccttatcacagctagggggttttggtaacaaaagccaaaaatcccggtatctactggatttaggtggccagaaatgcaatcatttgaagaacagatgcagaacaggggattatagttatctaatatttgatcaactgtcaattagaaggattctctctaggacaagggttagcaatgattgtttttataaataaacttttgttgcaacacaatcaggttcatttgttcacatattgtctatggctgcttttgtgctacaatgacagggttgagcagttgtgacatgaactgacatcaattatatggcctgcaaagcctaagatatttaccatatggcccttgaagaaaaagttcaggccgggcgtggtggtttacacctgtaatcccagcactttgagaggccaagatgggtggatcacttgagctcagttcaaaaccagcctgggcaatatagcaagaccccatctttgtagggggcgggaggcggggaagcaggttgtggtggtgcacacttgtagtcccagatacttaggaggctgaagtgggaggactgtttagagcccaggaagtcaaggttgcagtgagctgtgatcactccactgaactccagcttagggcaccgagcaagaccctgtatctaaaaaataaaaattaaaaaaaaaaaaaaaaaaaaaaaaaaacttacagactacctgggagatattatgaagaacagcatggagcccttatcctcagggagattacatcccatcccttccccactccccccgccaccaagacagggtctcactaccgttccccaggctgcagtgcattggctcaatcatggctcactgcggccaagacttcctgggctcagctgatcctcccacctcagcctgctgagtagctgggacgacaggcgtgtgccaccacgcccagttaattcttgtgtttttagtagagatagggttttgccatgttgcccatgctggtctcaaacttctgacctcagatgatgaacccgccacggcctccaaaagtgccaggattacaggtgtgagccactgtgcctggtccctaaaatttaaataacagaaagcaaatacacaaacagccataacataattcattaacatattgataaaacacaatagggtaggtgcagtggctcctgactgtaatcccagcactttagggaggccgaggcgggtggatcacctgaggtcaggagttggagaccagcctggccaacatggtaaaaccccatctctactaaaaatacaaaaaaattagccaggcgtggtggcatacgactgtagtcccagctacttgggaggctgagacaaaactgcttgaacccaggaggtgggggctgcagtgagccaacatcacaccactgcactacagcctgggcaacaaaagcgagactctgtctcaaaacaaaacaacaacaaaaacaaaaacccaccagtgatttgagaggaaattcctaccttctgtaggctgggcacagatcatgagattacgtgaaaattcaatgaaaccaatccagattatgaaagcgctggcttccatctagaatagtggtttcaaaatgtctttgctcatgcacccccatttgatatgtgatttttaaaaaatcataatttcagatagttgtaaagattatatttgaatactacataatgctttaaaaacatttttatcaaaactttggcatgtaaatatatttagcttcattaattgaaaaaaaaaacttcttttaaacttatttagctaatcagactttagatattaactcagtatttattctaagacagacaaggaataggaccatgtaactgagctcagacccatcccagccactcgaagagttagagggaaatctcttagttgcaatcttttagtggtaccctctggtttggtagatctgttgcagtctttttggagaattctaagagaagacttggttgataggagttcctgagttatctctattttatttttaaaattcaaaacttttttgcttaatacctgggagattctccttcaggtgctgagaactcttagaaatgatctctttatttgttgtccccaccatccaagacctttttttttttttttttttttttttgagacagtcttgctctgtcgcccgagctggagtgcagtggcatgatcttgactcactgcgacctctggcctccaggttcaagcgattctcctcccaaataactgggattacagacatatgccaccacgccctgctaatttttgtatttttagtagagaaggggtttcaccatgttggccaggctggtctcgaactcctgatctcatgatccgcccgtcttggcctcccaaagtgctgggattacaagcgtgagccaccacacctggtctcgaactcctgacctcaagtgatctgcctgccttggtctcccaaagtgacgggattaaagacgtgggccacgacaccgagcctcaagatttttacactctggggcaagacccatagtgggactcaatatggccaaaaggaatgctcttcttttgtcaagtgggagaggtacaggtatgggaagggaggtgggaaaggagggctgtcagacacagagatttaacagggaggcaaactttagaaagacagtacaagctaacaacgaagatttgtgcttatctacaccctgcaaagctgtcgcgttaccacataaatgccagtatgaagatattctcctagaacactgccgtccatcctacattatatcatggcacgcacagacaaaacttttttttttttttgagacagagtcttgctctgttatccaggctagagtgcaatggtgcaatcttggctcactgcaacctctgcctcccaggttcaagcaattctcctgccttagcctcccaagtagctgggattacagacaggcacaaccacgactggctaattttttatatttagtagagacggtggtttcaccatgttggtcaggctggtctagaactcctgacctcaggtgatccgtccacctcagcctcccaaagtgctgggattacaggcgtgacccaccacgcctggcccagacaaaacatttttaaagatatactaagcgtattttggaccagattactgtggctagaggcaactgagcccagatccctcctagctacttgaagagttagaaggaaatctcatattaagttgcaaccttttagtggcaccttctggtttggtggatctgttacagtctttttgcaaaattctaagagaagacttggttgacgaaagttgtaccttgaaagtatctgagttgtaactgcaccttggctgattttctttcacctagaagtctctcaagtttctttcattagactttctagtctgtggtctttcttaccatctggaaatgctagaacaggatgaacacaagagtccaactgggaaagacgttccaacagaggggcttcatagtgaatttcgggaggcatggtgttgatgctgcctgaaccacacagtgcgcaggagggattcacatcacagccagggcggattgtgctgttccggtgaacctgtgaaaaaagccaaacaaaactgacaattcagcatctgataaaaagccagctacccatttgttatccccatttgttattgagaagttagctccccatttgttattgcgaagacctttctagatacttgtgtgacactactaaaaggatgtttgattagtttgttaaaagatttccatttgtctaacacactgaccttcaaagtgggtaaggaaacttgcttccttttcattgatgaaatctaactacttgaagctctaagtgcttacctaggtatcaaacttctgacagtttaaaaagatactaaaactgtgctttctgagaacactttataaactctgcatgctttcacgaccttgatggtccgctaagacgaacagttggttcttgattcccaggtgggacattacttgctttcttcagcaaatttatccacctaggagccttcaattaccaaccacacctcttctcttcttttcacacctcttcttcaaaagactttcaggtggtctcaagccaggtggcaagcttccctgaagcttgtaacttaaaagtaacttattaactactctttaacctggcctaaaatccactgttacaaagctcatacctaagtaataaaataacattttgtacagcaaatgctcactttcatagtcttcatgttagattaattccaaagggtagaaattatttccactgaacttcctttgtgcacatgtgggcagaataattgataacctctccaggtaagtccaaagttaaatatgaactaatttaagtcttcaaaagattgaattctgtataaaaactgaacatctacaattttatactttgagcaaatttcaggtcatgctgaatgcaggatccctacattctagtgttaggatgaacaagtctggcatttgccaaagcctaactcataaagtcacctggacacacagccccagaaaaagaaacttgcatgttgaatggcactataagaaggcatcctaggtgcaagctcagtagtagaacaaagacaaaaagcatcaaaactctactagcaaaaactctaacatttactagagctccatttattttcagcagagacatctcgaaagccttttatggatttgtgtaagagaaagatatacataagaacaatgtggtctttatcaacattcccccgacattctattgtaaccacatagagaggtggcacgcaaataaagtcttttaaaggttagactgggcaaatcacacagaactagaagccactgaaagggagtgataccaactaggcatgctacttttgtgtagacaatattaactggtattgttttgggaaaaaaaaaatccctgtatctatgtaatcagagctggctttctggagaggatgacattttgaggtaaagagaaatgagtaggtagagatgaaaatgagatcacacagtgggtgagtgggaggatttaggaaaattggttaggatccaaaaattacactgaaactttcaatattcaaaagagattatctcactccagtaggtatagcaaataaaaaataaaaagagagagactagaaaccaacccatgacatcaactagctctccatatgggacatttaacaacactacattttatggctagagtgtatcacttaagtcaaagtcaatattgggaggccaaggcgggtggatcacttgaggtcaggagtttgagactagcctggccaacatggtgaaaccccgactctactgaaaatagaaacgtcagctgggtgtggtggtgggagcctgtaatctcagctactcgggaggctgaggcaggagaatcgcttgaatctgggaggcagaggttgcagtgagctgagatcacaccactgcactccagcctgggcgacagaatgagactaagtccaaagacaagcaaacaaacaaaaaaacaaaacaacaacaataaaaaaattcaatagatgtggctaggcgtggtggctcacaactgtaatcccaaaactttgaggtgggagagaggattgcttgaagccaggagtctgagactagcctgggcaacacagtaagactccatctcttaaaataaaatttaaaattaaaaaaaaaaaaaaaaaaaaaatttagcccagcatggtattgcatgcctttagtcccagctactcaggaggctgagggagaagaatcgcttaagcccaggagttcaggttatagtgagccatgattgcaccactgcactgcagcctgggaaaaagagtaagatcctgtctccaaaaaaaaaaaaaaaaaaaaaaaaggctgcgcatggtggctcacgcctgtaatcccagtactttgggaggccaaggtgggtggataacctgaggtcaggagttcgagaccagcctggccaacatggtgaaaccccgtctctactaaaaatacaaaaaactgggcatggtggtgggcacctgtaatcccagctactggagaggctggtaagagaatcacttgaacctgggaggcagaggttgcagtgagctgagattgcaccactgcactccagcctggggaacaagagcaaaactccgtctccaaaaaaatttaaaaatttaaaaaaataaaataaagggtagaaattctacttataacttgacaaaagggtaatgtgcacacatgtaacttaaacagtaatctcacttttaaattaaaaactgtaaagtactaatagaacccgaggagtatataaaaatatatttaatacttattttttttttgagacagagtcttgctctgtcacccaggctggagtgcagtggcgcaagtctgccttccaggttcacaccattctcctgcctcagcctctcaagtagctgggactacaggcgcccaccaccacacccagctaatatttttgtatttttttagtagagacagggtttcaccattgttagccaggatggtcttgatctcctgacctcgtgatctgcccgcctcggcctcccaaatgctgggattataggcatgagccaccgcacccggccaaagatatatttaatacttattaaaggatacattttggaaaatttttgaaagaaaacttgaattcatacccatgttgcacaaatccacaccaagaatctatcctgcagacaaacttaagtgtacacacgcacacgctcttccactgaaacaagatgccaaatcatctgcatgaattcatttaagttaaaaaacaacaagaacacacacaatattgtgttttacaataagaaaacaaatttttaaaaatatcacaacagatggtgtgcacgtgtagccctagctatttgggaggctgaggtggctcacttgagcccaggagtgaggagctatagtgatcatgtccactgcactccaggcctgggagacagagtgagtcagtctcttaaaagaaaaaaaaaacaaggatctcctgggctcaagagattcttctgccttagcctaccaagtagctgggattgcaggcatgcaccaccacgcccagctaatcttttatatttttagtagagacggggtttcaccacgttggccaggctggtctcaaactcctgacctcagatgatccacccgtatcagcttcccaaagtgctgggattacaggcgtgagccatcgcgaccggtcccagtcatgaaatcctattggcagaatccaaccacttcataccacctcaactacactcaatctagtccaagtcactatcttttctcaaatgggtttcttcaagcctcctaactgatcctcctcctactggttcttacttccaaatcaatcaacacagtaatcagtgtaaatcttgttttaaaatctcaatcacatcataccaacctcataatcttccaaatgacttctcatctcacgaggaatagaaaccaaacttcttgcatggttcccacaaggtcctatagtatttgtcgcctctatcccctctctctgacttcacctcatttttttgttactctcctagctgacactaccagttactctgatttccttgctatatttctccaagatagcaggcaaccttccagatcacaggcctctgcacttggctcttcaaccactaattccatggtcattctctcacatcgtgtctttttctttaaatgtcagtattcaaagtaactttttttttttttttgagatggagtctcgctgtcgcccaggctggagtgcagtggtgggatctcagctcactgcaagctacgcctcctagcttcatgccattctcctatctcagcctcccgagtagctgggactataggcgcccgccacaacacctgactaatgtttgtattttttgtagagacagggtttcacggtgttagccaggatggtctcgatctcctgacctcgtgatccgcctgcctcagcttcccaaagtgctgggattacagacgtgagccaccgtgtccggcccaaagtaagttttatttagaaatacaagtgaaaggccaggcgcggtggctcacgcctgtattcccagcactttgggaagccaaggcaggtggatcacctgaggttaggagttcaagaccagcctgaccaacatggtgaaacctcatctctactaaaaatacaaaaaattagccgggcatggtggcgggcgcctgtaatcccagctactcgggaggctgaggcagaagaatcgcttgaacccaggaggcagacgttacagtgagctgagatcgcaccactgcactccagcctgggcgacaagagcaaaactccctctcaaaaaaaaaaaaaagtgaaaaaagattatattcttgactgtaacaacaaaaaatgccctggaataagtttaacaagaaatttaagcacaaagcttaaagatattgatattctacaaattaatgcagaatcttaatagacttgaggggggaggggagacaaggcaaaggggatttaaacaaataatctaaaagatacaactgaaagaatgtaaggaaccattccccaaaatttctgataagcaaaaatacaggggagtgatctggcctattacatgttttatagttacagtaattaaaataatctgccctcggttaagaaacagaaaatttaaataaaaacaaaaattgaccaaagtatatatgacagtttattgtttaactaaaataatacttttaaatcagtttaaaaaaacaaaaggaggtattactttttcaacaaatgaatcaggaaaaccaagaggtcatacagaagaaaacggctgcatttctgcctcacaccaaaattaattctaaataaagatttattcattttcattttattttatttttttgatacagagtctcgctctgttgcccaggctagagtgcaatggtgcgatctcggctcactgcaacctccatctccgggttcaagtgattctcctgccttagcctcccaagtaggtgggattacaggcacccaccaccaagcctggctaatttctgtatttttagtagagacgggggtttcgccatgctggcaaggttggtctcaaactcctgacctcaggtaatccacccaccttggcctcccaaagtgctagaataacaagtgtgagccaccgtgcctggccccaaataaagatttaaatataaaaacaaatattatactcaaatctaaaaaaaaaaaaattgtgaagcaatatatagtggttaacagtatgagctgtggagccagactgcctgggtttgaaccttgactccgccacttactagctgtgtggccttaagacaagttactgtgtcttcatctttactaacaggagagtacctgatagagttgttttaaagataaataactcacaacagtatctggctctcgactcttaatcacttttgtaaaaccgtaagtatagctactgatagaacatttaccatcaaacttgatagaacatttaccatcaaagatcttgatttcaaaattctagcttcttaacactgtataatatgatcattgataagtcacatgacatccttaaattttctcacttgttaaaaaggactaataataccaatttcatgggagtgtaggaaagatcaaatgactctgtaactgttaaaacattacacaaatgttagctaaattagtataccgcatgatttctcaacagctggcacttctttgttgtggggcacagtcctgtgcactgtagatatctagcagcatctctgtcctcatggtgcatgtgcctccctactcccccaatttgtgaaaatgagtaattactacagatattgccaaatgtctcctgtgaggacaaaatcactgagaaccatgaggttcaaattacggtcatcccgtctagaaaaattcaaagcacaggctcccattaaatattagtggtgagtcacagtaaacataagactcagtaaaaaaggaaaacaaaaaaaataaaaattaatagtaagaacaaagctctcaaagactattgtcaagaacaagcctgaagagagcttcccctaccaaagatcagataacgttagcatcataaagaaaagactacaatggcttgaaatacctcaaatatgtttcaatcaatgactcacagccccttcatgaaaaacttcagtgactgtccttagaggatagtagaaaactaatttgttattttgaaaattggtaaataaaaaaaaacaacaaatcatgctttcttctgtacaaactgtacctcagggtaaacaaatagttgaaaaggacaattttccctttataaacatattctatctagctaataaaagaaaaacagaaatgatacaagtagaatatcaccattcttcagcttccaatttaacaatgggtccaggcaatgatcaccagtggttgataacaaacagtttagtcattacgtgtcttctgatacaagcataaggcggccaccttgtgttttctcacgaaactaaaactggacttattcacgtttctactagttttcaagaaaaacaagggacagaaaaacatcactgttttttaaatgcactaaaaataagatggattaataaatggaaggatgattgtatgctaaaatgttagtggtagaacctagggagtagctacataggtgttcactgtaaaattcattcaacttcgtatctgaataatttcataacaaaatttggaaaagaaaacagtgacaccacaggacttctgcttctagcagagtaatagtgatcagatttacctttcagtcataaaccagaaaactggacaacaggcagtataacactgagaaataaatggggtggtctctaagactgccctggttttccgtctggaagtacattctagactgcagggcagggagaggatctgaagcagagtataatagcttcactgagttgaggaagcaaattctcactagatcagaattcagagactaaggaaactgaaaattgcaaggcaaaattcttgagaggaggaagctttacagaaaaagagccccagaaatcttcataagatccccctgagtgtttgctaaatattaaaaggtgcatgtaaagggtgaaactatcaggccaggcaagagcaactaggcagctgtgagctgaaatggtttccacagctaacacaagcctgagaggcttttaaactgtgaccagccaaagttgcatagagaattcaagacagaagatcctgctttagttgtggagctagactactaaggtggccaactcctcacctgacctaacaaatgacaaggaatttacctgccagcaaaacaaagcctctttaaaggaagatggcacaatccacatgctacaagcagggaaaattattaattggattttcagcttaaaacataaataaaacattgttagatatgccaagaggcaagaaaatactactatagggataaaatttttaaaagaaagtaggctgtgggaaactaaggtatcagataaatgaagttttctcaacaaataaatcacctatatggatagtttgtatcaaaccaacactctcactaattggaaaagccagatttaaaacacacacacacacacacacactctctctctctctctctctctctctctctctcaaaacataagaaaaatgctgacataatgacaatattgaaagctaagattccagagaggaaaagaacctggccaacatggcgaaaacccatctctactaaaaacacaaaaattagctaggcatggtggcacgtgtctgtaatctcagctacttgctgaggcaggagaatcgcttgaacctgggagatggaggtttcagtgagccaaggatgtgccactgcactccagcctgggcaacagagcgagactccatctcggaaaaaaaaaaaaagaaagaaagaaaaaaaaaagagcagagcttttggtactcttgtagggctgaatggataacactagagacttgaaatgtcaaattatcaataaaaagaggacagggaactaagcatgacacacttccaagtaccaccctcccaaagaaatagctgaagttgtgaatggtaggaggctacaaagctaagtggaaagtctctgaaaagggcagagatgtttctggcagtctcgtgaggagactagaattagatctcaggatatgctaagaggaaaggaggctgggcacagtggctcacacctgtaatcccagcactttgggaggctgaggcgggcagaccacctaaggtcaggagttcgaaaccagcttggccaacatggtgaaaccccgtctctactaaaaatacaaaaattagctgggcatggtagcacgcgcctgtagtcccagctacttggaaggctgaggcaggaaggagaatcatatgaacccgggaggcagacgttgcagtgagccaagatcatgccattgcacttcagcctgggtgacagagcgaggcgaggctctgactccaaaaaaaaaaaaaaaaaaaagagagagagagagagagagagagagagaaaaggaaactgatcaacacatgttctcagctggaactaagagagagaaacagactgttatctttttgagacagagtctagctctgctgcccagactggagtgcagtagcttgatcttgactcactgcaacctctgcctcccagcttcaaaccattcacctgcctcagccacctgtgtagctgccaccacagctggcttttttatttttgagatgaagagattgcaccactgcactccagcctggcgacagagcgagactccatcttgggggaggggagggggacaaaaaacaaacaacaacaacaaaaaatcagcctgtgcaacacagtgagacctgcatctcaataaaataatgagataaaatacttgatacacgaagaaattcccacgttcccttaattaatactgcaatgctatcaattctctttgaaggaattcccaagaaatactcaatttaatacttatgaaggaattaataccaaagtaaaactctattcaccattttctgttaatcatagcatattcgtccaaaacactaaaagaattcttttggctcaaggacaggttataatcatttgcttttgctttgcatttgatattcgttatctaactcatccactgttaacatgtggaaagattttcaaaggtttggcaactctatcacaatcaagcatatcccacaactggctcttgaagatccatcagagtgaagaaacaaaacgtgtaagcttctattttatctcagtctttcaaaatttattttgtatgtgttttataatgtatatataaaacaccgtcataacagtttagaggtaactgttccaagcacagagtgatttctgagtattcttttagtagctttatgtcctaaggtacaattttctacatggcatgcttgctcctttccaaatgtctaactagtatgaaaaagttggttgggcctccaaggtctattgcactctgtcaaggaagaacgtatcaaattattaacttttaatactgactcatattctagttcattagtcctcaaccatggtgtcatgaaactggatttaaataggtggaatcaaaactaggaggcctagaatcatatattaacacctttatttaccctgatgtctacaggaaacctggtcatagccatgagagaatgccctgtacaaaaatgtcactcttcaagtgtgatacaatgggaagaagaggaggactactcggaattctatggaagccagctttaaaatttggcccagagcaatcccccctatgacaacaaggactacaaaattctaaaatgatgccagtacactgccaatttgttaggaaattgctactttttaaaaaattgaaagaaatgctattaagggcaataaaaatttcaagggtatgttagtaataaatgtagccattacctattctactggttattagtacaaaaaaacccagccttttcaaccattcatttccaaacactgatggtttccactgccagactatacacaagtttctaatggtccacagtaaattgagaatgagaacaatgcagtaaattattaataaaactacattcttttcttttttaaaaaaatactatttgtcttatggtttaattataaacataattttacttaaaaaataaaaagcaaccttatttgaaaattggctggtaccaattttattttaataactttattgatctgaaatcttagtacgtttaggttaagttataaacacctacttcacttaggcactgggccaggaaaagaacataatggcatataagaactttccactggagtgcttcttcattcacttagataattactaacatccaccatactagacccctaaagtgatgaaacacacaataaatagcaatataggctattcagtaattacaactagtaattccgtcattttataataaaattatgatttaggaagtactccatgttctccatgagccttactctgatattcacttaccacaccctagtggttattccttagattacatttaaaatattccacattcagagttgtagaggccttagactattatctcctccaggattactactgttagtctgtctttccacctccagtctcttgtgccaatccatcccaaacataatagttacagattggccgggcgcggtggctcacgcctgtaatcccagcactttgggaggccaaggcggatggatcagctgaagtcaggagttcgagaccagcctggccaacatggtgaaaccttgtctctactaaaaatacaaatattagccaggcgtcgtcgtgggtgcctgtgatcccagctactcaggaggctgaggcaggaaaattgcttgaacccgggaggcggaggctgcagtgagctgagattgtgccattgcactccagcctgggtgacagatcaagactccgactcaaaaaaaaaaaaaaaaacaaacaaacaaaaaaaaaaaaaaaaacatgttacagcagatttacctcccccaaaatagcttacaacacttctctgctcaaaaatttaaaacttatagactgaaacccaaatcatcagtttgggcattcaaggcttcctatttatttactgatagatctcatttctctttattcccaacgagtttaacttactgaacactttgttttagtcattgattttaagaagtacaagtgatataacaacagctttttttttttttttttttttttttagatggactctcactctctcaccaggctggagtgctgtggcgagatctcagctcactgcaacctctgacttcttggttcaagcgattctccagccccagcctctcgagtagctgggattacaggcacgtgccaccacgcccagctaatttttgtatttttagtagagatggggtttcatcatgttggccagggtggtcttgatctcctgacctcatgatctgccccaccttggcctcccaaagtgctgggattacaggcatgagccactgtgcctggccagcctttttaagggcaaaagagttactgcactaaacgtgcatctcaattttaagatatattccagccataattcaactaagctgatagccctttaaaaacacagtaattgggctgggtgtggtggctcacgcctgtaatcccagcactttgggaggccgaggcgggtggatcacttgaggtcaggagttcgagaccagtctggccaacacggtgaaacctcatctctactaaaaatacaaaaaatagctgggcgtggtggcgtatgcctgtaaccccagctactcgggagaatgaggcaggagaatcgcttgaacccgggaggaggaggttgcagtgagccgagatcgcaccattgcactccagcctgagcaacagagcaagactccatctcaaagaaaaaacaaaacaaaacaaaacctcaatgagttccctcaagtatgttttatttggttctggaatgcagtagagatcatttaagatgcaggtaaggaaaaaatattaatcacttgctttgtgtgttctgtactctgtactcacaataactgtgaactcactgtcatgtaacaatattagaacataatttacctgttaacttctttgctgtcattagaaagtaagctccatgaagataagggctttgttttccttaccaatgcaacctggctgccctgaataatacggtgggcattcaaaaatgctgttgaataaatctgtctggaaaaccgagcaattcaagatgacagaagacaagatgcttgctcatcagcaaataccactgaggtcatgtcatgagtgaggagccatgtgagacacagaaagcaacctagacagaaggaatggggtgtgtctctaactctggaagaactccagctttctgctagatctagtacatggtatatttcccaaagtcaactaatttctctgtcttatttttcatgcagcttacttttgtgtcaggatgattctgttttagaaagtggcattggaacaaaaggatatttagttttatgcctatctcttgcctaagctaccttttataattttatatgtacattcaaaactacattcgttcttaggcatggatcagaagaaggttggctacttcacatattaaaaaacaaaatccaggaggccaccacatacttcagaaaatttttatacgactcctgatgtcatgccatagtggctggtaaactgccaaaacagaggaagggtgctttattttcatgaggtggcggttttttttttttttttaaaatgtaaaagcattctgtgttaaattcatcaaggaattgacaaaaagctattttcctacacttgacagtaatatactgttttctgacattcctgttatcaactcctctgaaaatcttttagagatatacgactattagtaaaaaaaaaaaaaaaaaaacaaaaaaaaaactgagactgaaatgtcaatatgaaaaccctgccaaataccttattcttatctatttctgctattttgatatttcaggtagagtccgaggaatagacaggaagaaatggtatcgcctgacagtcaattctacaattcttttctttaaagagaacatggcaaacttacacagtacaactgcatactagaataaaacaaggaaagtactgaaaattcaccatgcaaatactaattgttccagcaattctctcatctcccttatttgtcattagcaaatatgttgctagtggctctcttaagaaaaattcccattctctgctctcttttacagcaacattctttgaaaatgttatctacaatggttccctcaattccttctgtggccttgtctcctgaaaccactccaaccatgctttaattcacctttctccctctaccaaaactgctcaccaatgtctgcaacaaccccaccccactaaattcaatggtctcaattctcagccttcatcttactgatcctgtctgtaacaactgacacagacaatccctcctcctcctccctctccaaaacactttctccccttgcctttcacataccacactctcttggtttttcttctactttattcgtcactcccttcccaatcctttcctcatctttcacaggaatgaggaggaatacctaagctctggaatacatcaaagggctaatccatatacctcttctttatctgagctctccagcactctctattccctcctctattgcatttctctctccaggattttttttaattaattaattttttattattattatactttaagttttagggtacatgtgcacaacgtgcaggttagttacatatgtatacgtgtgttttttttgtttgtttttttgtttttttaaaagacagagtctcaatcactctgtcatccaggctggagtgcagtggcacaaccatggttcactgcagtgtcaacctggtgggctcaaatgatcctcccgcctcagcctcctgagcaaatggactacacacgctcgcccacagcaggctttttttttttttaaagatatggggtctcactatgttgcccagactggtctcaaactcctgaacgcaagtgatcctccttcctcagcctcccaaagtgccaggattacaggtatgagccactgtgcctagcctctctccaagatttaatgctataggacacactgcagagttcatttattattttctttctcttaacaactagaatatttcatagggtaagcacttttgtctgttttgtttagtgttgtatacccagtgactagacagatttagctcgttgcaggaagccaataaatatttgttgaaagaatgaatgaacaacaacaaaagtggtaacaataacagccactttgtacgaggaacttatcaaccagacatcccaataagcatgttacatatatttcattgaaccctcaaacaaccctatgagatctctgaggctttggagaggagtggaagtcagggtggttaacatgcaccaaattaccaaactactaagtggtagtaccatgattcaaacccaaggttatcatcttcaaagataatgctcttaattcctgcacagtaccaattttactggaatattattatctcattagttttggaataaaggcaactgctatttgaagagtcagcaatctaaaattccctacagttgtgaattaatctccatttcctttgtgaagacaaacttttttttagtaatatcaatttaaaaactttagtgaagattcctttttttctcaggcagggtctcactctgtcacccaagcttaagtacagtggcacaaatacagctcaaagcagcctcaaccttatgggttcaagcaatcctgcctcggcctcctgaatagctgggactacaggtgtgcaccaccatgcttaatttttaaatactttgtagagatgaaggtctcactatattttccaggctggtattcaattcctaggctcaagcaatcctcctgccttggcctcccgaagtgttgggattacaggcatgagccactgcacatggccaagattcttttttagggcaaaggattctatactgccattttcagtgataacagtgaaggtgagagggcacactattctccttcaaagtgttaagggcagtacttaaactttcagtctctcccatttctattaaaaagctcaagacagtggttttcaaaactagctgcagagtcaccgaggagctttgtgttttctgaaaacaagattccaacatccaactccagagcaaacagggcccaggaacctagtattttataaagctccccagaagaccttggtggttagccaagtttagaaaacaccaaagttggcaagagactaactctatctgagcatctggctcactgcttgacaatgaccaactctcatctgtaccgaccttcttggaaagaggaacgatgctgttgggtcgaacaagcctccgcttcttacagctcagtacaggacgtgtccgggctgccacacaggtgccatcagatgatgaagagacgagattcagtcgttgcttcttatgtaattgttcctcagcatcagagctgtcacctggaatgtggtctgccaagacaggctgaagactatacaaggggaaggaagagtattctcagaacacacaaagaaacaaaataaataaacaacaagaaaacacaaagaaacaaagcctcttatactagttcaacctctatttgctaatgttcagacacaaagaagcattctagagcagaagcaggtctcctcttgatgtctgttaatctacctgtgtgtgcttatgtgtaaggttcttggtgcacattaactacatcatgtctgaaagataaaagtcaataaataaactcaagttctagtgattgagttctcctctacatcaaacacacgagtaaataaagtctagagaactacagttggttagaaaatgatgaattttgcaaatgttaatgggcttccttagaatcagttctatgaaacccgaattttaagggtgttgtacacatcattcacttgtacagaatctccctgaatcttttgttttctcccttgaatcttcataaatacagatttacaaacatagcccttggagatctaatctgtcctaagcagaggaggttaatataagcacttctgaggaattcctgcaagattaaaacaataataattcacagtaactgtagtgtcttttattttactccatgcccactccattttagtaggtaaaaggaaaatatacaattaattaaaatgcactgcttcattatacagtgaagattaaaaatgttactaagtgataaggcttccgcttctttaaaccagggtcagtcctggctaaagagaactaagagctccaaaacacctttacaagtctactaagtgtaggaagtagaagagctaaaacttacgtgttaataactccattgacaggtctgagtgctccacatgatttggtagacagtgactctgaaatatgaccaataataggggcaccatggttttccaatggctgagaaacagactcaatctgattaagaaaaaggaaaaaagaaattaacatgtacccaagcgcacccctgcctgaaaagcaccaccacttcatttgcacaaagcacctaaaacttctgatgatcaatttgaaaaacacaacttgaatgactgaagaaaaagaaaataagagaatcagtggtcaggtatgatggctcgcaactataattgcagcactttgggaggccaaggcaggaggatcgcttgagaccaggagttttgagaccagcctgggcaacacagcgagacctcatctctaattaaaaagagagagagagaggttgacagagagaaggagaatattatattagcttttgctttggggggaagagggatgaggaatccaaatgtacagactaaaagtaagtacctattgacaggaaaatgacctcaataattctatggaacagaagcttagcaaaacaattacacagtaacataagctttcaactaatgatcaagaaggatatactaacatcagtatcaagatgactaagaggaaatttaaatgtagttaatatctgcttaactctaacagagtatgctagaagcttgttttctaaaaactatgctttgtttaaaaatatacacacaggccggggatggtggctcatgactgtaaccccagtattttgagaggcaaaggtaggaggatctcttgagcccaggggttcaagaccagcctgggcaacatgacaaaaccccatctctacaacaaaaaaatacaaaattagccgggcatggtggtgcgtgcatgtagtcccagctactcaggaggctgaggtgggaggaggatcacctgagccaggaggcagaggctgcagtgagccatgatcatgccactgcactccagcctgggtgacagagtgagaccctgtctcaatgaataaataaataaataaacacacacacacatttttccctgacagaaaacaaagttaataaaatctcaatgaatctaattatctgatgctatcagatactaactattgtctttagagtattcaaatcaaatatgtttagaatataaaatgaaataacagatgagaaagaatagaaaaagtgtgatttgcagtattcaaaacaaattatatatttactaggctcaaaacggataggaacagtatgaatgccagtcatatagcacctctgaggtataggcaataaagcaacagatgcagctatccctcagttctagcaattgttgaactatcccagaaaggctatgggtctttgactccttactttatttttttgagatgaagtctcgctatcccgcccaagctggagtgcagtggcatgatagcagctcaccgtagcctccacctccctggttcaagcgattctcctgctttggcctcctgagtagctgggattacaggcacacactaccatgctcatgtaatttttgtatttttagtagagatggggtttcaccatgttggccaggctgttcttgaacttctgacctcaactgatctgccctcctcggcctcccaaaatgctgggattataggcgtgtgagccaccacacctaacctgtctccttacacttgaactgactctggggcacgctgaagttctctttcctataaaagctttcaaggtaaatattcctataaatgcttcctacaaatgctttcaaggtaaatattttgaggctgaaattctacttttcaatactgatttcttttgtctttatacccccaaggataaaacaccaaaggactgaacctgaaagtagtcctagacaagcatcaaaaagaacagactgaggctgggtgtggtggctcatgcctgtaatcccagcactttgggaggctgaagcaggcagatcacctgaggtcaggagttcgagaccaacctagccaacatggtaaaatcccatttctactaaaaatacaaaattagttgggcatggtggcgcctgtctgtaatcccagctcctccgggaggctgaggcacaagaatcacttgaacccaggaagtggaggttgcagtgagccaaatcacgccactgcactgcagcctgggaaagagagagagagagactgtctccaaaacaaaacaaaacaaaaaacaaacaaaaacaaaaaacagattgggaagataatctaaaagttttaatacaaattatcctaaaatacagatcaaactatatacacagacaagtcatataagtatgctacaatgagtgaacaccgagaaaaggctgtcttttttgttggatatcctgtacatctactaagatatcacaaacatcttgaacaattgtcaatgctatcaaaaattacagtaaatctggcatagacacattgccttaagctctatgcagatttcccttggaaagaaacacggtattaagcagcaagagctataaggatattcctatcttctgacaaaatattctaaccaatttttaaaaatctaccctaaaggagtaactcaacaaacacagccccaaaaatcttattcacaaaggtggtcactgcaatgatatctatcaataatctaaatgttgtaagcattataactatagttatcagttgtggtacaccaaatcaaaatattaaaaagaatcataaaggatatttcttctcttatggaagaagagatttcaagagaaaaaaataatagtttaatatagttgtagtgactaaaaatatacatacacagataacaacaagacaaagagtgttacagttgtaaaactattctgaaattttctttacattttaggtaatagttttatattaaaaagaaacccccataaaaccaaataccctcctgaatgctagtaaggatttactacacaggggaaacctcaaaaaggctaaacaaatatggtatgacaaagaacaagaaaaatcaaaagaatttaagattcaggttggtattaactaacagatgtataacttcaggcatgttataggtattctagatttcagaagttctggtttagatgaaaaagtttcctttcaatagaaaaatgctgtttaaaaatgctgtttgtttttatttcggcattaaattatggcagtgatttgatttatatatggtatatataatttatatggtatatttgatttatatatggtatatataatttatatggtagtgccttcacgtgttctagaaggtactacgtttaagtaacgggttgactgactctccatttgattaagtttttctggtagggattatgagatttaactgcaagaacacttgtcaagataaaatgttgccattctctaacaaagtctcatttcaaaacatttatctttcttatacaaagtctaaagaagaatatgtcaagtaaaatcaccagtaatgtcacgatccatatagctaactactactgctataacagcctgtcttgtttctcatgtctgcaggtgtatatatttaaatgctattcagctttaacatgaatgttattgattttcttatagaaacctgaatcttcctggagtaattcagcccccaaatcaaaattgaagtcaacaggcaacacattattaacatggaaatgttgtcaagaacatagaggtatacagaggtcaagagcataaacatcagaaagggactgtggctggcctgcattcccagccacaaaaaagaaagcactggatactcaggaaggatctacttcagatcttgggaaattctgtaatcaagctagtatccaacagcaggcatttggacatgtcctgcaacccatcatcaatgcaaagagcttaaaatattaatcccaatcacagtgttccatttggaaaaagaaaaacataacacacaaacacatgtaatttcacctagctccttaaatgcaggcactctcccttgagaaaaaatgaacatttcctatcctgcagtctaaaaggctgcaaatgcagaggataaacattaacaaacacttaagaaatattaaatccgcatactaatttcagcttattactactgcagtggtttacatcattagtgtttttagaaaactaaagcatgactgagatatctgctatccaataggcaactgcaaaaaggatgaaagaacttaagactctcctacctagaaaataaggattatcactgaagcttccatttgaattttatttgatgttgagatgaactcagggtttatgcatcccacagccagaaagaaagagtagaaaagctaaagtggtagacagagtgcctctgtaatcccctcctctccaaagcagggccctaggggattatcttttggagtaatcttacagttaaaggtagcaaggagggttgctgaattgctccccccacccctccccccgccccgattgaaagggccaggtgtacagcataaaattactaacatagcaatgagattcaaatttgttattcacataaagcaggcatctcattcattactccactctgggccagatcaagtaagcgtgacaaagaggccttgaatgaaaagctaaaactaaatagtttttacgggggtcgttttttctagggtctaagaaccaatgtctactagatttgtttcaccaaaaagtagagagggttaaggggtaaaaacagagagccacacacttaaaagcacacaataaaattaaactctacctgcaaatatgtatttttactttattcaattaatgccatgtcacacctgcttgcaatgtcattttttaaatgtatcacattcgtttggctagaaaagtcaacagttcagttttggttagttattccctttctgacaaacattaaaatggaaagaaaatgctaactgggtgacaggaatttaacttattcctgggttaaaatagtttttgactttgtatgattgatttcatgtctcaagcccaccccacccccatttcaatgatactgagcatagtttcgcttaaattcaccaaaatattgctggcctataaatagtatactagccatttccattagctagcaccatggccataaaattgtactaaacaagaagtggaatgttctgaaaattccattttcactaagttattgcctaggctttaatttctgcctatgtggggctatgtgcctcactttccggcttctgcaggttgaggataaaagaaaatctataaaattacattataacaattttgaactcatttttttaaagttttgattagcataatgctgttactaatccaatggttcctaagcctaagatttatgtttaccaacacttgaaaataactatctagaatttaaagaaatatagcaaatgcaaaaatgcatcttaaattcttattgttcaacttatttatccatagcccaatttattataaaagacctaacttgtcagtgttttctaacactgtgggtcaaatatttcttggccaatatctgtccctttaccttctatcccaaaacccttgtcaggccaatgaactactcactgtccctagagactgcaaaacttcaaagaaaggaagagtattcctacttacaccaatggaatgaagatgtatcttggactgtgtaaaaagaaacagcaatagcttacatttttagcatgcctttcttctgagaaagcattagctcttcacttaatagtacacttgtttttctcatcacttctgtaaagtaggatgagcaaggaaagggtaaaggagcaggatcattttacaaacagaaactaacacacaaataatgtgttacttgttaattgccatagaagcaatgtttttcgctaaacaaaaccctccttaacgtcaaatctagtattttaaaaaatatttatccaagaaggagattttaaaaaatatatacatgtgtctgctcatcggtgcaaaaaaatacaggaaagataagccaaaacgtactgaaattgctaacctacaggacgttgagtgagaaaaggatataaagaagaatgtatagcttttttagaaccacagtaatgtttcccatacaaaaataaaaattaacaatgcggggtggggaaaacagggaaggctagaattgaatactgtagtaacaaatgaacctaactgtattacaaaacaacataaccatactgaaagatttggtggaaggaaataactaacctacgtaacttcagaaaactgtattttgactgcataacagttaacatactgtacaaaaatattgtactctagttagcaaatgtgtttttcacaggggtactagatgacaactgtgagactatacgggtactaggattaaacgagtatcaataaggaagggggaaggctgctgtgttgaactggtatgaacttacggttttttatatatatatacaggttaagtagatacagaaatatagatgtgtgtgtatgcacctgtgagcatagatacatatgtttccttgctttgccttttgagacatcctagaagcagtgacacttacgaagtaacaatgagcacaactagtactcagattttagttcctaataaaaggaacctgagctgaagtaggcaaaatacaagaggaacctggaacatctagtattagaaagtatttcaaaatataagcggtacatgctaaaaggacacaggagccaatctgaaagagcgcccaatacccaaagttgagataactggagcaactgtataaacagtaataggttataatccattaaataaaataaatatccatgggaccatcctgatattcacaactgagtcaatgaatgagtaaataaatgaggggggaagacacctcttcctaacagaattccatttaatgcaggtaggaagtagaacaaccaccctttagtaaacaacacagcaataattgctgtaggaaaaagtcatcagtgaacaataaaattatgagtaaaaatataatgagcaacagaatatttacatagtgtctccctataagacagtcatttattccagccagggcaaaatggcaaaaccttgtcactacaaaaaacataaaaatgtgccaggcatggtggcacatgcctgtgatcccagctacttgggaggctgagagatgggaggatagctgagccagggaggtgaaggctggagtggtgattgcgacactgcactccagcctgggtgacaaagtgagaccctatctctaaataaataaataaataaataaataaataaataaataaatattgtcagttattacaaagggaaaaatgctaattttacagaggagaaagctgtcaggcaccaccttaaccaagggaacaaacctatcatcactattagaaagacaagtcaaaatcatgaaccccctgtggtgtagagaagggtacagtatcttctgtggcattcctgtaaaacaatgcgtaacctctaataatgagaaaacaccaatttgtggaacgctatacaaaataactgaccagaaatcttgtatccaagtaatgaaatacaaaaactgagaactctcacatattgaaggacatttagagatgcaaaaactaaaagcaatgatagattctggacaacagaaaggacattaataagaaaactaataatacagaaattcaaataaagtatgtctattactttgtataagttcaatgttaatttcaatgttaatttcgtggttctgataattaacgattattgtgacaagatgtgttaagattagagaaagctccgtacggagactctgtactactatttcaacacacacacactctctctttctttctgacacaatctcgctgttgaccaggctggaatgcagtggcacaatcttggctcattgcaacctctgcctcctgggttcaagtgattcttgtgcctcagcctcccgagtagctgggattacaggcgcacaccaccacacctggctaatttttgtatttttagtagagacggggtttcaccatgttggccaggctggtctcaaatttctgtcctcaggtgatctgcccacctctgcctcccaaagtgctgggattttaggtcaccgtgcccagcctaaaatcatattttaaaagaatgaagaaaaaatgtatctagcattaataaaacaaacttcattcatacataaatctgtacagtctacaggttcctatcagttacagtactcacttaagataaatatagaatccattctgaattggccaaaatatccaacactccatcacagaaaagtatttgcagttacctgataatgccaggctctttcaagcctatgctgcattacacattactccctacaccatgcttcagcaagtccataagactcagaaaaaagtccatccttccctaggaaactacctttactgactccctccagcactcccattttatgcttgttggaagaacaagaagcactcaagaaaagatagatacctggttctacttagtctttcagacacaaagtgcagtctggaacaatgacaattagcttttactaactttcattatctatcaaacattgttaaaagcaaattataaattttaaattaactttgtaagaaggctagaaatcaggtagtaggaggagagtgtgactcctccaatttggttcttgtttttaaaaattgttttggctactggccaggtgcagtggctcacgcctgtaatcccagcactttgggaggccgaggcaggcggatcacttgaggtcaggagttcaagactagcctggccaacatggtgaaacccccgtctccactaaaaatacaaaaactagctgggtgtggtggcacacgcctgtaatcccagctactcgggaggctgaggcagaagaatcacttgaacccaggaggtggaggttgcagtgagcccagatcacaccacagaactccagcccgagtgacagggagagacttcatctcaaaaaaaaaaaaaaaaaaaattgttttggctcttgaaaatacttaacatttccatacatacttgaaaatcaatgttcaattgttaccaaaaacaacacaacataaaccaaaaaatcttgctgggatttttcactgggtttgcattgaatcattgtgtctaacattgactcttctaacacataaatacagcatacatctccgttcacttatgtaatctttttcagaagttttatggtttcagcaataaagtcattaacgtcttttgttagatttattcctaagtattttatgtttcttgatactaccgcaaatggaactgtttctccgggttatttttcagttgtttgctctaataaataaaaatagaattgacttttatatattgaccccgtacctggagaccttggctaaatctctaattctcacaggtttagggaattccatggggtttctaagtatcatatcttcaaatacaagcagttttgccctaccttttccaatttccatgcctttaattgcttttttcttgcaatattgcattagccaagacagagtacaatgtttttgtttgtttgaggcagggtctcaccccgtcgcccaggctcaagtacagtagcatgatctcagctcagtgcaacctccaccacctgggctcaagcaattctcccacctcagcttccagagtagtgaggactacaggtgcacgcccccacaccaggctcatttttgtatttttttgtagagatggggtttcgtcaggttgctggagctggtcttgaactctgaggctcaagcgacccgcccaccttggcctcccagagtgctgggattacaggcatgagccactgtgcccagcttacaatatttttaggatatatttttttcctaattgtagaccaacaaaacaagcactttcaccaagtagtgtgatgttaggcgttaggtttttttcctaatttttaaacagcatcacagctcaggaataaggtcttcacctttgattttcacgatttttactacaatgttgtgattctcatggttattattcttgaagtttcatgatttttttattttatttttgagacggagtctcactctgttgcccaggctgcagtgcagtgccatgatctcggctcactgcaacctctgtctcctgagttcaagcgattctcctgcttcagcctcccgagtagctgggattacaggtgtctgccaccacgcttggataatttttgtatttttagtagagatagggtttcaccatgttggccagactggtctcaaacttctgacctcaggtgatccacccacctcggcctcccaaagtactgggattacaggcatgagccaccgtgctcggcctaaagtttcatacatttgtaaactgactgtttaaattcaaaaatccagtcattaagttcctcaatttttttccatctttttttttctttttcctcatgactaagaatcatattctcatgtttattcatatgtatggtaattttctattatatacagacaatgtatgcaatacattatagagactctgaatttagttagcttttcctaaagagtgttgatttttgttctagcaggcatactactactacctggttaccttcattttgtggagctagttttgtttttataaaagcatagtggagtctattttggttccctccttaatcctatggtgaatgccttcgtcctgggaaacattctttaactctttaagtgtgagcctttattggtttcaatcaaagccctcaggtttttgccaagtctagttggaattcgaactccaaattctgccttccctgcattaggcaatgatgatcttctctgctcagctctttcagccttccaattactgctttccactatgccctataaaatcttccctaaacatgtgcaggtcaggggtgagcacaaagatctgaaaggggctcaaatagattgtgggcctatgcccctccccatctcccatagctccctctttgccactattcccctccttcaatttctacctaacttggcagccctgaactccatcctctgataatatacaaacaagcccatgaagcagtgactattgaattctagaagctctggggcacatggactgagaatgctctcatctcttcctggcaatactttctgtctgaaattttgctgacattgttgagtaatttacctagtaatatgcacaggttccaagcttgcccttctttgctcattactttttcttaagcaggggaaagcaagcttctatttgaagagagagaatgagaaggtggggaagataagaggcatgtttcaatacactagagaacaactctcaaccgctttttacatgctctctttccaagggcacaccctctttgttcaaaaggagtcttaaatttcacagaagcatttatctgtacacacgacttatcggcagctaccaagctagaggcccgttaagttttctctccctcagctagccttacacctttaaaactgcctttgagtcagaagtcagaatgaagaggttaaaataaaaaaagaggcatttttctaggcattcctccttaggtcttccctttctctaacccactactctgtggtataaaaacagtacccacttccctaacccagaaaatattccttgatttgctccatgactcaaaaaaggttcacccatgaattcagtctccagttcttttgctcataggttgggtccttttagaacaacttagttcaataatatctgtactgtattcaagacccaagcagatatatactggttctgtcaataaacaatcatcctgtttggaaataaagcaaaaagactatgtatccttgcagtgtaccactgggacattacctaacaagcccacccaggaaacatctgactctccataaattatttaactttgttttacctactatctataattgattagggcccagaagtcttactggatgtttattttagaacgctgacaagttaaagttggtttgcatcttgttgaaaacaatgtccaaagttacagctttattgttctataggatattaataacttttgtatgctactgagtaatcatattcctgcattcttcctttttatctggtattaaaatactgttaacagtttggccaccatcatgattcccttgttattcagtaaatcactatatatttaggaattatgtctaggctggtgcagtggttcacacctgtaatcccagcagttttggaggccaaggccagcggattgcttgtgctgaggagtttgagaccagcctgggcaacttggtaaaaccccatctctacaaacaatacaaaaattagccagacatggtggcacatgcctgtagtcccagctacttgggaagctgaggtgggaggatcacttgaacctgagaggtagaggctgcagtgagccaaggtcgcaccactgcactccagcctgggtgacagaataagaccctgtctaaaaagatggaaagaaagagagaaaaagaagagagaggggagagagagacagagagagagagaaagaaaaagaaaagaattatatctaatgttttgaaactatattttgacaattctaaagacgctgatttttttgttaattccagctgagtttcagaaatgagaataaaaaaattaaacataacagaaaatacctctgacattattatttttaaactacaagtcttcaaatatatttttgggtaataaacaagcacagtccaggagtttgaggctgaagtgagctatgattgtgcgattacactccagcctgggtgacagagcaagagcctgtcttaaaaaaaaaaaaaaaaaaaaaaaaggaataaatacacctacctccatttggggaaaaaattaacaaaatggaaaacaggctggttacatgtgggtatgaaaacctacagttgccctctgtcccgggcaacctaatttttttttttaagcaaaactgagaaaagtcactttcctaaaatttaaaacaaaacaaaacaaaaaaacctggggaacaaacaagcaaagttaaatactgccttcttatacagaaaaactttgcctggcaattgacatacgcacagctttgcaaatatttggcattttaaaaatttaagtcaatagcttttaagaaacatatgctctgcgcccattctactaataataaacaatggaaatgtattgtccctgctccccccaccccaccccccaacccctgtcttctcttaatactttctgaacgcttttcagaaagcatggatatattcataaagggtagataattcacgaaaacagggaaggggtaatctctccttgacaaaatagtgacagtgtatacttagttgttttcattatttattttactcaatccaaaaagcattctattgcacaatgttgaaactagtatggccaacacaaagggaaagatggtcttgaccttcaagaatcttacaatttaatacacacacaggaatcttacaatttaacacacaagtaaatgaatgaagggtagggaaaggaccaagctcctaaagagtgtgtgtgtacaagtgaatctgtataaactgtctcacaatcactgtggattttttaagacaatgaggattagtaacacaatggaggactgttatgccctgtccttcagaagtgctgaggtaagagaaaacatgactacagggagattactcaaaaaagtttggaatccctaaattctatatacaaatatataagtatctacatagaacttactcccctatcacatatgcctcatgtttcatgtttcctgtacccataccaccaatgtatctatgtttcctttctcacttaacaatttttaccctgattagaccattcactaaaagtttcattaataacttaaaaaagatctgtaaacagcatgcaatgaacttatattatagacttaaatagtggcaaaacttggcattctgctctttaatttattcaaaactactttccagttaagaactatcaatcttctagtgtcttcacatttatctctagcaacagtggctggctttcaaaattaggtgagagatctttccaagatctaaacatctccaatatctgcctcagagaaaatttagtttccaccacatcatgcgttcctgctaacaatgattaaaataaataaaagaactataaggttggtttatttgcggatacaagaacagcttgcttaactcaccatttaaaaagccatcacttcacactagctttattatctgaagcataatcaaaataataaactacggttgtgggactttggaatttctaattaagttatggagacttaaatcaagaaatatgaatattcataaaacccagtaaccttttaggcaaagtaaaaaagtgaaaagaacaagtgctcttggaattcagaaagaaaattaactatggtattgagagaaaccaggaaagagaaggaatcacagtagagctaggatacagaaggaaacagaaaatgacagtttaatgctcattatagaataacagtgaatcacccacagagaccattttcagtgttcttgtgaatttaacctctagtctaaccttttaatgaaaaggctataatatattagagtggcccagaaaggtgaccttatgtctcaggtgtcagagccacacccaggtctcctgattcccaatgatactccctaaagccttacttgctctggctgtagtgttttgagaattggagctgcttttaatcctatggtcagctacacagctgcaggatgggccctagattccctattcaggaattcagatcttaaaacaccaaaagtgataaaagtagatacagttccccttcttcagccaatgcaaggatcctagttacagagaaaaaacggtgtgccaagacaacacccttaattctcacgcatttccccctttctatcttttatacttaccaatttatcagtcccatgatctgtcttcacctcagaactaagtggaagaaataagtctgttgtatgctctgggggaggtacctccccaagaactatcaacccctgcaggatagagaggagaaaaatagcataagtgagcagtataaacttcaaatttaatttaggagttaagtctcaaaaggactgttggtgtactagaggccccctcttcctcaccctatggttcagaaacaaactacagcagcagcagctttgttttcccaaagagctatttcaacaagcagcagacccaggctcccctctctgccacttgactgctctgacctacatggctcatcagccatttagcatctttattcatatctttcagatatgaaatctttaccagattatggcatttataccatattactagactccactagattaacagcagcaatgcagtttttgtagccaacaaatgcagtttatgacttactaagctgaaaatgctactattcttaatcatgtactccaccaactatacctgcacaaacaaaactgaatgaaacaaatgtggaacagtcccctacaatttatgagaaaccaagagcttcttaaaagctggcccaaaggaacctgcttttttcataagcataaatattacttcagattaagttcctgcttgacaatttcaaattcagacctttggaaattcattccaggaaacaatttacataaaaagaaattaaaaatgaacccacaagtcctccccattgtacatataatgagccaggatgggtaaaggcagaaggtatcttattattaaaaaaacaaaatactacatatgaatcccaccatgtataccagaagaggtgacaaaaataaggctatgacactatataaccgaaagactgggatgcaagtgatcagggttcccaatctctttctctggtctaaaaaatagagatctaactagattaagaagctcttaatggaaatttattatcagaatcacctggggaaccttatcaaactatactggcttaggtccaacatctactcagtacctctgggggtggggccaggtagtctacctttttatgggggaagggaggcaggacatggtgggtacatggaggtgggtgtctctctcctcccccaccccgccaaccccactatgttaccgaggctgatctcaaactcctgggctccagcaatcctcccacctcagcctctggagtagctgggatgacaggtgcctaccaccatgcccagaggtggatattctactattctttaaaagctcccctggtaagtcctaaacttgtaaagttgaaaaacactagacttgattagtttgggctcaaagaacatcctaaagtatagatttgggggactagggattgtgactattagtcttagctctctaggccatacgacagactcttatgagccactaaaccagatgatccatccctggggtccttgtaactaaaaaaccaatatgaaatacaagctgcagaaaaggggaaaacattaagaaagaaaaatggaattttatttcagtttttaaaaaagaagtatgtatctctttttctcttgaagcaaaagaagcactgcctccctattctggaatatgactacacttagcctgtatcaaaaatgaattggagggtcccggaatggcggctcacacctgtaatcccagcactttgggaagctgaggcgggtggatcacctgaggtcgtcaggagttcaagatcagcctggccaacatggtgaaaccccatctctactaaaaatacaaaaattgcccaggcgtcgtggcacatgcccatagtcccagctactcggaaggctgaagaaggagaatcgcttgaactcaggaggcagaggttgcaatgagccaagatcacaccattgcacaccagcctgggcgacagaccaaggctctatctccaacaacaacaacaacaacaacaaaaatgaattggaggctgggtgtggtagatcacacctgtaatcctagcacttggggaggttgaggttaggagtgcgagaccagcctggccgacacagtgaaacaacgtctccagtaaaaatacaaaaaatagctgggcgtggtggtgagcccctgtaatcccagctacttgggaggctgaggcaggagaatcgcttgaacctgggaggtgtaggttgcagtgagccaagactgtgccattgcactccagtctgggcaacgagagcgaaactccacctcaaaattttaaaaattaaaaaaaaaaaaaaaaaaaaaaaaaagaattggagtctcctcagaaacaagagaaaggccattaactagtaagcaagaaacattaaccctagcctttaaaatgaggtttctctggttaaagaacttctgcttcaaaatattttcttccctaaatcaaaagcataaaatataccttacaaactttatcacatccaaataaaaactatttgcaaaagacagttatcttgtacaccactgccttctcaaaacgttgtattcaacagatattccctacttaagggcccaaactgtcttcctgcttcctgtacaaagcatgccaaaaatcattttattattcaaattttcccataaccggttcctaagaacttttttaaagatcaatttccaactactttccccaaatatttgttagtgttataccaatctcatcatctcctagacaaatgtttcaatgaatgtgaagctgttgctgctgctggaggtaagggttattagtcagtagaaggttaaaaaaaactgaattaaaggttaacacatgagctgttcatctttatttatactcatttttatattttatcagtccaaattgccgttcgtccttccaaagagattttcaacaagtcccacctccttccaagaaaatgtcccgggttaatgagttcctacttgctttatccacactgccagacctcctaaagcacggtgattgtatcttactttctgtgtatttaaatctcatttccagagcattcataatcttatgccacattatttatttcacttattattgcctcagtttcttgtttgttgagacagggtcaagctctgtcacctgtgctggagtgcagtggtgtggtcacgaatcactgtaacctccccctcccgggctcaagtgatcctcccacctcaaccccataaatagctgggataacaggtgcatgccaccacatccagctaatttttgtatttttttggtagagatggggtttcaccaagttgctcaggctggtctcgaactcttggactcaagtaatgcacttgcctcaaactcccaaagtgctgggataacaggtgcaagccaccacacccagctaattgttctattttttggtagagatggactttcaccatgttgccaaggctcgtctcaaactcctagactcaagcaatccacctgcctcggcctctcaaagtgctgggattacatgtgcaagccgctgcacccagcctttaattgttaactaatgttagtttattgaagatgtggacaaaatacaaatatatttaaatgacccatgtcccttagcagagtcatacaccaagaaaataaatgcatagcaaatatttgttgagttgtataatttttttcctaacaggaaaatattaactttataataattatagccagaagataaataaatctaacaattagatataaaattactccttcaatttttctttttcagttatatgaaagtaaggacgcagtcagtattttccaaagggaagaatttttccttaaactacagaataatttctaaatacaaccctcagatagattatgaagacatctcctaagagagtataataaaacttggtagggaccatctattcatcgacataattttatagacccacagaggatgtaggtcaaagcttatgtctctacaggccaatacatggcagaactggggcaaaagtctgcatctaactaatatttcattcctcttttgttcagttaattcaatcatttatccgctcatcagcatttgttaggtactaaggatacaagaaaaaatgagagacctatccctctcccctaacccatccttcaaagtgcttattacgttctaatactgcggcaaagaaaaacaatgtaaataggtaaatgttatgtactacattagaaggtattaaatgctagagagaacaaaatataggatagtgaggggattaagaagtggaaatggtggggttggtcgtgacggctcatgcctgtaattccagcactttgggaagccaatggaggaggactgcttgaggccaggagttcaggaccagcctgggcgacgtggcaaaaccctgtctccacaaaaacaataataataaaaattagcctggtgtaatatcacacctgtagttccagatattcaggaggatcacttaagcccaggagagagagagagatacaagtgggagggggtactacaggcgcataccaccacgcctggctagttttttgtatttttagtagagaaggggtttcaccatgttgccaaggctggttgcaaactcttggggccaagagatctacccgccctggcctcccaaagtgccgggttgcaggcatgagccactgtgcccctgcttgaatgtttatttgaagacagaatcaaccagctatgccaatgtgcttacaagataggagggaaaagagtcagagacactgccaaggtttctagcttccacaaccagaagaatggaactcttcttcatttgttcagaggacatttgaatacacattagttttaattaaacctatttttgaaaatatgtgctcaagtgttacactgaagcaaccaacaatcatccatacactgtccattgcccccaagatatgtaagttcactatggcattcaaaaccaaacactggatcctctaatttaatactgtacctcacaccaaaaaggatgaaaacagctaaaaagaggctgagcaaataaaaagcatccaagtaggtaagagtcattcatgcaggtagcatctattgagtggctaccacgtgcaaggtagtgtgaaaacacagtaataaaataaaaacagattctaccataaggagcttatgttcatctagccttgaacagacaaagagacaaagtattatgacagtactataacagaagttgagagaaggtgatgtcagagcagaaaagagcctaactgaagagactgatgaaagtgaggctttacagaggaggtctacataattacttaacattccccaaaatatatttaatatattttgagctatacttattcattaactatacacttaatgactttgcccttttctgtatacaatgtttcatatgccacaataacacttatttcggataaagtttactcatgtttaataaccatgaaaagaaaggttagcattagctgagaaaacttcataatgttctactccacacctgtcatgctaccccaacatgggcttccctaacattccaggtttaaactgggtcagtgttgaatagctgtgccattagcctggtggcaataaacttagggctgctgtactatgaaatagcaaccggtagaagccgaagaaaaaggtcaagagtctccttttccttcgccatgtcccgagtcagagccaggatcatgcttaggctgcacaggcctagaaaactccaagagtgaagcaagcttctgctttacacaaggaccaaaggaactggaatgggtcacagttacatgcagccttaatacctcctaagtgactcctctgtggatgaaccctctctcaactgtatttgcaatacagctaacaggcaatttcacatacttccttacatcactctatcaggtcaatcttccctatgcatctcaagacaaaccagtgaccccactgcagaccagttccacaagaatcaccctgggctacctggaaaagataagttgtctaaagtgctttaaaaaaccctattaagatgagaacttcaacagctttatgaaaattttgaagagaaaggtgttataagcttctgcagttcccattcaactccttccctattcaaaagtttcaatgctcttccacctcccatcctcaataacatttccatcctcagctacagctgtgtaatctcaaagagtagtcagaagaggagattttaaaaaacaacgtaagagtcaagccagtgcttctgggaggccaaggcaaggaggatcacttgaggtcaagagtttgagaccagcctggacaacacagcgagaccccatcctttaaaataaaaaaaaccctttaacaattagctaagcatggtgggacttgcctatggtcccagctacttgtacttgcaaggctaaggtaggaggatagcttgagcccaggagtttcaggttacaaagaactatgatctggccattgcacctcagcctgggcaacagagcaagaccctgcctcttaaaaactgcttagtccctattctttcccctcatttaccaggtgtgaaatttcaacaaacatgtttcagtgaaatgatgaaaaggacacaacagcaaagtatgttagaaaaaaaatgctttggaatcagataaaaagtcctgagtttaaatttagctctgccttttacaagcctctgaagatttattctgatcattaaacgaacatacatgagtaaacctttaattagtatacactcaaggtacgtatattgttttcgtttctccttctaaagcatggaagagtttctttttaaaaaacaagctgacaaactatgaaaattaaaagagtacaacagcatgcagaagtagtacagaggagttcctagaagttatattctttctccagagagcaatattattcccaaaagggactctactcacttcacagcttggaaggtaatacctaccttctgacagaacagaaactggtgtctggatcctagaatcacctagcagtagtcacaaatactttttttttttttggtaatacgccacttaaataaaattaatgttaataagcaacaaagtaaatccttaaaaagaaaagccccaccatccctccaatctcccacccgaagacaaattataactcaacagcctatcaccaagattcagcctatcacctaggttcatctcaaaaaaaaaaaaaagacctgtgcaacccaggaagtgctgggaaatcttggtgcagcatggaaaatatgaacaccaacccacttaaccaaaacacataggaaaaactttcttccatttcagtaactaaaaaaaaaacccaagcacttaaagtgattactaacttgagcaatagctctgcactcacttggatgtgtaaccatgaacaaactacttgactgctctgatcttccattgtttatcttgaaaatcgtgaatgagagtaaaatgcttagcacagtgcctgacatatcacaagtgctcaaaaacttctattaattatagtgttacataaagactaaatgcatgtgaatatatcattgggggaaaattccatggcttgttagagcaagttgaatattgtctcttccaaatttatgttcacccagaacctgtgactatgaccttgtttagaaaaagggtctttgcagatgtaatcaagttatgaagagccatttagtgtgggctctaaattcaatatgactggtgtcctcctgacatggaaatctacacagatgcaaagagaaagatggtcatatgaagatggaggcagcaactgcagtgatgtagctacaggccaagaacaccaaggactagcacaatatcagaagctggaaaaagacaaggaaggattcttccctagagcctccatagagaccatggcccttttgacaccataatttcagacttctggcctccagaacggtgagagaacacatttctgattttttaagccatcccatttgtgatagtttgttatgacagtctaggaaactaatccatttgttgaaaaagaaatgtataaatacgacacgtaaagctgtgaattttcttgatgcattacttattggaactatcaacctagttttattcttcctatcggaactctgagaagtaaaagattatctatgatgttgtattttacagaccaagaatctgaagctcagaaatgttaagtgacttttcttctcaaggttcatgtaagcagctggtagcaaagccacgattagaaacaaaaatttaccaagtccaagtatggtgcttaatacaatacgctttgaatgatgaaactcttggataagcaacatacattcatgtgccaaatagcattatggtcaatgacagaccacatatacaatgatggtcttataagattttaatacagctgaagaatacctgttttagcacaaagcactactcctgtgtttgtggtgatgctggtgtaaagaaacctacagtgctgctattagaagtataccacatacaattatgtacactaagaatataatagctgataataaaagctatgttactgttacacttatttcttatgataataaaaagtgttatgtatttactatactatacttttaatcgttattttagagagtacttctactcattaaaagaagtgaactgtgaaacagcctccagcaggtccttctgttggcactgtcacaggcaatgaaagctccgtgtgtgttgttggccctgaaaacctaacagtgtaacaagatgtgaaggtggaagacagtaataccgacaaacctgaccccatgtgggcctacgttcatgtgtgtgtttgtgtcttagtttttagcaaaacagtttaaaaaataaaactttcattttaaaatggaaagttttaaagatagaaaaaagcttgtagaataaggtgtgaagaaaatatttttgtacaattacaatgtatttgtgttttaggctaagtgttattacaaaagagtcaaaaagttttaaaaacttaaaagtttataaagcaaaaagttatagtaagctaaggttaatttattattgaaaaaaatatttaaaataaatgtagtgtagcctcggtgtacagtatttataaagtttatagtagtgtacagtcatgtcccaggcttttcaatttcagttacccttcacccaccgactcacccagagcaacttccagtcctgcaagctccattcatggtaagtgccctatacaggtgtaccatttttatcttttctactacatttttactgtattttttctatgtttaggtatgtttaaatacataaatctttaccactaattgcctacagtattcagtatagtagcatgatgtactggtttataccctaggagcaataggctatataccatattgtctaagtgaatagcaggccataccacctcagcttgtatgtattaagtatgtatatatgtaagtatgtatgtatgtatgtatatgagacagagactcgctctgctttgcccaggctggagtgcagtgtcgcgatctcagctcactgcaccctgtctcccaggttcaagtgattctcctgtctcagcctcccgagtagctgggattacaggcacccgccaccacacctggctaatttttttgtatttttcatagagacaggggtttcaccatgttggccaggctagtctcgaactcctcacctcaggtgacccacccaccttggactcccatgcctcggcctcccaaagtgctgagattacaggcgtgagccactgcgcacggccctcagcttgaatttaagtgcactttatgatgttcacgcaccaatgaaatcacctaacaacacatttctcagtttcccttttgttaagcaatgtgtgatggtatatacaaaactccagattattttccagatatttagaaatacttttcagatattttgatattttgaaagtttctgaaaattgctctgtcattacttctgagtgatgagctgaagaataaagcatgaaccaaatgaggtgagtatcttcttatacacagctagtgagactataaactgacactgccaaaatacttctctgaagaatgcattaagaacataaaagagcattcatacctttgactgagataaagatatttatcatggcatatttaatttaaataacaaatgtaacttaaatagtcaacaaagaaagccaatagcatgcagccattaaaaatgttttccaaaaaccaactgggaaatattcagggcacatacgtaacatgactgtatttgaacaaattacttatgtgctaggaaaatgtaccataatgttggtagcgagataattttgagctgttgggttgttttttttttttttggggggggggggagggtgggtgtcttttatacttctatgtcatttcagtttcctgagaattgatacacagtatttcatcaattctaagaggtactctccccacatgtcaacaacttttaaatcaagatgcattttacaatttctgttatgccctggtttaactgaaataatttctttgtcgtacttaaaacaatggtacatcttacaatcaatagcatcttaagttctatgaaatgtagcagttttataacaaggaactaagatgatataacatatacacatatataaacccacatatatatttatgaatgtatataaaaagatgaagcagcacttatgactactattatactaatctcagttgttactaagagactctagttctcaaatatagaaaatcccacttaactactggctataaaaacctagaaacagacactgaagaggtgtctctgatagagaaagactgtgtttttctcctcagtacaggcatatccagtcacctcctagttattcttagtcatcattccagttcaagttctacaaatctcactttaaaatttcctttgtgaagacttgggaaagcaaaatatgcaccaaatctagaatgtttattagttttgttccagctaatttttaaataagtaaatcaggatttaatttgtatgctaccctaagggaacaaactagtaagaataaaaaagtgagccctctggactgtgtcctcaattaaagtatgctctattgaacttttagggggagggggaatatatatatatatatgtatctccaatctggaaagaagctataagtccgcagtgacatttttagaataaaagtttaaatgattagatagcccacagaactttcacttcaaaccctgatcattctgttcattttatcagttgatcaaccttcaacttttggcctactaatttaatggatactgttcacaggaaagccattttcttaaggctttgactagtactaaggtcaaaaaggcattttgacccttatttttagtagcaatagactttttctagacatgggtctacataaagatagagctcagccacaccaagctaatataaaaaatactttgcaagaatgtaagcttcatgaaggtaggatttttgagaacactgctgagacacagtaagcacttaaaataatggtacatcttaccatcagtagcatcttaagttctatgaaatgtggcagttttataacagggaactaacaaatataaatctaacaaatatgacagttaacatcaatggcttgcttgcattattcagtctgttttccttgtttcctgttagctcagatacccacacagttttgttctaaatacacgttcagttaaacattatattctaatagtgttttcctttttatgagacaggcctttcttagttgtccaggctggagtgtggtggcacaatcttggctcactgcaacctccacttcgtgggctcaagcgatactcccacttcagcctcctaagtagctgggactacaggcacatgctatcatgctcaactaatttttgtaatttttgtaaagacaaggtctcactatgttgcccaggctggtctcgaactcctgagctcaaatgatcctcctgccttggcctcccaaagtgctgggatcacaagagtgagccaccacgcgcagccacatcaggttcttaaattaaaccactatatcaggtcattaaaccatttactttgcaatagttaagaagagggttatgggggttacgaggtgggaggggatgtgagaaaagcgatattgatagttttcggcagcatttaaaaacatcagatacttatcccttaccttattagcacgtatctgtttgtaaatgtctgtttgctgacgaattcgatattccaagtcagaaacatgagcctgaagccagttccagcggctgacaatagctgcccggtctgcagcccatttccattctgacctgcgtctcctaaaaggaaataaactgagtgaaatccaagagtagcagtaatatctataccagattggggggtggggagtggaatttaacttttaaaggcccttgcagagactaactctagtgtcaagaaaaacccaagagagagacaagacacctcccgctcatcaggatgcacatggatataaacttccaaataggtatttcccaaattaagtggaactgcgttctagcatcctgatcctgtggcacacagtttctctgaaatccctttaatttctctgggacaataaaattattgtccatgccaaaataaaacatacattaagaataatctatacaggaaatccaactgacactaagaattattaaaactaataaagaattcagcaaaagtgttcagtaaagaatatttaaaaactaataaagtagaaaatatcattaagtaccattcataacaccaacaaaactaatgatatattaaatatctttacagagaaaataacgcctgaaagcatgaagatctatacaaatggtaggacacatttttttaggatggcgattctcatgaacatctataaattcaaagaaattccaatcaaattgcctacagtatttttaataaaagctgagaaacagatctaaaagttcacatggaataaaggaccaacagcaagaaatttgcaagaaggcatgatgcaaatacacattaccagacagccagatttgctgcaaaactatagagagcctcaaaacgtagaactagatacataaaagataacgggaaatttttaaaaaatcagatcagtgcagaaacgatcaaactactcaataaatagtactaaactggccagttctttaaaggaaaaagtaaaattagttcccttcttcatgatataattacaaaattttggcatttcaaattgctaaatatgaacagccaaacttaaaagaatatcttcgggacttagagcagggagcatttcttagataatacacaaagatttcacctacttttcaacatacaatagaaaatctaataaagttaaaaggccaactacattttggtggaagatatctaacacatataactgacgattaaacatcagaatatgtaacagaactctcagaaataggataaaagaaaaaaagacaatcttaacagaaataggaaattcacataaaaggcaaataataaatatataaaaatgtgtcatctcgttaaaatttggttaaaatataaatattaggtaaaacattaagatgctgtttgaaatctggatgggaaaacgcacagtctcataaagccaacaggtggtgagaaatggaaaagagcaattaatatattgctggtaacagttaaaattggaaccaccatttttgaaaaataatttgaaaatacttagcgaggtgtaaaatgtgcatacccaaccatcatgatactgtattttttttttttttttcctgagaggcagggtctcacactctatcattgaggctggattgtggtggtgcaatcacagctcactgtaacctagagttcctttgcttaagctatcctcccacctcagtctcccaagcagctaggatcaggagcatactacatacctggcttttttttctttttttttttttttttgagatggagtttctttcactctggttgcccaggctggagtgcaatggcgcaatcttggctcaccaccaaccttcgcctcccaggttcaagcgattctcctgcctcagcctcccgagcagctgggattacaggcatgcgccaccatgcccggctaattttgtatttttagtagacacggggtttctccatgttggtcaggctggtctcaaactcccaacctcaggggatccgcccacctcgacctcccaaagtgctgggattacaggcacgagccactgcacccagccctgactaacttttttttgagacggagtcttgctctgtcgcccgggctggagtccagtggcatgatctcggctcactgcaagctccgcctcccgggtttacgccattctcctgcctcagcctccggagtaactgggactacaggcgcccaccaccacgcctggctaatttttgtatttttagtagagacggggtttcactgtgttagccaggatggtctcgatctcctgacctcatgatccacccacctcagcctcccaaagtgctgggattacaggcgtgagccactgagcctagccccactggctaatttttaataaaaaatgttgtggagatggggtcttgctatggtgtccaggttgttctctaactcctgacctttagcctcccaaagacacgagccactatgcccagccatgaaattctgtttctgagaacataaactacacattcctctgcataaggaaacaggttcactggaggagagtctgtaatagataaaaactaattatattctaattctgctgaacttggtaaataaactataatttattcatttaatagttctatagtaataaaaataaacgacatctgtatgtatcaacatgattaaatctaagaacacaatgttgaatgaaacaactacaaaaaaactaaacaagattaagtacacacaagtagtgaaggaatttgatgaaatactatctagcaatttatttactgtatgtatcaacatgacctaatctcaacaatggggaatgcaaaagctgcacaaaaataaacaaataaacattaataaggattgttaccaatacagataactgatgaatatattttaaaatgcctaaaactgacatacaacaaatttacaatcaagctcctcattatctctggaaaggggatggagaagttggattttagctctacctataatgtttgacttctcatgtaaaaaaacaaagatggaaatgtgacaacattaacattgtttaaatattacactggggatacatggtgtctactatattctgtaatctaaatatttcataatctaccacaaaactattttcccagaaagcagcagcagtcacacagccctcagccccacttcccatcaggatacacacactcactgctaaaacttatgactataggtgaacttgaacacagtctcccataggggcaaaatacaaaatgtcaaaaataaaaaagaacaaatctgaccacgacagagtaagacatgaattaatacttaatcataccataataattaagaccaagggtagtaatggtattttaacttttgtatggaccaaacataaaccattcaaaccaaccactgtgataattatcaattatgtctcttcttttagaaagaaaacattttacagttccctaattttgatggaaccacttcaagataaaaagatacttttaaagtacagttatctgcttcaatgttggctgcaggtctagctctaccctaaatccaggaaatgatctcaagagatcaataagaaactagggatcattcttgaacaacaaaaatgccccctacccacaaagagacaaaactagttaaccctcgtattttattcccacctttccttacttttcaaggcttaccacctttctatcctgcaaaatcttttggatttatagattcctttcattcctaaaactaccaccacaccaggtccccatctatcaccactgggcaaccccaacagcctccttagctgctcttcccaacaccagtcaatcatactacttttcctcaatcaactcccctcacacctttttcatcctggcattctaatgtttaaggaaccatgcagctcctttgaaaatacaaaaggaaaagaaaattacttaaaacattttagttcgcaagaactttgataaatacactttttcttggatattaatgaaggtcttatgtcccctacacaggtatttacctaaataacaatacaaagcgagcctcctgataatatgttttggataatatggttaataaactaattaaagaaaggcaagacagcactaaggaatactaacaattcccaatttatgaacaagtttcattttacaagtgtatctgtgatgtgatggtttagaactcgaagtgatttccaggagaaagttgttacaacattattcttccataatgctgctcaaactctcatcatctccaatgaaaaatggaaaaccacaactcaagcgtccaagaagtatcttgtgttcaaaataccagcaatatgagcagaaagctaaactgttattaagcatgagaggtgtacagttaacaagtctggataagatatgaagatgttaccatactccagtggcagagcagagcaccactaaacagtaacacaagaataagagcttcacatcttttgttccttaacaaatacaagcggccgggcgcggtggctcacgcttgtaatcccagcactttgggaggccgaggcaggcggatcacgaggtcaggagatcgagaccatcctggctaacacggtgaaaccccgtctctactaaaaatacaaaaaaattagccgggcgtgatggcgggcgcctgtagtcccagctactcgggaggctgaggcaggagaatggcgtgaacccggaaggcggagcttgcagtgagccgagattgcgccactgcactctcgcctgggccacagagcgagactccgtctcaaaaaaaaaaaaaacaaaacaaaaaaaaaacaaatacaagctatataaactcagcttatcagaggtaaagatagacttcctcctcaatattcgaagtgtaaatttatcactctgacaatttacagctcaaaacaagggacacacattgaacattagggacatgtttaatgttataccatacagacttcaggaaagaacacaggactaaggttgcagaataatactttaaatacaatgaggacttggtttctaatatagtcattatcaataatgaagaaaatcacgtggattctaacactgatgagtcaactcattcctgatgcttgtttctgtgctattagtgaaataactgttttaactatgtgcctgagtaggacactagaatgccttagaacgtttgattttaccgtgtgctttatcctagtccatacaaaaacatgtactatatatactgtagttatcacctgagtgggaattcttttcaactcgtattttgctcattgcttttataaactttttattggtaaaaatggctttgtcaccatgtgctatacaaaaattcattaaaatgttacatgatgaattactttttggttacctaaatgcagtatcaatatttgcttttgtgacaccacatgaatagtacaccttaatgttaaccagctatgtgctagtattggtttacataagaaatatttgttgtatataaatatttcattagctatgaacttgtactttaatcgttctttttacacagttagactattaccacagagaattgagaatgctctgttgactctaagaacatagatctttcctgtgtttgtttcacactgcttttgagctaggtagtgagtacctgtgaatggttttttgttgttttcttcatgtgactcaacaattttaagacttctcattggtgaaatctatggtgaaaccccatctctactaaaaataaaaaaaattagccagacgtagtcgcgcacgcctgtaatcccagctacataggaggctgaggcaggagaattgcttgaatccaggaggtgacggaggctgccgtgggcccagaccacacgccactgcccttcagcctgtacaacagagtgagactccctctccccaaaaaaaaaaaaaaaaagcgccctctataaacacacttaaaccatacagtaaaagtaattaatttttttccttgcaaattcagggttcagcttacatgttggctaaaaattaatttttgtttttagttctttaaagttattaatagtcaatgggtttaaaagggattatcaatagatcaactcttttgtatttattagataagtagcaccaaaagctagacattgaaccacatggaacaccacatgttgactaccaggcctagtgcctctaattaagtcacctaattctattctaagatgggaaatttgtatgtcaatccagtagaacagggctggtggattatgcttctcttccctgatgtattaacataaatttttttaaatctcattaaggcaacaaacatgccagaaaaacccgaatggtggtaatttcaactttgattctgatttcagtcccatctcgattctttccttttaatgaaacaaaggttctattagccaactaaagtaaaatgactgttcacagtgagctacacagtgctacattcacactggtagataaattgacaaaggattatgtgctacttccaagtgtgcaggaaatcctgagacatctaagttctgaaatctccaggttatttagataacttttaaaaaccaaaagattcaaataaaactgagatcatcccagagcgtacaattgccagattaacagttttcagggtaagagttagggtcactgtggggcaggaatgagaaatcttgaaattgctgagtcacatgaaaaaaacaaaaacaaaaaaccactcacaagtactcactacctagctcaaaagcagtgtgaaacagagggaagatcaggagacaagttctcacttttacttactttatgtgatcctaaacatataaattgacctctgcaaataagaacaacatctgcttcacaaagttgtgatagccatacaatgatgtaatcctaactgcaacctaaaatgtatgtattagataagaataacaatttagtcagctgggcacggtggctcaggcctgtaatcccagcactttgggaggccgaggcaggcagatcacaagataaggagtctgagatcagcctgactaacatagtgaaaccccgtctctactaaaaatacaaaaaaaaattagccgggcttagtagcacgcgcctgtaatcccagctactcaggaggctgaggcaggagaatcgcttgaacccgggaggcagaggttacagtgagtcgagatcgtgccactgctctccagcctgggggacagagcaagactctgtctacaaaaaaaaaaaaaaaaaaaaaaaagaaataacaatttagtcattataaccatggatttaaattccgtatcaaaaaggtacaaaaaaggaagaaaaacagaataagattaaagaaaaacctctcagataaattcaggaaacaagtgttttcagttagcaacaagccatattctgagagtttcttgagctttgaactttagagtcatctaaaagttccactctaaacagaaaaatcaaagtagtctattagaatagacattgcattatcagtgacattaccaccaaatttaaaaagatggaggggataaagcacaaggagaaaaagaagagaaccaaactgtccagagttaaatatcccacattttagttgtaaagtaaaacccaggaaaaaactcggatacatacttcgtcttaacccattctcatctgtcacatgacctaggttgtgtcagctttctacagatatctgtagtaatgtggaacaaatgtaccagagccaatacttttttttttgagatggaatctcgctctgtcacccaggctggagtgcagaggcacgatctcagctcactgcaacctctgcctctcgggttcaagtgattttcctgcctcagcctcctgagtagctgggattacaggtgcctgtcaccatgcctggctaatttttgtgtttttagtagagatggggttttgccgtgttggccaggctggtctcgaactcctgacctcaaatgatccgtctgcctcagcctcccaaagtgctgcagttacaggtgtgagccacagcacccagccccagagccaattctacctaaactgccaattcatcctgacagacccttgaaattgaacacagcacttttgtcttactacttcaactagattacctctaatatttaaatgaaatttgtgtagttttggtagtttatttcagccaagcatttagcccaccatgaactcactctatccttcttccttccatttaacaaatatttaagcaactattagttaccaagaattagactaggttagggatgcaaaaacaagaactgtggctaaagtttacaatttaatggggcagatagatgttaataatcaaataatcatataaaatatacgataagagatcctaactatgtcagatttagactgggggatctagaaagacttgtgatataaatatttaaacagacctccaaagcataaaataggacttggatgcacaaactggtagggcttggggatgtggagcagaagacattaggtggaactgtggtgtgtcacaaagaaacgacatgtatacaatggttatgtggttagaactccaacagtgaacaacgaaaagaattcattcaacttgacaatggatacaggtaggcagggccaggtcacacagaacctggcaatccatgttaatcttataaaacaatataagcaatcctcatctttcctcatgctcttttatttatctcagaccctgtttgaatgaaaatttacaaatacaagctaaaagataataaactcccacaaaaccatcaaccaatttcaactatcaacttttggcgaatcctacctcatctataacatctatctcccatccctatgaattatttttaagccaattcccaacatcacatcatcacctctaaatatttcggtatgtttccaaaatgtaaggtcttttaagaatatataccagtatattttataatctaaaaaacaataattccttaatgttaaatatccagttactggttaaatttcctggattgtctcagttttctccaaatcagagtcaaataagatccacacaattcatttacttaatacatcacaagctcgtaacacgctcctcctcattttctttcctcacaatctgtggaagagacagcactatctgtcctttagaatttcctccattgtggattttactgactgtgcctttaacacaaagcccatacttctaaacttgataatttgacacctctaggctggccgtgctggctcatgcctgtaatctcagcactttgggaggctgaggtgggtagagcatttgagatcaggagttcaagaccagcctgaccaacatggtgaaacactgtctctactaaaaatacaaaaaaattggccaggcgtggtggcctgggcctgtagttccagctgcacgggaggctgaggcaggagaattgcttgaacccaggaggcagaggttgcagtgagccaagatcacgccactgcactctagcctgggcgacagagtgagactctgtctcaaaaataaacaaacaaacaaacaacctttagtagtttgatacatttcattttctgtaggtcagctgataaattttttttgtacattaaatttttacatgtttaagattgagatatgttttaaaatacactcaatcttttaaaaatcatttaaggtactttaaactcctttcaatacccgtcagtcagatttttcatcaaacatggtaaacatatacatattatatactctgcctagcacaataaaagaaatgtaattgtttgtcataccctatgcaaatttccaaccagaaaatacccagaagcatcttctaacactaaaacccacgtctctccaggaaagtttttccttgtgcatcgtacctcacaattcactctttgtcctcttcaagcttagttggatcctcttattttgttatttgtatgtgctattatttccaagtcatgtcatatatataactggtctccaactagattatccatgcctccttatgggaactaccatgtgttttaactgtaagacaatttttaatgatgtctgtgcacatgtagtttacaagtaaatttgcaaaaaatataaacaatatgagagagttttagctgatgccttatcctgtttaattctcaaatgtttatattttaaaaacacttaactgaagtattctaatggaggaaaaaatggcatgacaaagaagtatggaaatggcttacagttcttgactggctgtaggactgaacatggaatttgagcatgaagattttgagcaaaatactaggctacttactgtgtcttttttcttttttttttagacaaagttttgttcttatcgcctaggctggagtgcaatggtgcgatctcggctcactgcaacctccgcttcccaggttcaagcgaatctcctgcctcagcctcccaagtagctgggattacaggtgcccgtcaccacgcctcgctaattttttgtatttttagtagaaacaaggtttcacttggacaggctggtctcaaactcctgacctcaggtgatccacccacctcggcttcccaaagtgctggaattacaggcgtgagcaaccgcacatggcctactgtgtcttctttagagaataagactgttatgtttcaagaataaagcaaatgacaaatagtgaaaggctctcagttattcaaagtactgccattccagagcagctcctccagagtgaattaattttctgtctacttttcttcctttcaaaagttaaactgaggttagaatgttcaaattctgtatgtgatactaatttctctttcaaagagattgcttgaggccgagcatggtggctcaggcctgtaatcccagcactttgggaggctgaggcgggcagatgacttgaggtcaggagttcaagaccagcctgaccaacatggtgaaaccccgtctctactaaaaatacgaaaattagtagggaatgtggtgggtgcctgtaattccagctacttgggaggctgaggcagaagaattacttgaaccctagagacagacgctgcagtgagtgagatcacgccattgcactccagaccaggtgacaagagtgaaaccctgtctcaaaaaaacaaaaacaaaaaaccccaaaatgatcactcgagctcaggacttcgagaccagcctgggcaacaggtgaaaccccatgtctctacaaaaaaatacaaaaattagccgggaatggtggtgcaagcctaaggtcccagctactcagtaggctgaggagggaggatcgcttgagcctgggaggtcaaggctgcagtgagtcgagactgcgccactgtactccagcctgggcagcacagcaagaccttcacacacacacacacacacacacacacacacacacacacacacacacacacacacaccccagaagggtgaaggagcagaaaagtacagtgtattgaggcagggtccccctttcatccctactaccccagtcccacatattccacagggagaacttgcctccggctatctctagaagaatgagagaattttaatactaaatccaacagaaaaacatcttctttctcactttgaaaatacggtttattggaaaagagtatggtgtctggagtcagtgaacactgagttccaaatcctggccccaccacttagctagctattatcattgagcccccagtcagctactgagaaatcaaacaagttccaacgcacaatctccaggaataatgctccaactttagtaagtctaagaattgcctgagagagttaagtctcacgtacctttatgaagaaaaagcctcttagttattatgtaagatatctatgagaccatactttttttgttttgttttgtttttgagatggagtctcgctctttcgcccaggctggagtacagtggtgcgatctcggctcactgcaacctctgcctcacgggttcaagcaattctcctgcctcagcctcccgagtagctgggattacaggcgtccaccaccacacctggctaatttttgtatttttagtagagacggggtttcaccatgttggccaggctggtctcaaactcctgacctcaggtgatctacccacctcggtctcccaaagtgctgggaatacaggtgtgagccaatgcgcccagctgagaccatattttcagaaatagtccttaaagacactgaggtttagcaacagaacccatcttcaagaaaatgagttgaaccaaaaattaatttgttaataaacttaccagttcttaaaaataaatgtggtaaaaaggaacaaaacaaacaaaaaagtgaataaatagaagaaaccctggtacaggcaaggtggtgtagactctattctttctcccagctcatccctgttctaagcacaattataaatcctgcaaataacacaagaggcaatcaaaggaaaactctgaaagatagaaaagggaaggcaaactagttaaaggccccaggactaaaggaacaacacagtgacaaaagcatctaataaacactatccaaccgaaagaaggtaacccaagtttggcatttcctggcttccaagagagcaacaaagagcatctcagacaggctcattccctgcctccatataagggaagtatttccttcaataccagggaagcactgcagcaacagcaagggggatggatcaggaggtctgctaataataggaagccagaggaaacgttattgccccatttctctatttctttttacggcaaatactcattattctaatttgtctcttctcactgtttctttaacacagggtttcaacccactattgcaccaaagctgctggtcaaggtcaccaatgacctccactgtactaaatccaatttccacatttcagtccttaccacccttgatccatcaccagtatccaacaaaggtgattactccctccttcaaatactttctccacttctctttcaagacatactaacctggcttttctattgtctttttgaattccttgtaagactgcatatgcgaaatcactaaatcttctttcctatacttcctttctaggtgatcttacccaaactcatggctttaagtatccaactatgtttctgactcccaaattcctacctcgagctgaaatcgctcccctcaactccagattcctgtttctacctgcctactcaacacttctatttgaatgtctaaaaagtgtctcaaactttacatgatcaaaatgaagttgatactttcccctccccaactcctatatgccatcccaaacctgcttcaactagatggatctgttcaggtcaaaaacctccatgtaatccttaatttcaaccccccaccacctctatctctctcataaacacactcaattggcaaatcttattggcactgtcttcaaatatatccagtattcagccacttcttgccacttcattgttagtactttggttgaatctttctagatgagtccaagagcctctaaatgggcttctagctctcacccttgaccactttcaggatattatcatgaacatagcagccagcctaatattgtataaaaggataagttcgatcatgtcactcctctacccaaaacctagcctagttgtttaccatctctaaaaacccaagtcctgacaacgaccctgtaaggcctcaaacagagagcctctatcacccaatccctgctacctctctggcctcatctcctgttctcctcctggctcattccattccagtcactgctgtttgctgaacatgttaggcaagctgtcacccacaggaccttttatttgctattcctaaagcagatatcctcactttcttcaggtcatttccttacatgacactttattaaggctttcccttaactgtcctataaaattgcaacccctctccaaataccccctacacacctttctttcccgcttcctggctttattaatagaaccttcatgaaaattatttttaattatctatctttcttactgtctgtttcccccactagaatcatatccggaaaacagagatttttgtcttgttcaccataatatctctgggtgcttggaacaatgcctagcaaatggcaggtactcaaatatttgttcaaagggaaggaaggaagcaggaagagagagggaatgagggtaacaggctggaactatgatcctaacttttccttacaaaagattaaaaccaaagtaattccagactgaagctaaccccttttctcatctggtgccaacagacctcataaaactaactctggcctcctcataaaactaactctggcctctaatgctgaaagcgagtcaagcaattatagtccacactcttagtccaagtatacacaaaccagagaaaataaagctatattacaaagtgaaaactactaacaagatatttgagagctcttctttttttggagataggatcttgcactgtcacccgggctgaagggcagtgatgcaatcatagctcactatagcctcaatcacctgagctcaagcaaccactctcacctcagtctctgcagtagctgggacctcagatgtgcaccaccacgcccagctaattttattttttcatagaaatggagcctcacgatgttgcccaggctggtctcaaactcctaggctcaggtgattctcctgcctcagccttccaaaatgttgggattacaggtgtgagccactgcacccagtctaatcccaaccatacacaacttgaatggaaacttgctgagggtactatagatgttccagagtaaaaacgtttccgcttttacacatggtaaaatacaaaattctcacatctcaatttctatgcttttgcaaaccacttactaacagaatcgtgaattatatgatacgtgtaagatagttaagttttattggcagatttcgattctgccacatcaaattgaaaaatattctgtcatgttcatcattatatattatataaatttgcctccctcaaaaaccacacccccaccaaaaaaaaacccttaagaaataatttttaatgacatagacctcaaaggtcgagctagttttcagttaaagaatgactgagggcacaaaggtggacatttttaccatcctaaaaattggaagatatcactcccagggtggctgtgtgatttcaatgacataacatttttaaagtctagcattccattataagtgctcagtaaatgggaagttgctgctgctcttacaagcttctgactaccatacctggttgaactaactcagttaccacaaggtactctatgcccttacatctaatgacaaatatttgttttgaaaaacgtatactccttaaacacacttgagaaacaggaaccagagacccaagtacattttgttctgaatcaaattccagcatgcacagcaaagtgcatgtagaggggtgagagggtgactagggagactgcttcaatgggagattattctgcagtagtgccttaactgtagaacagtgatgatgataaactcatcctaaatttaggactactgacaggaacaagtgaccacagtaactgttcatcttaagtcgtaaaaagctttctggcaatactcatcttcaaaaaaacctagcatgtaggaaaaatcttttatgtgtttgaataagggtaatatagttaaagctaaaggcttagatttttaactggtctaatgagagaaagcacagtagtcatataataagaaggtttatgttttacttcattttactagtgtttcctcatgagaattaagtaacagaaattataggaatcacaaatgaagtgcttactccatgcaaaacactggtctggcacattacagatattaattcacgaaatcctcattaaaaccctgtcaagtgggtattatgatcatcactgccccatttttataataaggaaactaagacaataaggctaagtaacttgtctaaggtcacaccactaacaagcagagccaagacttgacataggtgctctgggccagagtttttgttaacagttggaatatacaaatttacaagtattactgccaaatcaattttctcaaaaataagtcaaagtggaggaaggggggagatgaccctctgaattcactaaggttctgtgaaaagatgctgaaacaaataaaaagagtatttgattgtcaaatatatgctatttagaaatactaatggaaaagaatactgtgggcaagaaaagaatcacaagtatttgtgctgagttctgaaaggagagaaataaggttggggtgggaggtggggaaagcaggtcaagcatggaatagagcatgaataaaaatgcacagtcagaaaagtaaaaagctatgtcctagatacaaagcagtagtaataggtagaaatagtattacaaaaacagcagtgtcactaggtatcaggcactcaatgcataactaaagagaacataaaaataattaaaactatagtgaaacaaataacaagaacatgtcatattcctggttgtgataactacctatcataattgtagtttttttcccttaaattattaagttggagcagttattttacgtctgatgcatttcttaagcggttttaaagaagggcatagaatatgtgatgataaatttgacacaataatttgagttcatgtgaatgagtgttcaaacattgccaagaaaacactgaaagataatttttaaagatggagtttcgctctgtcgtccaggctggagtgcgatggcgtgatctcggcttactgcaacctccgcctcccgggcaagccattctcctgcctcagcctcgcaggtagctaggactacaggcatgtgctgccaagcccagctaattttttgtatttttagtagagatagggtttcaccatgttggccaggctggtctcaaactcctgacctcagatgatccccctgcctccacctcccaaagtgctgggattacaggcatgatccaccgtgcccaaccgaaagagaatattaaggaagactctgcccaaccaattattaaaattgccattatacaacaagtataatcaatagatacggatggtatttgaactagactagacaaagagatcagcagaccacaaaatacaacatatacatccaagtatacatggcaacgtaatatgcaaagatgacatctcaattctcagaggaaagaacattgtatttaattgttgatattgatataaccaactacacatttgggaagaaaggagagggaattcctatcttacactacacacaaaaataaatctaaagtgtgttaaagactttagcataatcactgcattgggaggcattcttaaagaacagaagaaaagcagaaaccagaaaagtttattttttggaaaattaattaaaaattctcatgctctctgatccacttttcaagattcgatcccacagaaacgagagcaccaatacaataatgtttactatcaaggtaactgaaagcaactgtatttcccaaaggagaatggctgagtatattattgtacacctctatagggagtgttatataatcattaagaatgaagacaggcacggtggctcacacctataatcccagggctttgggagcccaaggtgggtggattgcctgaggtcaggagttcaagaccagcctgaccaacatggtgaaaccccatctctactaaaaaataaaaaaattagccaggcatggtggggtgcacctgtagtcctagctactcaggaggctgaggtaagaaaatcgcttgaacccaggaggtgaaggttgcagtgagccaagatcaagtcattgcactccagcctgggtgaaaagagtgaaactctgtctcaaaaaaaaaaaaaaaaaaaaaaaaaagaatccagaccgggagtggtggctcacgcttgtaatctcagccctttgggaggctgaggcgagcggatcacctgaggtcaggaattcgagaccggcgtggccaacatggtgaaaccccatctctactaaaaatacaaaaattagccggacatggtggtgtgtgcctgtagtatcagctactcaggaggctgaggtgggagaatcgcttgaacctgggaggcagaggttgtagtgagccaagatcacactactgcattccatcctgggtgagagtgagacattgtctccaaaaaacaaaacaaaacaaaacaaaaaactgggcagataaattttttttttttttgagatggagtgtcactcttgttgcccaggctggagtgcaatggcacaatcttggctcactacaacctccgcctcccaagttcaagtgattctcctgccttagcctctcgagtaggtgggattacaggcatgcgccatcacgccgggctaattttgtatttttggtagagacagggtttctccatgttggtcagggtggtcttgaactcccgacctcaggtgacccgcccaccttggcctcccaaagtgttgggattacaggcgtgagccaccaggcccggccgggacagataattttagacatcaatttaagtgggaagaagactacaaagaatacaaagaaactagcaatgcctgaagacattttttgttgtcacaactgggggtggggggatggtacttggtagaggccagagatgccgctaaccatactacaacacaggacagtttcctacaagaaaatgtcagtagagctgacactaagaaaccttgctgtatatgaaccactgataagaataaaatcttagctttccaaggtcaatcttgccttttagccccatcatggccccacgtgtttgcaggttctttggctaagccaccaaatagctgttatggtctgttaacaatcaaatgaatggcaagggagaagtttaagccatgacccagcatttaaaaaataatggaaaagaatacaacagaaaactaagagtatgcagcatgcagagtatgtggggaaagtaatttttgttaaagttaggcatatgcaagcctttgtgtctctcaaatttacctgtaggtataagtggggcaaactgtttatcgcacggtagatcatgctcaaagaaagtcattcaagatactcctcagttctctcatccaaaaaactcatgagttggactaaaaaaaaaaacaaaaaaacctacgaggcactttctttataaaatgttaatgaatttatgatcatctgcatgaagtctaccctgtatgtacagatgtaacctacatgggagggggtacagtccttataggtagacacctgaaaggctcaattcatttcagatgtttcaagaaaattccttagtcaataacattcacatagactttgtaagatcttgattaagccatgaggccaaatctaaatctaaatcacccactcagaaagtgccaaaaaccttaaaaccaaaagaaacattagagattatctatctctaagcatctcaatttttaaatgagtaaaatgagcccaaaatggggcccaaaggattaaatgatttgcccagagtcataagccaagtcagactgtcaaaccgttaaagcaaactgataagaaaaagatgctcagggccaggcatgttggctcacgcctgtaatcccagcacaatgggaggccgagtagggcagatcacaaggtcacgagttctagaccagcgtggccaatacggtgaaaccccgtctctactaaaaatacaaaaattagctgggcatggtggcaggcgcctgttgtcccagctactcgggaggctgaggcaggagaatcgcttgaacccaggaggcggaggttgcagtgagccaagatcgcgccattgcactccagcctgggcaacagcgagactccctctcaaacaaaaacaaaaaaactaaaacatctaactgaatcaggctgcttaagtatcaaaataatcttaaatatctgaagaggaagaaggataaagattccctaacatgcagaactaaaactagaaaaactttattctaatgttcttagactactatcaaattctccctaggacttctacattgctgataacagcttacaatatttttcccagtttagttaagaccacatgtcagtattttattacaatctttcaagcaagaaagaaggtctctgatatactaatttaaagacatatacactcttgatagagctatattaggaaatggcaatggctaattcgtaaactagatttttaaaaaatgacaatatcttgtttaaagttattagactatgacagtcatctgagtggggaggtaactagttccccagcagaagccttaatcccattaaggtttatcagacaagtgtataacagaaatgttcatttcttctcagaaggaggttatgaattatatcacacggattctgtttagatgaggtttagaacaatttttctttttaacagtttctccttttgatttagacactctctaaagatctgtccagatttaggtccatttcactgaaattttgtactaaagtccacgaatttttttcattttttctttggcaaacaggtatttttgtaaacccaagttttatttatttatttattttgagatggagtttcgctcttgtcatgcaggcaggagtgcaatgcacaatcttggctcactgcaacctccacctcctgagttcaagcgattctcctgcctcagcctcccgtgtagctgggattacacgcgcctgccaccacacccagctaatttttttatttttagtagagatgggattttgccatgttggccaggctggtctcacactgctgacctcaggtgatccacccatctcagcctcccatagtactgggactacagacgtgagccaccgtgtccagcctgtaaagcaagaatttttaaagagcaaaaagaaagtgcagattttctgtctccttactacagatgagaaaatagtataaagctatcgagagtgtcaacagttctatattacccccgtccccacccccactgtactgctcctgaaagctaaacagaaatcccaaggaaagtatacattcaaggaacgaagataactttagatatgtattacatgatgcatatacgggttttcagtgaactatatgtgatttcaaactaaattaaaaacaaggctttactatgacattatgaatgaaaaacagtttatttataggatactttgactctactcaaaaagtatgcttaaacaatccaacaactttaggaaagccaaccgataaatctttgcaatcaggcagaaatactaaggcatttaaaaaacatacccagaccgcttttaacatttaccccagagatctctaggctcatcacagagggtaaccacaaaatgcttaagctgcatacagacatcaggcaaatgccacataactgctggacagtaagttatcaccacagtagttaccaatgtgacaaagcagaggataaggagcattcagagttggaaactacggtggaaacgtttccatttatggcacattttctgattggttttataactcatgttactaactatagaatcatagacgagaagaatccccggaaccaagcctcttataaataagtcaactgacctgaaaaacttacgacagagtgaaaactagacccaacttcaaactgagataggattttatacttcacaaaaattaaagttagttatttagattttattagaaatagctcagcacgtaaagtcctcaaaggaaacagacatacagtcaaaaaaaaccattactgcggggcgcagtggctcacgcctgtaatcccagcactttgggaggccaaggcaggcggatcacgaggtcagaggatcaagaccatcctggctaacacggtgaaaccccgtctctactaaaaacacaaaaaattagccgggcgtggtggtgcgtgcctgtactcccatctactaggcatgctgaggcaggagaatggtgtgaactcgggacacggagcttgcagtgagccgagatggcaccaatgcactccagcctgggcaacagagcgcgactccgtctcaaaaaacaaaaaccaacaacaacaaaacattattaaactataataatgttttctatcaagacacaaaatattaaaagtagatcaggaaggaataataagtcaattcattatcaaccttgtgactcttctgtccagcctcttccagaggttccctttacttttaagtgcaatgcaatctttaaccttaactctaaaaactcatttagagtcctccaatttcttatcagttttccaatacagctcaagaacttttccatcagtgaataaaagttgcattacttttccctttcacagcttgttggcagggaattattttaaatgtacaacaaaaatctataaatctgtagcttccaaaagagtgtttgaaaatatattttaaatggcaaaataatctcagtaatcaacagtaatactgaagtaatgtttgaaaattacatttttagaaagtataaagttacatttattacaagtgaagaaaaaaatttttatgagggaatgtttttaaaaagggttacaaattctttgacacttctcccaatgagaggcagatttctgtcaattccccctcaaatctgagggagcttgtgaccactttggtcaacagaatatggtggatgtggtactagatgactttccaggacaggttataaatgggtatgcagcttcaactgagcacagagacttcatgttaagagatattataaccctgagaattccatgctgaacagccatgtgcacacagtacttgacgaagcaacccagccaagcaaagctttctagccattccttaaaagctgccagacttatgggtgaagaaactatctcacaaatttgtgtatggactctccttccagtaacgtaaattccaagagagtaggaattcgtctttgttttattcactgatgtatccacaccattttaatagtttccttttatgtatgcagtaagcattcaataaaggtctgttaaatagatattagtgatggtggcagtggcaggtggagaaggggatatcctattcatgaatagttcacagcagtaaccatgtgcatgcctcgcaaagcagccaaagattttcagagagtctatctaattccaatgaaaagcccaggcttttaaaacggtattttacaaagactgatggatctgactaaagaaatttaaaacttctatcattcaaaaaccataaaaattaaaacataaataaataaaaagctagggaaaacaatttgcattttaattatgcttttaaaatgcaaaaaaaccctttcaaataactcaaaaagacacaaagatttacagatttctttatataaaaaagtgacaaataaatacaaaagaaatacactactaaatcaaccaaataaaataatccaagaatgtcttttttgtttattaaattggaaattctttaaaaactactatctgttaggcttcagaacactgctgacaaaacagcagtttcattctggagaacataacatttctcaaaagccttaaaactgtcattatcccatgaccactccccactacccccaccccagaaaaagtccacatctagaaatttaacctaaggtaataatctgtgatatgaagcaagctttacacacaatgtttttaaactcttagataaaagagcactaactgagggtcatgttcccgacgttagttttatttgcttgtagttgggttttctttggccttcacaagtgtgtcaaaaaaaattcagtaagttgccagcattttaaaatctattgcacacaaacacaagatctgccagcactgggtctgcaagcctcttaatgactattagctaaacagtagccaatcccttcagatgtggcacatgatacacagttcaaaatcatccctaatctgaaagcttggttcatttacattagatgctttatcttctaaagttatctcagttggaagccctacactagagatcaaactttaagcatgcagggcttgctaaacgctgattggtgggccccacccccagagtttccgactcaggacatctgaaatggggtcccagaatttacatttctagcagatttctaggtgatggtccaaagactacactttgatggtctagagaccacattttgatgaactttccttgctgaagccagagagaggcctagcatcctttgaattacacaattacaggatacttaaacaatattggagattccattaatgggggagggaggcaaggaagagtagaaaagccgacggataaacaaccaatagtcagtgcactgcttccctctatcagaggtggaaaaccattgccctacactaaatttaagaataatcctagattaagttgctagtccaaattttctattctacattctttctcatgggccttatccatttctcaaggtttaatgacctcttctacacttcatggataaaataacaggggtaaacaaaaattgtggtaaaagatcccacgtagctccaatattttatgactaacaaatgtgtatcaccagccttaatattttctactgaatttgctttctccagctggatcctatacatagcagcttttgctgaatgcttcctttgttccgggcattgtgctacaacattacatgacttttcatcatttcatcataataacaactctatgaaacggtgcctactatccccatactacagatggagaaaaagaggtcatttgtcaaggggttaggtcatttgtcagagaagcaagcacaggtaaaatctacatctgtatacgggtaatctggctccagagtcctcaattttctttttctttttttttttttgagatggggagtctcgctcagttgcccaggcgcaatcttggttcactgcaacctccgcttcccaggttcaactgatctcgtacctcagcctcccgggtagctggaattacaggtgcacgccaccacgtccagctaatttttgtatttttagtaaagacgaggtttcaccatgttggccaggctgctctcaaactcctgacctcaagagagctgcccacctcggcctcccaaagcgctggggatacaggcgtgagccaccacacccggcccagagtcctgaattttaaccactacacttcatctaaaattcaacttgtacaaattccaatctttcatctaaaactagctcttcctctaaacttgcctactgtcaatgttttcaccttcctgctcaggctgccaggctccaaatcactaagttcctaccataattaagtccttctacatttcacatctgtctttttctttttatttcaattgacctaaatgtccttattcacccttcacctggcctctaaaatgcctagtatttctgcttctagtcttacacccaacggtgctcctcactcattgcctatgggtcaaaggccagcttatttaacatcaaattcaatttaagaccttacctacctcttggatccatttctgtggttccacaaacagattaaaaattatacttaaaacacaccaacacacatgcagagctttatttctgaagaagaagagagaggggtggaaaggaaaaaacttaagaaacaatgttcaatctgaaagtatcacttctaagtggaaggctacaagggataattaatagctaccaaaactgaacactgaaacatcacatccctctttcatggagccatgtaagttaaaaaagaatcttaaactgttgaggtatatcaacatagacaaaatctgaatgccaaagtgagtttcactctaggatcaggttatctggcagctcctgaaacaggacagtttcaggaaccctgtacaaacctcagtgaaatgaaataacttcaagctgtttgttacaggggactcttgtgtcttttagtctaagtaaaagcagcaattttctacaatatatttatataagctgtgcatttccatgaaagaaaggaggtctactgtggatatatgcttggtatgaaattatgtcagaaacaagtgggagcgaggggcaagtcaacatgctgtcactaaataaaagacagacccccagaaatgacctcaacaatcaaagaaaacatgatagtgtaagttaacatgattaattttttaaattaatagactatattttaaagtaatttgaggtttaatgaactgagtagacagcagagtacccatataccctcccttccatttcctttgcacatttattatacttaatgagccaatacttgcatattcttattaaccaaagtccatttacatcaaggttcgctttgttttgaattttgacaaatgtaaaacatgtacttaccacgaaattttacaatatgcaataccaaaaaatacagctagattcaaagagagaatgtttcagcatctcattatctttatcacagtaacataaactgaactccgatcttctcccctgctcccacctagttttcccagtcttcccatctcagtaaagagcaataccttccatccacttgctcagaccaaaaattccttcctcttttataacccatacatccagcccatcagcaaatcctacctgctctaacttcaaaatatatccagaattgaaccttaattctcacactttaccaccaccactggaacccaagacaccattctctcactaggttattatagtagccccctaactcttttttttttttttgcttctgtccacaaactaatcagatcatgtcactcctctactcaaagcaggaactggcattctaccttagagcaagagctacaatcctcacaacaggcctactaggttccacacaacctgtctccacctacctcagttcccttttctgtctatgacttcacctcctgtgtcctcttcaccacttgctgttgaagctacactggtttgcttgccggattacttcaggcagtctctgtccttaaagttttggcactggctgttctttttgtccaaaatatcttccacaaatgctcacacagctgacttcacatcctgacacaaatatcactttcatagttaggcctttttccctgatgaccctatttatcactgcattgttttcccctgtactccttatccctcttacctgctttatttttttctgcatagcatttgctgcaaccaaatatatattctactttgttattttattgacccccccaccccactagaaaataaatgcagcaactgaggtttctggccttaaaaagcacttagtaattatttgttgaatgaataaactatggtgtacagattctcctcaacttacaatgggggttttgtcccaataaacccatcataatttgaaaatatcataagatgaaaatgcatttaacgcacctaacctactgaacatcaaagcttagctgggcctaccttaacgtgctcagaacacatacattatcctacagctgggcaaaatcatctaacacaaagcctattttataacaaagcatgaataactcatttactgaagactgtactgaaagtgaaaacaacggctgtgggtactcaaagtacagtttccagttttcacacgataataaagttgaaaaaccataatttgaactatagtaagttggggaccatctgtcaaggttcctaaaggtgacatacaggtgctagcaactacagtctaaaaaaataaagccccaattctcaacaaatcagtaactgattctggaaacacagaagttcctttgactctcttaaaggcttcaagcccctctatcagaaaaaaatgtctacagtttgaggagactagcctgctgccttcgggatgtccccatctgttttctagccactaacacagccacaaagcataccacacttaggaacagatctatgggtaggacacaagcatatttaggctgctatcataaagataaagatgcattcagccataaatacttaaacaagtattcatactggaaatatgaaacacttttaatcatattcctaacaaaagtaccacgagattaactggctgagaaataatgggggtgatctcctatcgactacaaaagtgggttagaaactgaagtaatctaacctcatcaagcaagtaaagcttcactttactgcactttgcagatgctgttttaaaaaaaaacaaattcaatgtttatggcaaccctgcatcaaacaagtctattagcgtcattcttccaacagcgtgcactcacttcatgtccatgtgacacatttgggtaattctcacaatatttcaaatgttttcattatctgttatgatgatctgtgatcagtgatctctgacactgccattgtaatttctggaggtaccacgaaccgcgcccataaaagatggaaaacttaactgataaaaatgtgtgttctcactactccactgaatggccattcccctgtctctctccctctcctcttgtttccctattccctgaaacacaacaatattgaaattaggccaattagtaactcctcaatggcctttaagtgttcaagtggaagagtctacagctctcgctttaaatcaaaagctagaaatagacacttgcggatgttttctggtaaaatagctgaaagaaaagaattttttttagagacggggcgcagtggctcatgcctgtaatcccaacactttgggaggcggcggcaggcggatcacctgaggtcaagagtttgagaccagcctggccaacatggcgaaaccccctctctactaaaaatacaaaaattatgtgggtgtggcattgcgcacttgtagtcccagctactcaggaggctgaggcaggagaatcacttgagcccgggaggcagaggttgcagtgagccaagatcgtgccaccacactccagcctgggcggcagagcgagactccatctcaaaaaagaaaaagaatatatattttttaaaagctagaagtgattaagcttctgagaaaggtatgttgaaagccaacataggctgaaagtaaggcctcttgtaccagttagcaaacttgtaaatgcaaaagttcttggagaaaatttaaaaagtgctactccagtgaacacacaaatcgtaagcaagagaagcagctttattgctgatatggacaaagttttagtggtctgtatagatcaaaccagccacaacattccattaaactgaaagcctaatccagaacaagaccctaatcctcttcaattccatgaagactgagagaggtgaggaagctgcagaagcaaagtctgaagatgacggaggctgctttacgaagtttaaggaaataagccatctccaataacctaaaagtgcaaggtgaagcaacaagtgctgatggagaagctgtggcaagttatccagaagatctagctaagatcatcgatgaagatggctccattaaacaacatgtcagcaatgtagaaaaaacagcattctattggaagacacaatccaaaacttttgtggctagagagtagaaaggagaaatcctgtcttcaaagagaggagaatgcttgacttcaaagcttcaaaggacagcctctcttgttaggagctaatgcagctggtgattttaaggtgaaggccaatgctccttgaccattctgaaaatctaaggcccttaagaattacactacatcagccaggtgcagtggctcatgcctgtaatcccagcactctgggaggccaaggagggagaactgcttgagcccagtagttggagaccagcctgggcaacacggcaagaccccgtctctataaaataaaataaaaacaaattatgctacatttactctgcctatgctctataaatgaaacaacaaagccaggatgtcagaacatctgttgacagcatgttttactgaatattttaagtccaccattgagacctcatgctcagaaagattcctttcaaaatactgctgctcactgacaatgcaccattgccggagaggtctgaaagagatgtacaaggatataaatcctgttatcatgcctgttaacacaacatccattgtgcagcccacagatcaagcaataatttccacttctaagccttataatttaaaaaatacattctgtaaggctatagctgccatagatagtgattcttctgatgaatctgggcaaagtaaattgaaaattattctggaaaggattcaccattctattgagtcactcatgattcatgggaggagttcaaaatatcaaccccaacaggagtttggaagaagttgactccgactctcatggataatcgagaggttcaagacattgctcgaaaaagtaactgcagatgtgaaaaacacagcaagataaccagaattagaaatagagcctgaagatgtgactgaactgcaatctcgtgataaaactgaaacagatgcaaagttaagttgactctgactctcatggataactgagaggttcaagacacaggtcgaaaaagtaactgcagatgaggaagaaacagcaagataactagaattagaaatcgagaattagaaggaaagaaagggaaggaaagaaagggaagggaagggaagggaggggaggtagggagggagggaggagggagggaggagggagggaggagggagggagggagagagggagggagggagagagggagggagggagggagggaaagaaattgccacagcttccctaaccttcagcagccactaccctggctagtcagcagccatcaacatggagataggaccttccaccagcaaaaaagattatgactcacttcatgaaggctcaggtgatcgctggtatttcttttagcaataaatattttaaaattaaggtagtccactatttattatgacataagcctaccgcatacttaacagactacagtatagtgtaaatgtaacttttatatgcaataggaaacagaaaaagcccatgtctctcactttagtgtgatattcactttattgcagtactgtggtcatctggaaatgaacctgtgatatctctgaggtatggctgtattttcatacaaataaaggcactccccctaaatctagagtctagatcccaaatacatctgtccatatagggggtaccactcccaagaccaaaggggtgtatggctcctatctccagccgtaccaaatcatatatacagtgtaatatctggttactctttattcaggacagctacattcaaaggaaacataaaatgggcagaataaggactccttgctcattaacaaaacaaagccaactcttatgtcagagtacccttttgatcaattagtgtgattatgttcactagtaacagattctaccatcattgttgtccatttcatttccattctcaagctttaaaaccccaaaaggacagaaagagatactacaggctagtattagtaatactaaaaatagttacctcttattgaaacctgaagggcctggtacttgacatatatcattttctaatctttatatgaactcaataaagcaaatattgttatttcaacactattacatattagagactgagcaatctggacaaagtcacacagcttatcagtaccagtaggaattcaaactcaggtctgactcaacagtctgcattcttaaatatacctcaataaagctgttgaaaaagtaaaagtcggccgggcacagtgtaatcccagcacacctcaataaagctgctgaaaaagtaaaagtcggccgggcacagtgtaatcccagcactttgggaggccgagtcaggcggatcacctgaggtcaggagttcgagaccagcctggccaacgtggtgaaatctggtctctactaaaaatacaaaaattagctgggcgtggtgatgggcgcctgtaatcccagctactcgggaagctgagacaggagaatcactcgaacccaggaggcggaggttgcagtgagtcgagatcgcgccattgcactccagcctgggtgacaagagtaactacgtctcaaaaaaaaagtaaaagtctccatctttccactagaccacactgcttttctcaatctttatgacaaacatgtaaggcatattgggttctggataatatgtcaaggagatatactattttggaatattttggcaaataaaggggggctttaaaacatgaaatttttttttcttaataagaactgtaatctatttccccaacttcattattaagtgagttttaggcctaggtcttccagaacagtttcctccaaaacatacagtgtaatatctggttactctttatgtgtgcataagaaatgtcactgtgacaaatgttataaagaaaaaatttgattaccctaaaaacaaatacataaacagcccgcaagtttagctcctaaagtaggaaagaataatgtgaaaatgtttctggctgtaccactcaacaaaaatttgcccgccaataaggaatcctttcttcaaaaattggtcatgatcattagccaaactgtaaccagtaacatccagctggattatggagctaataaagaacaacagaggggatccacaggaaattcaacaggtaacttacaactggctctctcatcagactggcagactgggtctaatccgaggtcagatgacatgggggattatggaagccaataacaatcatatttaaataaatgtcctttacagaacaccaccactttcctcataaaaagttcaaaggactattttcacccctcacaattacagtaaggataagaagcccaagcacagcttgaagcagcaaaattttctgaaaaggaattgaattctgtgttctcttcaggatcttcctttcccaataatgggggtattaaatttcacttataaatcaaactgaaagggaaaaaaagaacaataaaaaatgagctggaaaacctacattcatcatcttcaaaacaacatcaagttagaaacagttttaaagcaatgttacaactcctttagaatctggcaggttttctggtttttaccagatcccgctccggcaacaacaaaaaaagaaacagttttaaacagttttatgggcgtggtggctcacacctgcaatcccaacactttgggaggccaaggcggacagattgcttttcagcacaagagtctgagaccagcctgggcaacatggtaaaattttgcctctataaaaaaataccaaaaaataccaggcatggtggtggcacactcctgtagtcccagctacttgggaggctgaggtgggaggactgcttgagcccaggacagcaagggtgcagtgagccgagattgcaccaatgcactccagcctgggcaacagagccagaccctgtctcaaaaaaaaaaaaagttaaatgctgatgactgaatagaacacaattctctgtaaattcttcaatgtgataaagcatttcctacaccagttaccagtggcagcacctaataagacttgagagcaacttaatacttcaccctcatgtatgtatgaatttaaaatagaacatcacaataactacgaagatacccaaacaccccttccctaatttttttttttggtacaaacaaagtctcgctatattgcccaggtggatctcaaactcctgggctcaagtgatgctcctgcctgggctttccaaagtgctggggttacaagcgtgaaccactgtgcctggtcgcttccctaattcttaacatgtcccacaaaagattctgcttgatcttggcccccactatatcatcactatctctagtaaatagactcaaagcctctgctttctctgtggctctagccacactggcagagaccaaaggagagttcaatgataggccctctcacagaaccttgtgccttaccatacttgtcagttacaattttattcactcgattcaagcattttttggatgcctcatatgtttcaaggtacctttgttacagcagtgaacaaggcaaagcccctaacaggaggaaattcacattccagaggtaagaagagaattaaaaagccaaaaaaaagtgtgtgtatgcatatatatgtgcataagaaatgtcactgtgacaagtgttataaagaaaaaaaacacagtaagaggacagagagtgaagttgtccttgtacagttgacagtcaataacacctcttttaacagtagtagagacctgaacagggtgaagaacagagccaagctgacaggagatctggattaaagctttccaggcagaaggaatcgaaaataggcgggaatatacttagcttgttgagcaaggcaaacagcatggctggagcacagagagccaaaagagaggtgataaagacaacaccaatgaggtaaataaaagcagacagaacttggatcctctagagcctgcagctcacgatatggagtttgaattttagtctacgtgtgacaggaagcctttgaagaactttgaggagggacacggatgtgttatcgacacactataaatgaccagtaacttcagaagcaaggaggccaactgggaggctgcgaaggttgtccaggcaaaggatgataatagcttagactagggtgatggtagcagtcaaatgaggaatgttatttattttcagaatgtaatctgaaggtggagccaagatttgccaatggaatagaatgtagagatgaaaagaaaaaaaaatctattcatctctgcatcccctcagagaatgtacctgaccaccatgaaagcaagggccatgtttgtcctattcaggtccttgaacaaaggaacagtgcagtatgttctagttgaattaataaatgacctgcttctttccctacagaatcacaatattggcatttattttggctggcaaatactggtacgatgtcaagcatagaaattaagcaccttaggagaagaaaagggagttaaataaaaaagagatccatgtttcactgaacttgcaaattcaactcaaagcaccacctgtctgaaaatggaacgtatatatataaaaaaactgctcattaaggaaaataaatcacagtatctcagcaacagtgctttgtcgtgagttacaagattggctacaccatctgacaggattacttaaattgacaaagacctgcctcaccaaacacagctagaggtccttgggtccttgtggtactggtatcaggaatctgataaatcagtcagagtgtggagtgtttttaaaacacagacaaaatatatttagcaagcaaagtctgttaaagggaagattggagatcactttaaaaataattcaaagcctactctaagtatttgcaaaattgtaagattatatttctgtgcttttgaataagattcagattggacagtctcaactctcccttgtgggagagggtaggggtgggggtggacctgttttctactaagaaatttataggactctccaaaaacagaacttagggcagtactccttaatagtgaccatacattagaatcatctagggagggctgggcacagtggctcacacctgtaattctagcactttgggaggccgacacaggcagatcatttgagcccaggacatcaagaccagcccgggcaacatggtgaaatcccatctctactaaaaatacaaaaattagccaggtatggtggcatgtgcctgtagtcccagatgctcaggaggctgagacgggagaatcacttgtgcccagaaaggtagagggtgcagtgagctgagatggtgccactgaactcatgcctgggcaaaagaatgagatcctgtctccaaaaaaaaaaaaaaaaaaaaggaatcaactagggaggcttttaaaacatgaatgctggagacccacaccagataaattaaatcaaaatttaatcgggggtgggtcctgggattttccctttaagtgtttcccacgtgatctgaatgtgcagcccaagttgagaatcaccaatttacagcaataaagtttaaagtagaggatttaaataaaagtcttttaaagaaacaacactttcagaagtcaacaaacttgagccttcatgttaacacgtgggggtcacagtgggcattttggagcacagataaaaggacctgctttggaattgtaaaaggctgtttcatacatacaaacagttcaggaaaggatagaacgaaaacaaaaacaagaaaccttgattaaccccaccacattccttcccaagggcttgaattttttaaccgaacactacaatagcaacaaacctagagagtcagttcaagacggcttctccctgtaatgctgccttagaactctacagaacagcagtcactgctgcacagctaaatacatctccagccaaggaaatctagacatagaagatagaaaataacatcccagtttgtccctcctctttcccctccctcatcacatatcaacagctaactttgaacacatctgtggttcactgtaccacttacaggggtacagaggaatgaaattaccagtcctcactgtaaaataaacacatttctttaagaaattctataaagcacaagaggaaagcaaaaccttagtaaactgacaaatgttcccattctcccagcacatgaagaagactgccacagtctttttcaattacactttgaaaccctctgtcctggttttcaagcacaagctgatcttcacctcattatagatactcaaactgccacccgtcttatttttaaatatcagagaagtgacaaaattctatctatgatcaaggatgtattataaaagagaagaaattttgcctggtttttacatttatttaagtcccttctacaatgaataaaaatggttgttcaaatcaatgggtgaatgggaatacaaataaaatatgggtagcattttaaggcatggtattaaggctaacatgatgtccatctaacatccagtttctgaaaatctgaaatcagaacacaggaccttttcatttcaaatttacattaaagttcagctcactgattaagcatttccctcaataaaattacatttgtcataccttaattgtgcaaaagctgcaaactggtaaaaaacttgaatgccatggcatgattattcaaaaataactggtacaccctatgcctgaaacctgagtgcctactgtgaacctgccaaaatgattacaatgacaacccatcatcttcatcacatgaattactgcaatgtgaacagtattctgctgagcactatacagtaatcaaaagacaagctccacatcctcaagaagcttataaatttgactgaggagatagggctgataggcaagatagcaataaaacacataataagggcctaaatcatgcagtacaaactaagttttgaataccagttcccagcttgcagtctcagacatagatagcaacaccaccaccaccacccttgccaagccaagtaagtaaaaagtaaaatgagtaggctaggcacggcggctcatgcctgtaatcccagcactttgggaggccgaggcaggtggatcacaaactcaagagattgagaccatcctggacaacatggtgaaactctgtctctactaaaaatacaaaaattaactgggcatgacggcgcgtgcctgtaatcccaactactcgggaggctgaggtaggagaatcacttgaacctggaaggcagaggttgcagtgagtcaagatcgtgccattgcactcctgcctgggccaaaacagcaaaactccatctcaaaaaaaaaaaagtaaaatgagtatacaggagtcctaaaaacttgagaaaccaaaggaagcaattcatttggtcaagagaaaggtcagggcagtttcaaccttcccatttatttagctgtgtgactttcaacaatttacccaaccctttaaaggaagatagtacctactaattaccatgagaaccaaatgagatagtgtatataatgcgctttgcacaatgcctggcacatagtctcaaatactgcctattatcattactgttagaaacagtaaaatcctagtgttggcaggggcctttcaataatccaattttccagtcgaatagttctcagggtgtagttaccatcagcatcatttgggaaattgttagaagcccatactctagggctccactccagacccactgaatcataaattatcaaatctgcgcccagtaatctgtgttttaacagcactccaggtaattgtgatgaccattaatgttagagaattgctgccctaattaaaccctctaattttacgtataaagaacatggaggccaggttcagtggctcttgcctgcaatcccgacattttgggaggccgaggtgggagaaccacttgagtccaggagtttgagaccacgtaatatagttagaccctgtctctgaaaagaatacaagaattagctaggcatggtggcatgtgcctatagtcctagctgctcgggaggctgaggcagaaggatcacttgagcctgggaggtcgaggctgcagtgagccatcatcataccactggacttccagcttgggcgacacagcaagaccgtgtctcgaaaaaaacaaaagtaagcagatggaaacctgaagagataaaataacctgctcaaaaccacaatcatggagactgtttgtttagggtccattatatgccaagtaccagggtgaccactttttacatttttaacatcaggtcctcacaacagcccagctgggccccaattaacagaagaaaaactgaggttcaggtgtgagatggatggagtaatttgtcaaaggcggctcaatttttaatgggcaaaattaacattcaaatccaagttgtatgtgatcccaaacccttactgaaaccaggaccactgagtgttctgagggaacgataccaagcacacgcccagacttccccacccaagggcatcgttcttttcattctatcataccaccttagctgcaatgattttaccatgaaacataaccagaaattagcactttaaagcaactctcagaagacaggtggtaaacgattcttcactccaactagaaaggaaaaaatgacaacatactatgaaaaaagctatgaggcaggaaaaagcacacgtcaaggcatggagatacggatatagactaggtaattttgcaaccacataagtgaaagaaaatttgctatccaatcttcctattctctactcccaagagcctagtgcttttgtatagttttcagctcagtaaagtgcctccagatttataaaagctcaatgacaataacaaggtatctttattacaaaatagttgttaaaagtttgattcgaaaaattttaaggaaacctttcaggtaactgaaagtggagggtaggggcgcgactcatgaaggagttttttaaccaaagaaatgatatgatacatttttaaatgaccacttcagttgcaatataaaataacagattttggaggaaaatgtcaatacaaggatatcaattatcaattattaggttactatattggttcaaggagagatgatggtggctgtggagatgagtgaaatcaacagatccaagatatattttagagagtattgtagaagactaggaatgggagtgaccagacaggaatgaagacttctagacttactgcacactgtcatgaggaaggatggggatggaagggtacagtggaataagctgggttttagcagaaggaatcaagagccccattacaaacacattaaatggcctggcgtggtggctcacgcctgtactcccagcactttgggaggctgaggcaggcggatcacctgaggtcaggagtttgagaccagcctgaccaacattgagaaaccttgtctctactaaaaatacaaaactagctgagcgtggtggcaggtgcctgtaatcccagctactggggaggctgaggtgggagaatcgcttggaccctggaggtggaagttgcagtgagctgaggtcgcgccactgcactacagcctgggcaacaagaacaaaactccatctcaaaaaataaaaaataaataaaaataaacacattaaacgtttataatgtatttacaagactaacaatcagataaagtctgaacttcagaaaggagatagagctgacctgaaaatataaattacgaactattgttatatgaatgttacttaaaagacgaggaggccaggtgtggtggctcatgcctgtaatcccagcactttgggaggccgaggcaggtggatcacttgaggtcaggagttcaagaccagcctggccaacatggcgaaaccccacctctaccaaaaaaaaaatacaaaaattaatcgagcacggtggcatgcacctgtcagcccagctactcaggaggctgaggcaggagaatcacttcaatctggaaggcggaagctgcagtgagctaaggtggtgccactgcactccagcctgggcaacagagtgagactcggtctccaaaaaaaaaagggcagaagatggggcggaagaatagagataggaaagaggaggatgttgagaactaaaccctgaggtacttttagtattcaaagtgtaggggggtctggaaatcttgtagagaccagtaggggttggagtatgacatcttccaataatgaattctcgttgctgtccccttatgggtctgggtctacctgatagtctcttctggaagtcggtatcacttgtgcttaatttctactcttttgtgccctctatacagcctctactacaaatcttttttgaagaagcacagggagaaataacttggggaaaaaaaaaagcctatcttttagaaatagattctgaaatatttacagatgaaataatatgttgtacagaattggcttcaaaatagtccaagtaaggggtggtctagataaaaaaaaaaagaacagctctgagtagatgcctgttacagttgggcaatgcacacatgggaaggttcactgcactggtctctctgaatatttcacaataaaacataaaacatagtatggaaggttggcaaacacaagtccatgagaaatctctccatcttacccagattaacgagagatacaaccaaggatccacaggtttgatgcagacattctaaaagattcaattataccaagactttaaaggtgacagatttttttcccctcaactatacatttttttttttttttttttgagacagagtctcaactctgttgcccagactggagtacggagccataatcatggctcatttcagccttgactttactggctcaagcgagcctcccaagtagctgggactacaggcatgccccaccatgcctggcttttttttttttttttttttttttttggtagcgacaggggcctgctatgttgcccaggctggtctcaacctcctgggctcaagcctcagcctcccaaaagtgctggattataggtgtgagccactgcacctggcctatattgctatcttaaaatgtctcagtgacccaacaatttgccaaagagcatgtagagcaaactaggctctattcagcatttccatttcttaatgtatctatttgatttcaataaaatttcatcattttgaagatctctcccattagcttgggaaactacagaaacatgcacataactactgagaaggtatcaagtgttcctacactagtttaaaaaaatcattcaacacccacataaattctgatatgcactaggctgaacagctgttaaccactgagaagctgggcactgcatcctctccctgggtcaaaactctatatgctaatcaaacagggtcatgtatttgggaaaataataatccatggtaaaagtcacaaaaagaccttaattttaaaatgagaattcctaatctatacattctttaaaaaatctagggtatataggttgatgtaccttccttgatcaaaactcttacttctctgaagcctgtcagagtattttcaccacaaggcttggattaggtttcattttacatatgcatgcacatgttcacatacccataatcatccttcttagtagtatatagagacggaccatatcgttaccctcttctgctcaaataaatgtcttcccctacaaatgctaaggagtaaaatgatccagaaaaagtagaaatttggcataatcagcactgacttcctcaacggtaacatacatgacataaacacattaggtagactggatgcccaaaggccaatccaacctcatgtcttcctggcatttctcaggcctttctcgtcacccaccccacctaggttccacgtttccaaaaaagttccatgaagattcaggaaaaaacaaaaagggaggaaaactcattttattaaatttacatcatatccttcttcccagggttcaaaattaaataaaaccaaaagaagaaaaccagaaagacaaaagcacttttgtccaaggtggcaaaacacaagagcaatttaactgccattatgaaccaacttatactaaaatagtatttcctggaatgtgtataaattaaaaaacaaaacaaaatgttcatggttacttttactttcagggttgggaactgaatcccacaaacagcagctaaacctcaaaaaaattgtaattccctaattatttccagattaaaacacttctcttgaacacatgtttctgctgttctttggggtgagtgtagggcacagctggagtacagtataacacagaaacagcaagtgcactaagagcatcaaatccttccccccaaaattgtttatctcttccagactcctattcacacttattcccctgacttaattttaattctgcctcttggccctcttaccttgtccctttctaccctactcacttattctctattcatcctcattctctgaaatgatagtcaaaataatacttcatgctaaagcattttcttaaatatttccagatattccaacttgttatgatctcccacttctttaaaccagaagctattactacttttagagtgcatacctatttctgccccatatttatcacatacaacttacgtatgatttagttagcatcctcaaacttagaaaatgattctcgcagcccagcaaaaatccttactatagcagccaatcaatatctattgaaaaatacatgtaccccctcgatacaattgtcataaaagttttcagtgtgcacttaatttgataatgtcacttccatctttctgttttgaaaactgtttcgccgggcgcggtagctcatgcctgtaatcccagcactttgggaggccaaggcaggctgatcacaaggtcaggagatcgagatcatggtgaaaccccgtctctactaaaaaaaaatacaaaaaattggccaggcgtggtggcgggcgcctgtagtcccagctactcaggaggctgaggcaggagaatggcgtgaacccaggaggtggagcttgcagtgagccaaaatcacgccactgcactcaggtctgggcgacacagcgagactctgtctcaaaaaaaaaaaaaaaagaaaattgtttcataagaatgactcatccttcaaaggaaaaattcagatgaaaaggtgtctgcactatgtagtgtgttaaaatttgttctcaagcctctccagctaccctcaggagtgaacagtggcaaactgcagcttaggctagtgaagtgatctgccctacaccatcaagttagccaagaatagaagccacatttcctgactcctgccttgactcctgatctctttccacacatgcaaatacaagttcagcatcccaaacccaagatccaaaaagttcccaaaataggaaactttctgagtgtcaacatgacactcaaaggtaatgtttattgaagcattttgggtttccagatttgggatgttcaactggtaagtacagctgaccctctgtattcatggattcaatcaatcaaacagcaaaaatatttaaaaaacaatgtctgtactgaatatgtacagactttttcttctcattattccctaagcaatacagtgtaacaactatttacatagcatttacactgtattaggtgttataagtaatctagagatgacaaagcatacaggaggatgtgcataggttatacacaaatactatcccatcttatatcagggatttgagcactgtcagatttggtatccacggaagttcgtggaacaagtcatccaagaatactgaaggataactgtataatgcaaagattccaaaatccaaaacacctctggtcccaaacatttcacatcagagagactccacctgtaatggctttcagttctgtaaatcaacagcacatctagttgtgtgaatacatacgtggctaaggttcaaagtactttaaaagtattaagtccaagacaaagatgagatagtattcctcacctgatccaagggtcacacctgacagtaagaactggagtcaaaggatcatcactgtaacccatcaacataggtacagttcacaatattaggagaagtcatgaagtaacatacatacaggacacacataaatttcacctctaaccaggaatcctgtgatagaattcattaaacctattctcactcaactacccccagtggcttatgaatcaatcctaaaggcatcagacacaagactattaccattacaaatttctaatctgctaagaagtcttgagttttaaggaagaaactagtgccaattcattaaaaaggaaggcagaaaaatggaaaaccagaagtctttcattgctgctctatccccataatctaaaacaatacctaggacatcacaggaaaccaatgtctatttactaatgtctatttacctcttagcctttattaaagtgaactcatagtattgacattattttctcatcctcacagggcatttgaccacattttggaaccaagtttaaaatctttcataggccaaaaaaaaaaaaaaagtatataatgactaacatgctttaaataccatgacaaatataattaaatacttgctctcactgaattcaaaatttttagttccctcaaggtgaagttactcattttccattatttctctctaacatcaatttctccaccagatttcctccacctgtgccactactcacccatctaaatgtgcacatgtgtactcaagcattcaatgaattgcttattatgtactactcagcacgaagaagcagaggaaacccagcctttggagtgatatgaacctgactctacttcttgttttaaccaattactaagccttgtgacctcgggaagtcaatcattatgtctagtactcctgttgcctaactgtaaaaatgtgaaggattattacgtacataaaagcataataccaaaaataggcactaactgattgttagtttccgtccctctcctacaacagcaccctgactttggaaactaaccctccacgaactgaaagcattctcagaatatactgtccttaaaaaaagaggaaggaatgaagggaaagaaaagaaaagaaaaaggagagagggaagggaaaaggcaaaaatttttaaaaatacttttggtcctggtttacaggccaccacaataattcaagtaaattagcataatccagagagacaaaaactttttctattttttactacaccaaaaaagctcataataaaatttcaaagtattaaaaaataaatgaaagtaatcccttcccttcctccatcccaacccatcccatccctcagaaataatcactgttagcactctggtgtgcacatatacacatacacatacatacatatatatttttgttgccaaaattttactgcagatatctggaaaataaagagtagcataaagaagaaaaatatgtaatctatacaaccggaaaaaattttaagctgcaaataagtttccacaactaaatttacattgtaaaacacatgatggggaaaaaaaggtctttacaataaatatggtacaaggacaactgaatatccactatccacaggcaaaataaaattggattcctacctcacaccatacagaaaactaacttaaagtcgatcaaagccctacttaaatgtaagcattgaaactcctggaaaaaagcataggagtaaattcttcatgaacttgggttaggcaatgatttcttatgctgtgacacaaaaagcaaaagaaacaaaaaaaaaacataaattggactatatcaaaatttaaaacttctgtaaataataatcaagaaaatgagaatacaatccacagaatggaagaaaatatctgaaaatcatctatttgacaagacactggtctccagaatatatacaaaaaacacaattcaacaatttttaaaaaccaaataactttagaaatgagcaaaggatctccaaagaagatatacaaatgaccaattaagcacctgaaacgattatcagcatcattagccattagagaaattaaaatcaaaaccacaatgagataccacttcacattgactagcatggctataattaaaaagacaattagaagcattggcaagaatgtggagagaatggaacccacaaatatcgctcatggtaatacaaaatggtaatataaaatggaaaacaggcagttcctcaaaaagttatacacagggctactttatgtgttaaatgctgaggatgcataaaggatcagaaattcagataaagcattcccagaacagtgattgatcctgtttgtttaaaaaaaaaaaaagacaatgtactcaacaattaactaaagtacttgtatttctctttacaaaactaagttatgtaagaactaaacattttaaattgaaaattgtttatctggttctttgaactgaaaatccttttatattcccacctgtgagtgtacacaacaaggtgaagcaaatgcattaaacccagtaggtctcaggacaggaagcatttacactcagaggctatcccacagagcaaaatccacactgaagactaaatcatttcacagaaccctagatttagataaacttggagacaggagagcagctgaagagcccttctctttcctcaaggttgtctacacatctaaatcaacttcactgggggagcataggggctgcttaagggtctaagacaaataaattcttctatgcaatactttacatttatttacaaacggtctatcttacactaagctcaaaatattccactgagctactgcagaaaatctgggtgcgaaataagaaaagacaatcagagagtgtatactcataaaaggaattaaaaagaacaaaatgcccaagaatacagtatcctcacaaaaaataccctaaatgaatctagtaaaaatttggcaacccatattctggaaagatattctttacaagttaacctgtatgtcttatgcaacttccaaagtcccaaagaaagtaatacaaaattaagtggttttgagatactagtcagctttttcggaaagagggttagagaggacttacttccttgtattatgaaacaaaaaacgctctgatgaattaaaagggtagtttctttctttatttctctttttttcagacaagtctcactctgcgtgcccaggctggagtgcagtggcatgaccttggctcactgcaacctccacctaccaggttcaagcgattctccagcctcagcctcccgagcagctgggattacaggtgtgtgccatcacacctggctaatttttttgtattttagtagagccaaggtttcactatattggtaaaagggtagtttccaaaaataaaaacatgtacaaggaaatttaaaattctcctattagtgtctggaaggatgaagaatttctactattttaggttgagaaagaaagctaaaggcaaaagatcaacagacaaaaatttaaacaatttataatttctaacttatccaagtttgactccaatatttttaccaaaggataaatatctctgcttcaaagaatcataaaaacattacaacagcctggcacagtggctcatgcctgtaatcacagcactttgggaggccaaggcaggaggactgcttgagtccaggagtttgagaccagcctgggcaacagagcaaaaccccatctctacaaagaaaaaaaaattttttaataaggggggcataagggtgcactcctgtggtcccagctacttgtgaggaccacttgagtcctggaggttgaagctgcagcaagctacgactatgccactgcactctagcctgggcaacagagcaagactgcagactgtatcaaaacaaaacaaaacaaaacattacaacatatgagaatgttcaacttcactaatactttcccaatgcaaatttaagtaaagatagtattttttatttatcagtttagcaaatatttttaaaggatcctccatgctaattggagtgtggttaaacaaaaaacctgcttgttacactgctggtatgactacaactgggaaccttttggaaagcaacctaacaagatatatctgtagtcttctgaattgttcacactctcttttattcttagattcatacaatataaataaatacaaaaagcaaagcctatgtgcacaaacagcaagcatcagaaagtccatgaaaagaatagtacaagtatatagtaaaggaattaacttatactttgcttttcaaactatgttcaatccaatagatttctaaatatggcaagtttctaaaaatccaactccttaagtacactgtaaagacatttatgcacacagctaaaatatactcaaactaagaagtcctcaaaggccgtaagatacactaaaaatataatacctcccagtgaaataaagggaaaagcagaagtcaggtgagaatatttacatatatgtacccattcagcagttctgtagaagtcattatcttctttgggaggccgaggcaggtggatcacctgaagtcaggagttcaagaccagcctggccaacatggtgaaaccccgtctctactaaatacaccaaaattagccaggtgtggtggcaggcgcctataatcccagctactcagaaagctgaggcaggaaaatcgcttgaacccgcgagacagaggttgcagtgagctgagatcacgccattgtgctccagcctgggcaacaagagcaaaacttcgtctcaaaaaataaataaataaataaataaaaaggccgggcacagtggctcacgcctgtaatcccagcactttgggaggccgagacgggtagatcacgaggtcaggagattgaggccatcctggttaacacggtgaaaccctgtctctagtaaaaatacaaaaaattagccgggcgttgtggcgggcgcctgtagtcccagctactcaggaggctgaggcaggagaatggcgtgaacccaggaggcagagcttgcagtgagccgagatcacgccactgccctccagcctgggcgacagagcgagactccatctcaaaaaaaaaaaaaaaaaaaaaaaaagaagttgttatcttcccagtagaagagatgagaaaatttgaggtccagattggttgagtgatatccgaggaccacagagctagtaaaattatggagctagaacttgaagtctgattccaaatcacatgtttcctatgctaccccaaacaaagggagtattttctacagtggcattacaacagaccaagtaacagcagaggtaaaacaagtttcacatgtctgtggctctttgttttttacaagtttttattactttgtcatgggggggaaaacgaaaaattataattaggtcaaggaaagatataactatactactactatcattctgaaggaagggaaggtataccttctaagtcctgcatagtttaaaaattcccattacttgcgagaccaggtgagactgcacagttctagacttcctatcgtgtgccaaaactctagggataatcaaaaaatgtttgttgaatgaacgctaatttaaaatagaaaaagaaattccagatttcctcctcagtacaagaggcctgcaacaacaaacttctgaaataccagcagtctactaattgcatattcaaatttaaaccacagaaagttgaatcaactctgccaatttctgggactctctaaatgaactcttaatacaaaaatacatactcaggctcagcattttttctaatcatttacaaaagtaaaaggacgtcaggacaagttctggtgaaattttataaacagccatgaattgcagctgtagactgccagatacataacctgtatatgacagggggtaccacgtggaaattagagacatcccccttcaccaaaaagattatatccaggggatactacataataaaaaaaaaatctgaaaaatgtaatgggattaagatcctttagaataggctagtagtgatgattttgctttttcagtcccctcctcacaaacaaatgatgatgacactgcccttagctttctatgtgcaaagacagtattaaccttcccaggccaaacttacgactacaccttttccacacgaaatgcaaggcatttctaactccccagattacctcacattcgttggatgccacacaatagattataaagtatcaagatatatattaatttttaaaagttcaccaggagttggatattctaaactgggtttctgattcttaacagtgagaatgaagtcaagctccttatttggtggttagaggagaggatttggccagaaataattcttttaggattgacagacaagtactacttaagttctatcatctcatccaaaaacttgcttcttatattctgcttttaacccgatctacacaatgaaaagccacggagactagttttgcatgaaagcaaaggacttttctaatatgacttcagagcatgccatgctttaaagtccatgttcaaccacttactatcattttccaactcactctctatgggcccatcccatatttcaactacaggtatacctcctggccctttctatttcataagcttctttggaagacaaatctactgatttatgcaataaactttctacctctacttaaccaatttgataatttaatagctggagataattctaaattccccaaaccttaatcaagaattttggaaaaaaagagctatctagaacagttatcttcctgaaaacactgttgtgctaaactgaaacacagccttttctcaagagctaagcagctacttgggtctacattttaatgcactaaataattttataagatcatgtttgaaaccaaaaaacccaaaaaggattgtcaagctaggtcagcttacaaaaccccttctgttatgaactaggaaatcaaacaacaaaacataagctctaggaaatgagcatggaggtgctccatccatactagcttttccttgtttttttcttgagaggagtgactctctgtcacccaggctggagtgtagtgatgcaatcctggttcactccaacctccacctcctgagttcaagggattctcctgcctcagcctcccgagtagctgggattacaggcgtcgaccatgacactcagctattttttgtatttttagtagagacagggtttcaccatgttggctaggctggtctcaaattcctgacctcaagtgatcctcccaccttggccccctcaaagtgctgggattacaggtgtgagccaccgtgccagcccatactagcttttctgaagcctctttactcattcttttgttctctactctagcagctaaagacatctcctaaagaaacaactagtgtgcctccatacaacccctcagtaagcactcagtattgagactaaactgtgaaaagcactaaaataaatgcatcattcatctatgaccttctgagaataccaccacctcatatttgaatagacgtctagttttcatgagaactttcacgcactcatttgatcctctttaaaaaccacaggaaacagggcaagccatcttatcagctctatttacagagagggaaatcaatttgaaaaggttacatagcttaatcaaggtcacaaagtgactgactggccaagctggtactcagtcttatgatagtccagggctctttcctctacactgatcctaaattgaaaaaaaaaattttttttggactgctcctgcaaggtagggctaccccataggcagagagtagctgaaaaattctgtatgtgtctatcacaagaagttgaggccgggcgcggtggctcacgcctgtaatcccagcactttgggaggccgaagccggcggatcacgaggtcaggagatcgagaccatcccagctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaagaagttgacaggcctaaaaggtttcacatttagatgtttctttttttggaaaaggtgaagatctggctgggcacagtggtgcacatccttaggtagttccagctacacaggaggctgaggcagaagaactgcttgagcccagcctgagcaacacagtgagactccatcactaaaaataagtaaataaataaatcacataaaaaataaaaaattttaaaagggggtaaagagccaatgaattgactaagaaatgtgttgtttcaaatcagaatgaccttgaaaagccatagtacttgcatgcaaaaatatgatccgatttaaaaagtcaatatgcttaaaatacaacagaaaaatcaaccaatatatgtatttcgtattactggtttaaaatttctgaatatgctgtaaagagaaggaggtgaaaaacgtcaaccagactggggtggtggctcatgcctgtaaacccagcactttggaaggccaaggtgggtggatcacttgagttcaggagttcacgaccagtgtgggcaaggtggcaagatcctgtctctacaaaaaatacaaaaattagccagatgtggtagcatgcgcctgtagtgccagctactcgggaggctgagatagaagaattgcttgagactaggaggcagagggtgtagtgggcagagatcataccactaacccctccagcctgggtgacagagtgagactctttaaaaaaaaaaaaaaaaaaaaaaaagagagcgagagagaaagaggcagagagagagagaaagatctcaactgataagatactacataatcacattatctcttgcttgaccaacttaacaaatatttcaaaatgtttataaaaatcaaaatgggtcagcattggaagaagttgtaagtaaaattcaggtgttctccacatgaggcaactgctgttaatagaagactatatgacggtattttctcgaagtttggtacaaagatcaaaaatagaatcacaggcaaaacccttgaaaggcttaggaatctgaatttttaagtactaggttgttgatgaatataaaatttaaagatgtgtatttagggtagaaataaccttgaccttggtagctgtggaacttgtgtggttactcgttctgggccctggttttcccaatggtaaaacagaggaggtagggacacaaacgtcctacttcatagaaaagttataagactttaaaggcgatggtttataaaaagtaattagcacacagttttgacacacactaaataataattagctactatggtggaaattttatttctatttaacacttctgacattagcaaatagtgtaccaaacagacatgctttttacatagttacatgattcttctcaacaaccgctcccccgaaagaaagcagtttttaagagggtcactctcatgatttgaagagaactgggagaggaggaacataaatcagttctgtcacattttaaggattagaatttaaacattaaaaacaattttaatatgttcacatatataactatcacctggttggaccatgacaaaaacccacccctaaccataaacaagggtaacctatcatttatcaaaaacaggaaacgttcctatctctcaagatcagcgctctgaactaattatttaacataaggtcatttttacgagttcacatgctgaatggcttacaattaaaagcctcttctaacccaaatcaccatcctccttcacttacctttttttttttttgagatgggagtctccctctgtcgcccaggctgaagtatagtggcacaatctcagatcactgcaacctctacctcctgggttcaattgattctcctgcctcagcctcctgaacagctgggtacaagcacccaccatgccttgctaatttttttttgtatttttagtagcgacagggtttaaccatgttggccaggctggtctggaacgcctgatctcaagtaatctgcccacctcggtttcccaaagtgctgggattacaagcatgaaccaccgtacctggcctgttgcttacacttaaaaaaaaaaaaaaaaattcctcccctctccctagactcctaacctaatcaagttaccaaattcaaaaaattattttatctcacccattcttgcctctttttttcttttttttttttttttgagacggagtctcgctctatcgcccaggctggagtgcagtggcatgatcttggctcactgcaagctccacctcccgggttcacgccattctcctgcctcagcctcccaagtagctgggactacaggcgcccaccactgcgcccagctgattttttgtatttttagtagagacggtgtttcacgtgttagccaggatggtctcgatctcctgaccttgtgatccgcccgtctcggcctcccaaagtgctgggattacaggcgtaagccactgcgcccagcctgcctctttttttctactagggctatcacaattctggccttcatttcatttgacaggaaggcatgggtttataccctaaccagaacaacaatgaacaggatttctgcctccactcctctaatccaggggttggcaaactttttctgtaaagggccagatggcaaatatttaggctttgcaggccacacagtctccgtctcaactacacaactcttgccattatagtactaaagcagccacagacaatattcaagtgaatgagtatgactgtgttccaataaaactttacttacaaaaacttgccttagactgcatttggcatacagggcatagtctgttgattgtgctaatccaaccaactaatatcaactttcctaaattccatcacagatcatgtgatttctgatttaaaagtcactttccttggctgggcacggtggctcacgcctgtaatgccagcactttgggaggccatggcgggtggatcacgaggtcaggagatcgagaccatcctggctagtagtagagatgatgaaaccccgtctctactaaaaatacaaaaaaaaaaaaaattagccgggtgtggtggcgggcgcctgtaatcccagctactcgggaggctgaggcaggagaatggtgtgaacccaggaggtggagcttgcagtgagctgagatcgcaccactgcaccccagcctgggcaacagtgcgagactccatctcaaaaataaataaataaataaaaaataaaagtcactttccttaccaaaaaaaaaaaaaaaatagaacttaacattccttggcctgatactcaaaggcttcctccatgagtataatcttcattaaccttggtcatttcctttttctcatactagattccaaattgtattccatgattgtggctgcttatactgctctaattccaaacctttgctcaatttgtatacagaatgtcctttcttctttccctctaaacacctacatctcccttgcttcccacactaccacctagaactaaaatccatctatcctctaagaagtctccttccctttacccagaaattcttcttcagcagaacttctatggcacttaatctgtatcttttctgacaatgattgctttgtatcttttaccacagtgaattatatcttagatcccctaagcctgtgggcagaatttatttacaagtcatctctgtatttcccacagcactttacaatcaagagataaaaaaacaggtattattgtttcaaagaaaatattcctacaactaaattcctttacataacatagcactgttaataagaccaagacacacttattctgtattaaaatgttacctaaaaactaatgacactggctcaacaaattaagccttcaaaaattagtctccatcttattacccagagggcagcatggcaaagtgggaaaaggaaaaaaggacaagattgacatcctgattctgccattgttgttaaatttctgcttccttatcttgtgaaacagatgttaccactgcctacctgggaaaactaggaataacgactacagtaaattattatgcattatggcttttataaacagaaatttaagaacagctaagttaactgcaagatccctattctgtcaaaaaaaaaaaaaaaaaacacgagtatcttgtgttcagcattatgaatataaagaataaagacatgagcagtctcataacatagacaagttcagtctactgtagatcctttcacagagaagtaatacaacatactgagtgctaaccttccagctatttctaaaaagatggaagtccaaggttatttctaaattattttaagcataaagctaaatatttaagaatgagttataactgagtttctaccaaattaaaacaacgatgcttacaacagcttacagggctcctgatctcaccttctaccactcattctatacctggatcagcatgcatgctcctgccaccccgggcttactgatgaaaatccaacaaaccgggctcagtcccatcttagggcctttgcaagtgttctctacaccttgaatgctcttcctcaagatcttcacaggtcttgctcacacacttcatacagatctcattcaaactgtcacctcctcagagaggctttccctgaccaccctattaatatagacatctctctcccataaccatcactttcaatctccttaggctctttcctttttatatctctttatagcacttgttaactagccttcggtcattatttacttatctgtcttccctagtaggataaaactccctgaaaactgtaatatcttattggctgctgtactccttgtaactaaaatcatgcctggaacacactgagtacttgatacatattaatttttaaattgatgaataacatttgtgagtgacgaggaatattcatcattgcaacttacataatttcttaaaccagctgcttacaattaaatctagcatgttgaggctactcctagaacaggggttcttaatttggggctttagggaatcattaatacccatgtttctggaaggaaaatctacagcttttctttaaatggtccctaatctgaaaaacatcctagaccagtgatttatgactctggctacatcatggaatctcctggtgaattttaaacatacagatgcttggatcccatcccagagggtgtattttttctcatctgtggtacaaccacaggacttctaaaaaattacccaggtgattctagtgtatagcaaaagttgagaaccatgcaatttgaacacaacaaatgttaactgggtgagagtcctcaaaggtacttacagtgggaagaaaacaaaaattgaaaactatgaattttgagggaattggcattgctggcaaacagatcaatacacaagttcctgaataattctgtatcataaaaacattttaaacaaaaactagtagctctacctccacttaaatactaacctgacattgagattctagagcttactcccagaacacaaataacacctttcacttaaaacaacgtatttcagacaaacattcacttcttaataacttacttataaaaacctaaaactatcaagaaaacaacagaatactttttgaagacgaatcagctatattacaactatgaagctctttgtagttttattcctaaaaatgcctttgaagcaacacatttccaccaattaatgtcctcatttagcctcaactgttacacaggatgacaggccctgaatttaggtgaaactaatactgacaatagacacaaaggggggggggggatttcagagatttatttagatcatgtcaaaagggtttgaaaagagcaggtgtcagactgacacaggtggtaaattgttttctttttgaagtcaaacaagcaaacattgagtaataagcgaattcactgataccaaccgagggtttcataagttactggtttttataccttcatccaagtagcccttttaaaaaagggattagcaagatagagagcaaaacaacaaaatgttaagtatttgtaaaataaataaatccagatgcttaaatccacagtgataaataattttaaattattcctggatacttagaatcacgatgaaactcattccatctatccctttctttctttattcttggctgtatggagatacctgctgacacagaagcaccaggtcatgagcacatctgacataaaacattacaaacttaaagcagtattttttaaaatctaaagggcttagggaagacagccatgctcctagctatgaagcctctgtggcttgacttcctggtcatatcacaaggatttttttttaaagtattattcagttcccttgttgagtaagttaatttactaggaaagtgcaaacaaagacatacatgcaggtacgcagctcatcaacgcattttagttgtggggaaagatcaggcttaggagacacgaataattataaaactattagagctggaagagccctctttaaatttcccttctagaaagatgggcacaaggaaatccttagctttctatgtcgttttactcggtaaaatagtacactcttattagtaactttatcttttatcaaaagcctgtggaaataaatgttctgggattaactagtaaatatataaataaagccacagaaacatattcccaaaatgtgggctggaaatgaaaacagaacagcatgggatacaaaaccccactggctgtttacaaaatgtttcgtgtacatgacttttatgtaataggaacagaacactagtataggaaatgaagactacatggaagggctggctacttggaggtgacggagttaaagatttcatgaaccatcaaaagaccaggtcatttatacactagattatcaaaccagaaaaagtctgagtcccctcattccattacatttgaagaaatgagaagcaccaaaaaaataaagtatcaatacaaagaagagagagaaactaagacaatctgaccctgaaggaatcgcaatgtggagggaaaacccagccctaggagttaattgtctaagtcaggtaagaaaagagtgaaaaagttgaacagcacaacagactatttcatgaacaccagatgcctcgatatgtaagggctttaaataaagagaaaacactctcctcatgagctgctgcttcagtgcctagttcttcactcaactatacccccctctaaatcagatgcagcattttgaaatcgacctcactcccttaaccacacttaatttttggagtagaggttaatgaacacaccaggataaaacgatgtctagtttggcaggagtgggagtacaaaagtaaggggaaaaagacaagaaagaacaaagcactggttcgcacacctctctccaccccagttaagctgtggaaagctgactggcatatccacatgcttaaattatacgttactggcaatgagggaagtggggaaatgctaacattctgatttgtcccttgacaaatgagggaggatattcccccctcagggttgcactttaagaatttctacttgcaatgctcactgcagcctcgacctcccaggctcaagtgatcctcccatctcagcttcccgagtagctgggactacaggtgtgaaccacaacatctagctcatttcttgtggtttattgtacagatgggcgtcaccacgttgcccaggctggtctcgaactccttgagctcaagtgatccccctgcctcagcatcccaaagcactgggattacaggcctaagccaccgtgcccgggctctcaccacaattataaaaagagagagaatgaagggaagggtagaatttcctctttaaaagtggtctgactcaccaaaccatcttcactgcaaagccttaaacagtaccagaatacaggaaaaggatattgtatgcttttcttagagctgggacaaagaaatgagagggtgtggtggggggaaggagtaaacaatcagagcataagtaacccatattatacatggtttatatgatgccatctccaggtttaatctttcccttttattattttatgattattttaatggagatggggtcttgctatgttgaccacactggcctcaaagtcctggcctcctaaagtactgggattacaaggtataagccaccacgagcagcctaatctctcaattttagtttccttaccataaaacagacacaatgcttactatacaattaaaatatgctataaaatagtaagtgaaataactatactaaaaggcattcctggcattcagaaaagttgatggtagcatcctttccccctcaaagataggtacaggaggccctaatccaatagttctcagccagggatttttttttttttttttttttttttgagatggagtcttgctctattgcccaggctgtagtgttgccatctcggctcacagcaacctccacctcccgggttcaagcgattctcctgcctcaacttcccaagtagctgggactacaggcgtgtgcgaccatgcccagctaatttttctatttttagtagagacaggatttcgccatgttggccaggctggtctcgaactcccggcctcaaatgattcgcccacctcggcctcccaaagtgctgagattacaggtgtgaaccgctgctcccagccttggggattattttgaccttaccccaacccccaaaagggcacatataataaagtctggaaaaattttgttgtctcaactagggtgagggaaggtcctactggcatttagggggtagaggccagagacgccatcaggcattcttacagtgcacagaatagcttcccatgacaaataattattagtcccaaaaggttaatggtgcctctgttaagaaaacctgcctaaaaaacattcatttttggaaaaaccacataaacacagaagaggagcataacactctagttcctacagtctattaaaaaaaaaaactatttaaaagatattacaggctaagtgcagtggctcacacctataataccaacactttgggaggctgacacaggaggattacttaagcccaggagtcttcggctgtagtaagctatgatcacgccactgcaccccaacctgggtgatagagtgaaaccctatctctcaaaagaaaacatactctaagaacaatcctttcttgtgatagctattactcaaatgacaaaagctgggggaaataccttgtaaatatcagaaaaaaacttctcctcctaagtagtttaaaaatatgcagataggcgggcacagtggctcacacttgtaatcccaacacttttgggaggccaaggtgggcggatcacctgaggtcaaaagttcaagaccagcctgaccaacatggtgaaaccccatctctactagaaatacaaaattagccgggcatggtagttcatgcctgtaatcccagccacttggaaggctgaggcaagagaatcccttgaacccaggaggcagaggttgcagtgagccgagatggcaccactgtactccagcctgggcgacagaccgagattctgtctcaaaaaaacattaacaaagaatactccagatcatccagaaagtcagtatctgatagtgtttatatggagaactcctgcactggaatgtaaactcctaaccctagatccatctcttctcaggtcttcctatcacctcagcctacagcagtcaatccttccctctaaccactccctcctcctaagatttcagcatttaatgcctgtaccatgtatctaatacttagtacacaatgcctaattcttgttttttaatttttatttaaaatactaaaacgaaacagagacggggtctcgctatgatgcctattctggtctagaactcccgggctcaagggatcctcccaaggaactcggcccacaatgtctaattctaatgcttcctcttttacttgaaagtggaggggaaggctgggagcagtggctcacacctgaaatcccagctactcaggaggctgaggcaggagaatcgcttgaaccagggaggtggaggttgcactgagctgagatcacaccactgtacgccagcctgggtgacagagtgagactctatctccaaaaaaaaaaaaaaaaatcagtcacataaattactcattgaagacaggaaccaagttttcaattcttcttaagtgttttcatcattcctgatctaaccaccagagaagtgtttccttgccctttggtggcaaggttaatcttggtgataaatgatcctgaaaggctagtctccaaataattagaaccttgaaaatgtttatatttttctctgctcggaaaattctggaaccccttttctaggactgccacaaggacacttctgactatcctcaatgatgacacattttagtttccattcagattaccaattatggtaactcccctgatcactgtttaagtactacttattaaaggaacaaacattaagctattgctcttggaaggccagcctgctaggaaacacccaagagcaattctgtaccttatccttccctaaattagtcagccaatcttaccattcaaggatgaaattaaaggcatttatctcatctagtaataccatcagtaaaccatggaagcttaaataatctaacattgctttggacattatggaaatgacaacctcagcacctaataaaatgtaaaaccaaatatatacatatcatgtcaatgtcttgaatgtacaattaccttgaaaatttcaaagtcacctcacatttctcaactcttggacctgagacctgcttactatcaagttatcattgagaacaaattaagaattctcaattgagaggtcacctgttgcactaagcaaaccgcctgcaaatactaaattagcttttctacttacactatcaagtcaaattacttctggtaatgcttgagtgtatttgcatgagatcaatttcatatacagttgggcagaagcaaaatgagtcttaagcaagcttcattctgttttcatcttacaaagaaaagactggcctgtcctcccagccttttgaataaggatcttgaaaaattcactacgcacagggtgtgcccaaagaatacttgctggaaaaatatgctgggagagtgccaatttaaaaagaaaaacattttcgcccagttggaaatctagagaaagaatagttgtagcaattcagctaaaaactctcaagacctgaagaaaattttagaaaaaccccagatctttttgttattggagtaaaattctatgaaaggcaactaaatgaatcaatgaagtattcaactatgctaattttatgcacctaaaaagcagtaactgaaattctgcctttgacatttgacggtgcaaaaagcactaagtaccttatttgttctacataaatgaactttataatctgcaatagtttttaaatcaactgtttctgggaaataatgaaagcattttattttcctttttaaaaaagcaagaataacaaaacttctttattgttttgctttttgggaggaggggttgggggaattgggataaatttttgttttccattagagacttttttttttttttttgagacagtctcgctcagtcgcccagctggagtgcggtggcacgatcgatctcggctcactgcaacatctgcctcccaggttcaagtgattcttgcacctcagccttccaagtagctgggattacgggcatgtgtcaccatgcccagccaatttttgtattttttgttttgtttgtttttgagactgagtctcgctctatcgcccaggctggagtgcagtggagcaatctcagctcactgtaacctccaccacctgggttcaagtgattctcctgcctcagcgtcccgagtagctgggattacaggtgcccgccaccacacccggttcatttttgtatttttagtagagacgaggtttcaccatgttggcaaggctggtctcaaactcctgacctcaagcgatctgcctgccttggcctcacaaagtgctgggattacaggcataagccaccacacccggccaagagacttatttctgaagcataacactccagcaatagcttgattaagctaaaaagatacccatctgttacaggcctttgtcttcagtctctcactacaacacccacccctttccaggtccactcagaaccttacgctcagatttttttttcactgcaataagtgaacacaacaaaaaattacagttactacagggacacactggtcccaggttgcctcatgagaaaagcaggtgagtaggcctgctggagctttgcactaactctatggaccctgtggaaactgcatgcaatgcaggctacatggagggtcaccgggctgctcactatacctcagcaaagcaaaaggcctgcctatgcctatgacaacagcctttcccatcacagcctggtcccaccacaaaacaacaagcaatattcttccaaaaagtacagtcctaattttaaaagtgaggaactcgagcctaggtagacaaaatgtaacaattcttaacagttgtccagaattctttctactctcttactccccttttagtactaataccacaaatgctaagaaaaataacctctagttcatccttcaagttttctggtacttgccaaatcaataaaaataacatgtgaaatgttaatcacaaaccacctactcagacactgaaatgacacaaatacagactaagtagatgaaaaccaatcaggatagtcctcaactattctttcaatatcctttcaagttctatggtaactagatttaccagcaagagttttcttgaggaaaatactaaacacaaagcacatgcttacaattcacctgtaagcacaagttaagaataatggagaaagaacataaaataccttcataactcaaaagagctccttttccagcaactggggaaatagttgtttggggcttttccacataagatataaatcatccctttcgaatgtcaaaaatgtttaatttagccatttgatggggaaaaacctttaatagttcacttctctagagtgtttattacagtaaaggaaaactatttaaacttcccaccatccctcctggtcaatgctggtgtccacccacgtactgtgtggtcagagagctgtctaaaggagttacagcaaacagcaaagctatgtgccttcaggttgctccatttctcaaaatagaatcttttttctgccctctctctatcagttccaggagttatcttctattcagaagatagaacatgtatgaccacaagcaaattatttaacatatctatagtcttgggtctcaactgtaaaacagggtatcatcatcatatggaagatttaaagacaacaaacctaaaccacctaacatacagaaaggtgtgatcaataaatactaattcctttcttttcttccttttttaaaaaaaataacttcaaccacttcctagatgttagtctgccctagcaaaatgtccctcctctacccatccaactttttttaagacaaggtctcactctgctgctcacgctggagtgcggtggtgcaatctcgactcactgcaacctctacctcccaggctcaaagcaatcctcctacctcagcctcccgtgtaagctgggactataggcgcatgccaccacgcctggctacttttttttgtagagaaggggtttcgccatgttacccaggctgctctagaactcctgggctcaagagatctgcccgccttggcctccccaagtgctggaattacaggagagaggcatcacgcccatataacccatccaacttctactccacaaaagaaaatgagtaattttcttttactcatattgtaggcttaaggatgtatctggttaagatacatatggccattatacctttcctcaaaaaatacgtattaccaaattaatgtataatagtcttctgaatataaacataaatgccattattttacatgatggttggtagacctcttttcatcaaccaaatctaatgaacaatttgattctgtttacactaaaaaagctagtgcttatgcccaggagataggtaaagagcctagattattatcttgatctcttattagctgtttgacattaagttacttaaactttccattctgcagtttgagtctgtaaaattaaaattatctatctcattgtactgttggaggattacataaattaatttgtaaaaagctctttataactaaagagctaaaaacaattcaacaaatgtgggctattatttctctaccagaatgtctcaactctgttgtctgcttaggcaaagttggttaaaaacgttgttcccagcagggcacagtggctcacacctgtaatcccagcactttgggaggccgaggtgggctgatcacgaggtcagcagatcgagaccatcctggctaacatgatgaaaccccacctctactaaaaaaaaaaaaaaaaaaaaaaaaaaatacaaaaaattagccgggtgtggtggcagacgcctgcagtcccagctacttgggaggctgaggcaggagaatggcgtgaacctggaagttggagcttgcagtgagcccaggtcatgccactgcactccagcctgggcgacagagcgagactctgtctcaaaaaaaaaaaaaccttgtttcctagctcacccaaatcagttcggtcaaaatcctcctgggttctcaggtttaagactaattcagtcccaaaggccctaaactctgccaccctgtttcttcccaggatacatctcttgtaagtacctgagaaacaaaccggaaatagcaattaaagggagagcaaggaaatggcactacatatacaagggtattcaattccctggcacatgccctctattcttttaggcctaagtaaaacaacttataagaacatgattttaaatgaactatgacacctctctctagttgccattccccaatctccccatttcccccgcccccaaaacaattttctctacaattcctcttacctgagttctgaatataatctacatgattactacaatgctactaaataggctgctagagcaaaccacaacattcacaatttaatagcaaattttcagtatattctgcttgcagagcagaccctacaactttcatcaggcttaaaataatttcaaagcaattttgtctaccatggtacaagaaacctttcttcacacttatagaaatataaaatcaaacaggacacagttgccacaaagccttaactaatgagaatcaaaactggtaagatttattcttatgtttactatatactaaacccccttggtttcaaatctatataaactcaatgttttctttacattggatatgtaagcataattttcccagatgcacaatagaaaattggagaaagataattcactggtaaacatgaaagggcatgaccttaggcatgaatttctacccagcttgcaaaataatctagtccactttggtccatgtttagggaggtggggaaatgaattaaagtaccatccatttataacagaatgtggacccatgctttcccttttctagttaaaactatttgttttatcacactgacagagcctaatcgggggctctacaaaggacactccaggtatacccaacaaaggaaaatatttaaataaaaattaatgaatgcctacctcatctgctccttctccatcttgacatatccatccaatgtagttacccctgccaaacaaaaatctgggaatcacccatggcacctcttcccttttgctcaccacatgcaatcagccacaagccctcatcacccctacttccaataaccaattctcttaaatctttcctgccaaaggctgagtccaccattcagctaactggttagcctaaattcacctctattccccttctccacacaagcggggtctgaaaaatacaaatcatgtaagccatgtcaatggcttcacaataaaaattttaactttatataatcaacaaggccatctgtatgatctggcaactagctacctctctggtctcatttctcactacttgtaaaatacactatactttgctctgttctttgagagtcaagcaccttccatttccaggaccttagcatgtcttgtttcctcaatgagcagcaaagccccttctcacccaccaattccttcttatccttcaggtctcagcttacatgtcacttccttcagaagactcaccatcacatccccatcacatgctgcctagatatatccaatatgcaccctcagatcactctgaactttgttcctgtagcacccacaacaatcataaatatatcatctatgtaattacccgcttaaatattaatctctctctaatctatattccccatgagggcaagacaaggattgtatctttcttaaccactggatccctagcatcccagcatgtagcaggcattcaatgtagagttaatgaatgaattaatcaaatccaaactcctccaatgaaggttttcaggtctctacagagcaactcctcccccatttatagaagattatttggaagcttatttcctcactgttttttattttttcagacacagggtctcactttgtcgcccatgctggagtttagtggcacaatcatagcttacccaagccttgaactcctaggctcaacccatcttcctgtctcaacttcctgagagctgggattacaggctcaagctactgcacccagccatttcctcatttttaacacttgctggaacttgtaaggaatacagaaaccttcatttttaagactctagtaaagaacctggactctcatgagctcttaagattattttgcaaactgagtactgaaatgcttctggtaaccatctattgctgtagtcagccaggcttaaaacttcaatcacctatgatgatccctcccgtcattgcccccacacatcacagttattaagtcccattcaatttacctctacatcatttctggaattatctctttttcttctcacattacatttaccatctgtacctataatactatgtcttcaacatatcccattcccatggtgccaccaaagccctatacctttcaacttgtcttctctgtgtgccctgtgctttctgcctatactgacctctcagtaggtcacaatcaaaagaaaactgtctatcaaaatctttgccaaccttcaaggttcatttctaacatcactaagtgccaggcactgttctaaacattcatctttgtcttactaagttcttcactcccttcactctttaaacttcttgaggatacaaacttagcttattcatctgttatctcttgtgtcttacacatttacttactccataagtacttattatatgactttaacactaccataaaagagtacgttcacttcagagaacaaaaacaacaatcacaaggtggcagaaaacactatagcaactatatctacggtaaatgggtaacacccaaattcctgatgcctaagttcctttcttcagaatcccacaacaagcactaagaatgattttcactacctacgtttcttctcaggaaaaaaatgagaagagaatagaagaaaaaaacacaagttcctacttctgccacttgacgtcatgtgcagattaggagaaaagccaaggggcattaaatcaaaggtgttcaacaaatgaaagtttactcagctctgaagtaaattctgtaagaatacaatgaaattattcccacatttctatcccatacatcaagaaataagataatcactttaatggactatgaaaagtaaatcaaccaaagaaatgaatgaaggcattagaagaaccaaagctttaagtcacaagtcaagaaacctgttttgtttcaacttataccagtgctttgctgggttctttgcctcagcttcccccaatgcaaaaaaatggtgatgagaatagtttcattcatgttatttaaagataaacagtcacatttcaaagtagtttgagacctaaaggtcacgtagggtcagctccctcactttaattagaaaaatggttacattagtcctatagctagtttttagcagaagaagggtttagctgagaagacttgggtatcctggctgatgttcctcccaacccaccactttatgaaatgataaagagtagaaaaatgatagccgggtgtttggtgcatgcctgtagtcccagttactcctgaggctgaggcaggaagatcacttgaacctgggaagcagagactgcaatgagctgacatcacgccactgcactccagcctgagtgacagaacaagactctctctcaaatatatacatacatacaaacatacataaaaagtaaaaaatgacaaagcaatttgattgccactttggcaacatcatctgtgtattcttaataaattcaagtaagagttacttttttttatttttatttttacttatttatttgaaatggagtctcgctctgtcgcccaggctggagtgcagtggtgcgatctcggctcactgcaagctccacctcctgggttctggccattctcctgcctcagcctcccgagtagctgggactacaggggaccgccaccacgcccggctaattttttgaatttttagtagagacggcgtttcaccgtgttagccaggatggtctcaatctcctgaactcgtgatccacccacctcagcctcccaaagtgctgggattacaggtatttttattttttttttgagacacagtttcactctgccacccaggatggagtgcagagctgagatttcagctcactgcaactcctgcctcctgggttcaagtgattctcgtgcttcaacctcccaagtagctgggattaaaggcgtgcaccaccacgcctggctaatttttgaatttttggtagagacggggtttcaccatgttggccaggctggtctccaactcctgacctcaagtgatccacccaccttggcctcccaaagtgctgggattacagacatgagccaccaagccagaccaaaagcaacaatatagaacattccaaagtatctaaaaagcaaaacctataaacacactagtaattcattttaccatgaggtcttcataaactccaagaggataaaattccccaggaggggctaggcacagtggctctcgcctgtaatcccagcacttcggtaggccaaggtgggtggattacctgaggtcgggagttctgagaccagcctgggccacatggtgaaaccccgtctctactaaaaatacaaaaattagccaggcatggtggtgggcgcctgtaatcccagcttactcaggaggctgaggcagaagaattgcttgagcctgggaggtggagattgcagtgagccgagatcatgccactgtaactctagcctgggcgacagagtgagactctgtctcaaaaaaaaaaaaaaagggctgggcacagtgacttacacctgtaatcccagcactgtgggaggccaaggcgggtagatcacctgaggtcaggagttcgagaccagcctgagcaacatggcaaaaccctgcctctactaaaagtacaaaaattagccgggcgtggtgacaggcacctgtaattccagctactcagaaggctgaggcagcagaatcacttgaacccgggagccagaggttgcagtgagccaagatcgcgccactgcactccagcctgggcaacaagagcaacattcggtctccaaaaaaaaaaaaaattcctgagggtgagaaaactcactgcaatcaagaccatccaaaattcaaataagcgctttagtgtcactgaactgcatccatagtctatttttacccaaccctgatctgaaacagacttcaggagactattagacaaaacacaggttagcataaattcaaccagaaataaaaacatgaaaatagggaaacaaaatgaagctattaaaaaggtacaagcttagctctaaatttccagatgtcaataggaaaaaagaaacctagtgaacaattacagcacccaggtaataaaaacagactaaaagcttagacaaacatacaattattcttggctgcacatctttctccctgaggtctttataaagaaggcattgcagaatacagagaatatcctcaacaatatttcagtaatcacaatgaaatgttttatgaggttatttttatactgaacttcaagataagcctagagtaacggttgggagaaaaaaaagaaaaaaaaaatttcggggacagagagaaaaaaagaaaggaaaaaaaaaaaaacttaggagagagagacctacataatgtggtccaggtacccagaacactgctgatttaagagcacaattaagagaatttctggaaaaaaaatattattttaacaagtagttactatatagaagtttataagcacaggacccagaaaatgaaaagcaaatttagcaaaatgtggaatgggtccaggaattaaacaaaattgcagggaaaaaaaaacaactctaagagggaaaaacaaagaatataaaagaaagaagagcaagcacaactcagcaagtacattacatacatatgataattaaatgcttttatttctacatctacaattaagaattaaacattaagatatttacggaagcatgcagcttccttcttaatcccataatcaaggagataaaatttaaattcctgtaccttccacagtgatgaaatatcattgtttagtgacatcatatcaaacacaacgtactgcagaattttcaaagcagttatatttccactgtaccaagaaaggaagatatgtgaaatatttcatgaaaattttccaagaagagtttaaaacaaaaagggtaagagtttttaaaccagacataaaatcagtcaaccataaaaattaatttaaaaaactctctctaaagtctcatttagcaatatagtttactgtcaagcataatacaatgataaacatacaatttgctaaacattcaacaacatagaaaaattaatcattctatagctagcatgtaccaacgacacagaatggatcactgtttctcctctgggaggtgggaaagaaaaaaacaattgaattcttagtgaagaaagggattataatttccacagaactatccacttgtaatttaagcaacatcatttaaaaacagctcattccaacagtctcctctactaaatattttcatcagggctgcctagacgaaacctagcccaccactctatcttgggcaaaagagtaaaatacagaccagctactggaagggtggggggagccaaaattcaccagctgggtcaagttcctgaagaattaactaactacattctaggattcatttctcagcatcaaagaacaactttttcttcttctttttaaattaaagcaatgcctccattctcattgtctggtcaactgctgaaaacctttaaaacactcagaagatcaacaaacacttggctaaataaataccagccttaagagtcaacccggtgatcttgctcaacaagaactttaaagtatttatgctttactggtggttttagtttaaatacaatttttttttttttttgagacggagtttcgctcgttgcctaggctggagggcaatggtgcgatctcagctcaccgcaacctccgcctctcacgttcaagcgattctcctgcctcagcctccagagcagctggatgtagaggcgtgtgccaccacgcccaactaattttgtatttttagtagagacggggtttctccatgttggtcaaactggtctcgaactctcaacctcaagtgatccgcccgcctcagcctcccaaagtgctgggtgggattacaggagtgagccaccgtgcccggccctaaatacaattacaatgtgcaaaaagagcatgtacttcagagtactttcagtacccaaatatgatctaacgcatgaaaattcaactttttaaagtatcagttgatttaattgcaagaggattcaactgatcccaaaatgtttcctaaaagccatcctttggctgttcttatacacttcacacccttccaaaccataaaccattatgtgagaagaatgctcagaactaagtagtgaatgaatggccttaaggtttttccaagtcattaaactatcctacagaataagaaaaattctcaggtacttttatttcattggtttgtaacgcttacctacaacagtaccaaaactcagaaatgttttcaatgcaacgtatcctgaaaacaatacgcttatagtgtctaggtgcttttctgttactcaaaataagtgcatgcaatttaaaatcctttaactacagtgtttattatacctctaagcacaaaatatttaacgttaaccaagatatttttaaagcggtgatttaaacagcaaagttagtggggataatgccatgaatattagcaagctgaattaagctactaatccatttaaagaaagatgggttacggaagaagcaagcctctgaagcatttgctttaaatctaaatacagaagtggacttgagcacagtgaactaacaaatgataatagaactaggtctacaaggaagaaattcagcaaaaattatccatttcttccttcaaaatagaaaaaaaaagtttcatttcagatacaatatccatgcagataatataaacaaaattgggaaaccagaaaatttacttttaaaaatcatagctgtctcaacaaccaaacactccagtgaaaatcttcatcaccttttaatacagtcaaggaaacaccaattcttcccacatattcatctttttcagccttctctagtaagccagcctctagcaaagagaaaatgaaagatctgctagtcaattatcctgcccctcttttccaactcctcatgctctctctcaaatctgatattcctaaggagataaatgcacttatttaacatgtatctttaagtatgttataatatagtactgctttatttaattaagtacatagatgctgaattgggagtgacaggaatgaaacgtctctgtctccaccatgccaatttggagtgccacccataaaaagcttatgtaaaattttctcaaaccaacagatttagaaaaaccagtaagatgaggtgggcggatcacgaggtcaggagtttgaggccagcctggtcgacacggtgaaactcagtctctacttaagaaaagaaaaaagaaaaaaattagcctgacttggtggcgggtacctgtaatcccagctacttagggaggctgaggcccgagaatcacctgaacccaggagccagaggcttcagtgagctgagatcgcactactgcactcctgcactccagcctgggcgacagagcggaactgtctcaaaacaaaacaaaacaaaaaacaacaaaaaaaacaacccagtaagaatttattccaaatacatcaatacatttaactcagcttaacaaatctgcttaaaatgggcttttttttttttttaataggaagagagtcaggttgtgaaactagactgtgcttggaggcgatgtattaaatattctgaagcattttctaattgtcagtccttaaaatgtaagaaaatctcaagtgttaaaattgaagactgggtgtgctctctgctgaaagttcaatcaaaagcaactgtaatttcctacaaaggtaactaggtcaactcagcatttgtccctgcttactggaaacaacaaaatctcaacaatcaggccattaacttatcatgtcctatatatagtttcaaaagaaatctaaattcactcttaaagaggtactagtacaattttacacataagatgtctcctagttatttttcttagacttcaaaaggaaattaccaccatttagactacaacaatacaaccctacagcaaaagtatcttccccttcttcactagcatgtatatgcactcatctacccaacatcagggaaaaaacaaacagaacctagacacctatgtacaaagaatcacattctctccataatggcgattcattcattcttccttgtgccaacatttctcaagaatgctatcatgcatgaggtctactcacaggggtacatgacgctgctcgggatcagctctggtcagttcttcctcttcaatatcagactcccctcctgaactactgtcagtgacatctgaatcaaatgcctgttcactgcacctcaagttggctatgccactagctgtaaatctctccaattcttctgaaattgaattgcttttcagaaagttgctaagtccctctgaagtggtggtctcactggcagcttttctcaaggcagcttcagcctttcgagtcagcatcaactggctccgtggtctcaaggattccaagtttggcagtttgctcaaagtcttctccaaaaatccacccagctgatgttgtatatgcctctcaacctgcttggcttgcacaacctgtaagcgcttttgtaatctgcgggcacggctctcaatgtcagcctgtcgccgcagtaaagctgttatccttgtgtcagaatctaaagcactgaaaagaatggaagacaggggagactttttaccctccaatttgacaccccccaagttagagctggagtctgtaccaggtgataatctactgcttccttgaagtgccggctgttccatggaattgacagaggatttgtttgcagtgctattattgctatacaaagttgtgtgttctacatcaaggcttctatgtggaagagtgcaattggtcataccccccttcaagtccccagattcagatcctcccatttcacccccatgaagagcagatgaagtgagagcccgttttcccccattgagggaagtggaattgtcatgatcagaatgtgttgaacttttagtcaatttcttagccaacccatttacaggtgcttgtggcagagctgtctgaccactcgtattcatggttctaagattttctaaggaaaactccaaaactggctgtctccccaacagctcagctcggagttcataggactgagataagagaggatgagatttaaggactgtctgcttgctgaagaccccttgcaacttcaaagactcctttgagggaacagatgttacatcagagcagagataagatgccaccagtggttgcagctttcccaagtcttccttggtaggattatttcggaaatctaggctgggatcctctgcagcaatggcttttcttttggttccgttggcagcaataaggatgttggcgttgccgttattttcggcactgccaggggacaaggtagaggatgggggagccagtttgaaccggatatggtgtgcttcagctgctgcgtcagtgagagcgggcgccatcgcagccattcagcacagagagacaggaagtccagcctctcccgatgccgaggccgaggccagctccacggccccttactgcctccccagagaacagactagaagagaaaggagaaaagaatattagaaatacaagcacttttaaaaacatgtatatttttaacaaaagcactacttgaggctgttgtctaaactgcctccagaaagaaaacactctggagctaactgtaccacagttattctagagacccaaatatctttcatctgggagaaagggggaggcaaaatccctgcacaagggaaggaagaattgcacccttcttgtcatttgttaccacagattgaaaggtgccaaaacacaagttcgattcagagaaaatcacagattgttaaaattaaatcatctccattaaaaaaaaatctctttaagcttgttgaaataaatggatttaaagcaagacacatcaaactaagcaataattaaacagaaaaaaattagtaaggaattcccgtgttcactaaaaaaagtatgccaaatatcacaggtctgtgcatttttctggccagggaatccagttttcatcagcttctcacttctctagaagtatagattatactacaaagctaactgtaccacatctgtaataccaacttgtttcatcagttttcttttctttcagatcaaagtggtcatcaatatcttctctactggcttcttcctctcagcctaggaatttactcaagtatcttctgccctcagtacagcctctctctcatacttaattgcccaaatatctctctttccctttaccccaaaacttctctaagaatagtataaataactgtctctgcactcttcactcttccataatctggatttcaccccctactgctctggcaaaggtgaccagtaatcttattatcaaatccaatggtcaaacctcagtccccattctatctgacttctctgaagcactggacaataccgaccttcttctaattctttcctgatgtccttgtactatcatcctcttctcttcctcctggacccttaaatgctggtgctgcacaaggtcccttctgccctcttctctctcaacaaccactagtatggtgaggtttcttaaccataagaaaaacttctgagctgcactaatcaagattcctataacctctatgttcctcaagccccctgaagctcagaattcactttctccttccagcacactattccgcatcctgtttcattaccttaagtaatgacactgcttttatttagtaaccaagctaaaaatctcagtcatttgcctctgtttgatcccccttgatctatgtggtctgggagccaaaggaaacatacgtaaagaactaagccagttgttctttaaagtgtggtctctggacttctggggatctcacaggctattttggaggttcgtgaaatcaaaggtattttcatagcaatactagaatattatctgccttttacactgtgttgacatttgcaatcagagtacaaaaacaaaggtgaacaaaactgctggtacattattagcacaaatcaaggaagaggcaccaaactatactaatagtcattatactctccactcagtttttctttttttaagggagttccacttaagatgtccttgatgaacagcaaaaattatgaattatcttgagcctttagtgcattttttaaaaatattctttgtgatgaaagggaaagtatgcataaagcactctgctgctttatgaattctcaggaaaaagcacagtacaactgagttgcaaaatgaactagagctttgttcatggaacacgatttttacttggcagaactactgacaaacattatttgaaacctgcttcactagcagacatttccttgcaaatgaacaaagtgaacctgtcacttcaaggaagaccactgacgatatttgctgccaataataaaatctgaattttttaggcaaagattagtgtttttgaaaacttgtatcaacaatcatgaacttaaacattttcccaatattttatttggtgggtgtggatgtgtgtgtgtgtgtttaacagagtcttgctctgtcgccacgctggagtgcagtggtatgatctcagctcactgtaacctctgcctcctgggttcaagtgattctcctgcctcagcctcccgtgtagctgggactacaggcacgtgccaccacgcctggctaatttttgtatttttagtagagacagggtttcaccatgttggccaggatggtcacaatctcctgacctcatgatccgcccacctcggccttccaaagtgctgggattacaggcctaagctgccacattcggactttctgaatattttaaaagccatttctgatttaacagacttgtgacgatattaatgaacgtgaatttttgattgcatataatgtaatgtgtaacatttggaagatctgcataacccagtgaacgataaaatgtccagtgaatgtcaggaaatcatgcatgggtaaaaagtttaagtgcaagacaaatcatttatttgttgctgttattttgaaacagggtctagctctgtcacccaagctagagtgcagcggcacaatcatggctcactgaagcctcaacctcctgggctcaagtgatcctcctgcatcagcctcctagtagctgggactataggtgtgtgccaccatgcccggctaattttttgaatttttgtagagatggaatttcattttgttgcccaggctgctatcaaactcccagcttcagccttccaaactcctgggattataggcataagccgccatgcccagcctgaattacttattaaatattttttaaatttctcaaagtttataagaaaaacaatttatttgctgttctcaacaaattttaagagttaaaaaagggtcctgagaccaaaatgcttgtgaaatcactggactaagcacccccctccctgccccaaatgagggcaatctccaatttaatcaaaaatgcttatctttggagcaataccaacacaggatggtaggccctacaggaccacagtaagcttctttatagtatgacaatttgaatcattaacataaaaatactcaaataaatgactgagaaaacattattcataaaagcaccaatatacatatgggtcgaatctgtcttattgctgtgtgtgtgtgtgtgtgtgtgtgtgtgtgtgtgtgtgtgtgtgtgtgtgtgtttctgagatgtagtctcgctctgtcgcccaggctggagtgcagtggcgtgatctcggctcactgcaacctccgcctcctgtgttggagtgattctcctgcttcagcctcccgagtagctgggacttcaggcatgtgtcaccatgcccagataatttttgtatttttaatggagatggagtttcaccacgttggccaagctggtctcaaactcctgacctcaggtgatccgcttgcctcagcatcccaaagtgctaggattacaggtgtgatccactgtgcctggcctcatataattattaacaccaaaagtttcttgttccagggttgtattttaaccaacactctttatgaactagattttcagggcttatgtagttttctcctgtgggctttctggcatatggcattctgtgtggcacaaattattctatgttgtcttttcccatttctaactttaaatataatactaattactaatatattattaaacattgtgttacagaccagttgacagtactaattcctgttattaaacattgtgttatagaccagttgacagctggaccaatatagttgttaaaaatattttgagtcacttttataatatgcaaagggtttttcccatggacaaacgaaaatcactaccagataattcccatcaattcaatctcctccccttttgaatgtcaatatgtagttgatatgagcaatgcaaggaggcatattatcagtgccagatgattaatacaacatgtgaagagtaattgtaccctactgcctgacagcactacagtaagacttagcaagggcaggaaacagcttccctctgaggacccaagcaagggcacaaatatgctttatgacttacataaaacttaggaaaacccaggctcactccagcacaaatgaaaaagagggtcataattaacatcacatcacagaaggtgcttaagtagtaaacttctcaaagttattctgagattattcaattctttaaagcttacaactttaagaaaaaatgccggcttaaatcccatctactccagctgggcacagtggctcacgcctgtaatcccagcattttgggaggccgaggcaggcgtatcacctgaggtcaggagttcaagaccagcctggtcaacatggtgaaaccctgtctctactaaaaatacaaaaatcagctgagtgtggcggcgagcgcctgtaatcccagctacctgggaggctgagacatgagaatcacctgaacccaggcagcagaggttgcaattagccaagattgcaccactgcactccagccggggcaacaagagcaagactccatcttaaaaaaaaaaaaaaaaatcccatctactccaagacttctctgaaatgatgtctatgaacttgacattaacatatacacttcaaagacaatagtttatttgatttgcactttatccttggtctcaatatccccataggatacacagcatagtgtagttactaaaacaatcatctaagtaagggggtgggggaggagagagagtgcagagaacaggaaaaagtgaccactttttccgaaaaaattcccattcctaattcctaaatcttgagatttctataccaaagaaataccatttattgacttgacatacctttattgactcgaaatactatgctaagattcaacattactcccaaagatattcataagtaagaggagcactgactcaagtgagcaaatctcagttcccatcctggctccacctcctgtaggttacttaactattctgttctttaagtctcctcatctacaagtaacagagccttcccgacaaggatgctatgatgatgaaataagatactttcaattacttggccacgtacctggagcaaccacccagtattatttgcacttttattacactggaaacaaaaaggaaacatagaaggaatgaatttccatggctttttaatgcacctagtttgcaattagctacaattgccataaaccaccacctaagtttagtactttaatcttttccctgttatgtctagacttacttttaatatttcatgatgttgtttataataaaaagaaaactgaatgccaaaaactcggttaaattattaaatatccatacaatggaatactgtgcaaccctaagtgtggcagagctatatttactaacatagaaaagtgcttgcttcattattaaatgaaaaaaagttacaaaacaaaacacagtatcatctcaattttgctttaaaaagtcattggttaagattcttttgtcttttgtttcttggcttatgtaaagtctccaccataaacatgtattacttctataataaaatggagagaaacaaaaagaaaacaatggaaattcttaaagagccaataactaagtaaaacaaaatcacagtaacattctttttttttttttaagagatggagtctcgctctgtcacccaggctggagagcagtggcgtgatctaagctcactgcaagctccacctcccgggttcacgccattctcctgcctcagcctccccagtagctggaactacaggcgtccgccaccacgcccagctagttttttgtatttttagtagagacagggtttcaccatgttagccaggatggtctccatctcctgacctcgtgatctgcccaccttggcctcccaaagtgctgggattacaggcatgagccaccacgcccggcccatagtaacattcttaaatttaatatacagagcaaaacaatgattcctatcccacttgacccctacaaaattcaaaaagcttcaatctttgacaatgtaaagcagggaaagactgtcaaatttaagcagttcttagagaagctcagggctaaaggaaaaaaaaacgaaaaacaaaaaaaggaagcagttctacacaaacagcacaacagcctatctgataaatcatctttctccaaagaatacaaagccttaaaagctataattaactgattaatcctcataacaacctgggcagtagaattagggctgagattataatttctaatttaccggtggggataaagtcagactgtacattcagaataaaaattcaagccccaaatatcccaatttttagttcattcagttagtaaactataatctgacaaatacagatggagctgctacacctgctgtcactcacacaaattgagattctgcagtaagcttgtacagataaaagaaaaggctacctattcaaggtcatttagctataaaaggttgggctagataatcaatagtttctctctcagtttcaaagaagtattttagggtctggaagatgttaaatgcactcagcaagcaaatacatttcggaaaaacttcccagatggagactcacaacgtattgcatcatactgaatatgcaaatgtttacctttaccaaacttttttaacaagcacctttttccattacatctattaatatcaagcagaaacatcattgtgagaaatacaagttgggataaagttcaaatatgtgacctctagggtcccttcctatgttaattctattattctaaattgcaccatcggtccaaggacaaacttctacctaacacaagtggcacttgggaagcaaaaatatacttctaggatagagtttctcaacctaaccactaactgacatctcacgatgagtaatctatcacagggggctatcctggcagtagcatgtttagcaacatctctgttttccacccactagatgctagtagtgcccttctgaaaattatgacaatcaaaaatgtctccagacatgtcaaatatgggagctggggggttcaacatcacacctcccaacagagaaccatatcctaaagattatacacacacatatatatactctttcaaaagcaaaacgtatccagctgcttcaaatactgtaagtcagaactaactccacacccacaaatgaaaacctcatttattcccagtcaatttccaagacaagactccagatacacaagaataacctggaagcatccaccttgcaaaaatatttagctgcagagaacaaaggggaaggaataggtcatccaggtggccaacaagtattacaaccacacttgcactgaaagcaaaagcaaaaatcagatggggaagaaaagtttgcccataatgtggcttctactaacctcttccttcaccattacctcatttctctacacaaaggacggaaagaaacagcaggaaggatgattagggaagtgtccatgaagttgccgcaattttagctgagacttgaaaattagctaaaatgtcattatgcaaaaggctaggacaagagaatggtaatgtggcattctagtgagaggaaatggcataagaaaaggcaacgctgtgtgggaaaaggcgacattctgaaggttaaaagaaatgaacaatttgggccgggcgcagtgactcatgcctataatcccaggactttgggaggctgaggcgggtagatcacctgagatcaggagaccagcctggccaacatggcgaaaccccatctctactaaaattaccaaaaattagccgggtgtggaggcgcgcacctgtactcccagctacttggaagactgagacaggataattgcttgaacccaggaggcagaggttgcagtgagctgagatcgggccactgcactccagcttgggtaacaagagcgagactccatcttaaaaaaaaaaaaaaattaacaatttgcttaaaacacaaagcatattttaatagaggaaatagtagaatgaaggtggaaaggcagtttgaagccagatccttaacggacagcctttaatagccttaattcagacttaaagacagtagaggggccaggcacagtggctcacgcctgcaatccccgcactttgggaggctgaggcgggtggatcacctgaggtcaggagtttgaaaccagcctggccaacgtggtgaaaacccgcctctaataaaaatacaaaaaaatcagctgggtgtggtggcgggcacctgtaatcccagctgctcgggaagctgtggtaggagaatcgctgaaacctgagcggcagaggttgcagtgagccgagatcgcaccattgcactccagcctgggtgacaaaagtgagactccatctcaaaaaaagaaataaataataaaaataaaaataaaaaatttagccgggcatgatggcaggtgcctgtagtcccagctactagggaggctgaggcatgagaatcacttgaacccaggaggcagaggctgcaatgagctaagattgagccactgcatttcagccagggcgacaaagagaggctctgtctcaaaaacaaaaacaaacaaacaaagacagcagaggccaggtgcagcggctcagacatgtaatcccagcactctgggaggccaaggcaaaaggattgcttgaggccaggagtttgagaccagcctggtcaacatagcgagatcgagtctctgaaaaataaaaagtatatacatatatatatacacacacatatatatgtatatgtatatataaaataatgacagcagagtatcattaaacactttttaaatgggagtgaaacatcagactgtgctttagagagatcagttgggtaggatggattgaaagtaagtaaaaaggcatctatagatggcaaagaccaataaaaaagctaccacaataatccagataggatgcaatgagaacttcaaccagaaaataatagtcaaagtctctaccaaagcttaaatccagaaatgtgaaggggccagtctaacaaaaaggccaaatatatgacaaacaaaaacatgatggcttataaagaatggaaagaaagctctcttttccttcataatttcatctcctttgtgacgaaatccttcttttctcacgaagcttttcaggtttggtatgtcctctctatacttctaacactatcagtctagcccaggtcctcatcagctcctgtctagattatcacaacagcttcctgactagtgcctcagtgccccaaactatcctttacctttttatcatctcactttcctactctgaacaagttcctcacactttttttttttttgagacaaagtctcgctcttgtcccccaggctggagtgcgatggcgcgatctccgctcactgcaacctccgcctcccaggttcaaacgattctcctaccacaacctcccgagcagctgggattaccggtgcctgccaccacagccagctaatttttttgtaattttagtagagatggggtttcaccacgttggccaggctggtttcgaactcctgacctcaggtgatcgacccgcctcggcctcccaaagtgctggaattacaggcatgagccaccacacccagcccctcacacctttttaatgagttcaaattcttcaagatgaaacttaacgtcagggcaagcacatcaattgatacggacccagaactccccacagattcccaactccgtatctttgcctatgttgctacctctacctggaaggtccttcttctactttttttttttgtccccaaacttactaatttttcaatacatagcatctccacaaaaacttcttagactcttccaattcatatcactttcttcctgcttgaattgtataatgcacttaaagtcactgtcattcagttcaaattatctgaattttccctaattgttaactaattctatttccaagacaagcaaaattccttaacagcacccttctttagcgtgctaactttatcgagagcttggtacatagtaagtgctgtaagccctaaatgactggactagagaagtcaaaaaggcctcgtgggggttgccctcaagtgtaagattttactaagaagagaaaaaggaggaaacacgaatcaaaaaattgacacaatcaaaataatgggaaagacgtggggcatgatccacaaaacaacttgcatgaatcaggtggtatatgtacagcttctcaagagaaagagaggaaaagaacagtgatttgtgatgaagtactgcaagctacattatggaatgcactgcaaagtatttattttacatatgaacaaaagtagatttgttgtggaatacaatggggaaggagagacaaaatttttactataaaacaaagagataatgtgtgtcacccacaagaccattatcaatttccttggccaacagggcttcttaactgaaaaagctttatattactaaaggaatcattcctgagtgcaggataggttattacaaatgttgttcactaacattaattagcgttttactatgtcaatcactatgctaagtatcttacatatattctcttaatcttcacaataacaatgtaaggtaagtactactgtcctcattttatagatgctcaaagaagttaagtaatttgcccatgatcacacaactatgaagttgcaggggcaggatccataatgctaaagccgatgcttttaactactacactagatagtttaaggcttaaactgaaacggtcttaactgcctgacagtaaattctgaattttagtctttagaggaaagtcagtcaaagaacaccaactacctactgagtatctccaataaatattaaaatgcctagagtattcaaagcaccacagtaagtacatacaaggatgacaagcagcagtaaagagagacactactgtgtgatttgggggatggaggcaatcctcatacaggctgagaagtaggcggagtcagaaaatgcttttcagaaaaaagaacatccaggctgaaacctaaagaatgagtaggagctgggtgcagtggcaggcgcctgtatttccagttactcaggaggcaggaggatggcttcaggcaaggagttcaaggccagcctaggcaacatagcccccatctaaaaaagccacccaaacaaaaacactaattttttttttttaaatgatggcctaccatggtagctcacacttataagcccagcaccttgggaggccaaggcaggaggatcgcctgagcccaggaggagtttgagactagcctagacaacacactgagacccagtctctaaaaaaataataattagctgggcatagtgggagggtcacttgagcctggcgggtggaggtcgcagtgagctgttatcacgccactgcactccagcctgggttacagagcaagattctgtctcaaaagaaggaaaagaggagaggggaggagagaggagagaggagagaggagacaggggagaggggagaggaggtgagagaagaaaaggagggaaagaaggaaggagggagggaaggaagggaaggagtagggccgggagaggtggctcacgcctgtaattccagcactttgggaggccaaggcaggaagatcacttgaggtcaggagtttgagaccagcctggccaacacagcgaaaccccgtctttgcctgtaatcccagctattcagaaggctgaggtacaagaatcacctgaatctgggaggcagcggctgcagtgagctgagatggcaccactgcactccagcgtaggcgacagaatgagactgtctccaaaaaaacaaaaagaaagaaatgagtagaattcagcattgcctatacaactacttcaagcatcccatattcaaaacccattccctgccccaacaccaaatccaaaacttcctcctgctcctcaacattgtctatttgagttaatcatgacctcaaatcaccaacttactttttaccataaatatttaatttaaacatctactaaatgccagatacaagatagtaaaatataaattaggtgtgaaggtagcctagcttgataaagtactgtatttcacctgaaggggtcaaggaaggcttctagaaaagatgacatactgactgaattttgaaaggtgaggtggtgcacagagggtgagggttggcaacacacagaatgacaggcacattcattccatccttggtgccaatgccctagtgcagaacctcattatgtactatagtaattcaggcagtaataatctcccaactattcttccttcttcctgtctcagcaagcctctaatctagcgtccactaccaaaatgattattagaaagggaagaaaaaaggaaaggagggggtaaacctaaatctaaccatttaaaatctttcactgactctagagtaaggatgagtccaaattccccacacaccattatctgtcccctttttacattagacctcatctccagcctgtcctcactgcagccacctgaaacatatgtttcctggctcttctatgcccctgcacctttactcatgctactctttcacggttcagctcaaggttacatgctctttcaagtattccccattactcccaggttgaggtggggtccctccctctaggctcttacctgcacccccatgacaccctggctattgctcatggtacaatataaactcacaattttgtcttgtctctttcttccccagagtatgtacttttttttttttttttttttgaaacagagcctctcattgtcacccgggctggagtgcagcggcacaatattggctcactgcaacctccacctcctgagttcaagcgtttctcctgcctcagcctcctgagtagctgggattacaggcacccgccaccacatctagctaattttttgtcttttttagtagagacagggttccaccatgttggcctggcctgacctcgtgattcgccagcctcggcctcccaaagtgctgagattacaggcatgagccgccacgcctggccaactatgtacttcttaaaaaaggagggttatagcttgttttatctctgtcccctacaagcagcacaatgcctggcagacagcagaccaacacacgttaagcaacctgagcattctatgctaaacccatcagatgaagatccattaggacgttaatggggatgtctgaagtgatcaaccacctaacaagaagaggcatcaactgaacctaggataggcttcacccactacaagttccagttatttacttgaccaagcacctgtacccagactaggaaactttttaactacactttttaagctattattaaatgtggttacacagcattataaaggtaatagccatcaaaatcacaaatgtaattgctcaaacttttacccagcaactgcacttctagaaatctattcaacagaaatattctcataggtactcaaagatgtatacacaatgctttcactgaagaactggaatacaaaaaaaaaaccctaattaaaaagatcaagccatataacaagtatgatcccattaaacatatatatatacacatatatatacacacacatatatacacacacacacacacacacacacacacacacacacacacacggataggctaggccccatggctcatgcctgtaataccagctactctagaagtcaaggtgggaggactgcttgagcccaggaattcaagaccagcctagacaacatagcaagataccatctcaagaaaacttttttttctgaaggatgtctatatatcaaactattaatggtgttaatcctacttctatgctagcactgaattcaaatttcctaccactctttagctgacaaaagacagaggaaaaaaaaatcatactttttatcatatctctttccaacaagccctaatggttggtgtaagtgctcctgaacaatcctaaaatcagcgacttctggaagattttaagaattctaaaggaggccgggcgcggtggctcatgcctgtaataccagcactttgggaggccgagacgggtggatcacaaggtcaggagatcgagaccatcctggctaacacagtgaaaccccgtctctactaaaatgcaaaaaaaaaaaaaaattagctgagcatgatggcgggcacctgtagttccagctactcgggaggctgaggcaggagaatggcatgaacccaggaggcagagcttgcagtgagctgagatcccgccactgcacctccagcctggggcacagagcgagactgtgtctcaaaaaaaaaaaaaaagaattctaaaggaaacaggttattctgggagggtccatggccaaattcctgagttcccactgaaacctaccttatacctttagagaaaagtcaattaatgacttttaaaagtacatttttccaatgccaataaaatgttaagtcaatactaatatccatttttcattctcttgggaggcaaggggtaaggagtaaatcactaagtgcaaaaaaatacagtccaattttttggagacatgcttaaggtcttcaaagagcttcagttctccatggtaacatatggagagtttaatgaaactttcctgacagttcaacttatcagactggtatttcttttttcttttttttgagacgaagtctctctctgtcgcccaggctggagtgcagtggtgcgatctcggctcactacaacctccgcctccaggttcaagcaattctcctgcctcagcctcttgagtagctgggactacaggcatgcgccaccatgtccagctaatttttgctgtttttttttttagtagagacagggtttcaccatgttaagccaggctggtctcaaactcctgacctcaggtgatccgcctcggcctcccaaggtgctgggattacaggcatgagccaccacacccagcccaggctggtatttctatgaagtgtctctcctatactagaaaccagaaactagctacagtacttagctttgagcctctttcccttcacaccctctggtggaggtgctaacaaacagtcacaaaggccaaataacaagcagcaagaggaaagtctagatatgagttcttagcaatttttggtttaacatcctaacaacaaaattgttattcctcttttttattccctaatacttaccttccaactgaatttaaccaagtctaaccttaagctctcccctttttaaaaaggaattaaaaggtgagggactccattaagtttgatgtcactcaagcaactttttccaaataagagcagaatctgctgtaattaaaattcagagtaagatctcattttggattcctggttcaggttacaagaaccagagtttttaaaataacatttagataaaactgcactcaatctacctccactttgcatttcctgaccctcaaaatcttggaaagaaactttaattctaaaaaaattacagccaggaaaaaaaagggtaagttcacagtcagcaacaataaaatacacagctaaataatttcctggtagagggctttcaaatgttaacactgtggaagcagcttaaaatcttggaaaagcaaggcttgcagaaagtaacatttattaaacaactattttgccgcattgtgctactaaatggggaaggtctactctatttaaaaggtctcttccaccttaaagggactctttgcataaaggtttaaaatcttcatataaaatgtttgatttttttctttcagactgcccaaactcatttgtttttgattcataaacatgagctgtgttttctactttggtcaagtcagtttccgcactctattttagctttacctttattctaccaaagacaagaaaatgcttaataaaaaaaaatatatattgcagctctttttggagtccaagtattttggtaaatcacaccttttggcttattttctcctatgtattttgttctacatcctaaaaggcacatggcttaaaaaagaaacaaataataatagttaccccctgccatactagtcatctcctatgacccacaatcctcccctcaatctgcaagtgacacccaaggatatcacttacctcctatatcttctgatagccttcaaacgctggtgaactctagtacagtggatatttgtcttttctaattcatactgtcttctacagccatagtgtggttcaactgagttttgatctcacatttcagggaatgggaagtactgatgagggaaacttatcttgtcatataaactattgttctgcacaacttttagtatgcccagaggtatatacgcaacttatcagcatagaaactgtaatttaaacatacatcttcagaagcaacatgagaactaaaaaagtcttaaaacagacttccaagaaacagttatgaagtccaattttaggaaaaagacatgatccaagtgttctttgcactgacacagtaggcaagccaggtgtctggggccattttacttaagaacctgccctgtactcctttcttaaggtaagtaagtaaagaggcactaaggtaaaatacgcttcccaagacatagactaatcaaatcactcaaggcaggaacatttaaaatgaagaaagagtacaacgaaagctgctttaaaactctaaataagacaagcaaggggccaggcccggtggctcacgcttataatcctagcactttgggaggctgaggtgggtggatcacctgaggtccggagttcaacaccagcctggccaacatggcaaaaccccatctatactaaaaatagaaaaaaattagccaggcgtggtggtgggcacctgtaatgccagctacgcaggaggctgaggtaggagaatcgctagaaccctaggggtggaggttgcagtgagccaagatcgcgccactgcactccagcctgggcaacagagcaaagattgtctcaaaaaaaaaaaaaaaaaaaaaaaaaaaaaaaaaaagacaagcaaggttatatgctcccgttgctcaacctactcaggaggctaaggcaggaagatcacttgagccccggagttcaggcactctaaactgtagcgcacaatgattacatctgtgcacgccaacctgggaatcacagcgagaccccgagacctcgtctctaaaatgaaaaagaaacaaaatctctaaaccactcaataagatttactctggggcaatcaacagacaaccacttattcagtttaccctagtccctcccctctaaactcaaggaatggaacggagaggtcctttgttggggggtggagagggacaataaaactatatacatctatctagcaagaaagtcgcttatttctgtgtcttaatggactcaccaagaagaaaaaaatagcccctacccatctccccacaagctgaaaaaacataaaaggaatacgcattactctttaaacatggcgtttactatgtttagaaaatccagtgtggattagtttggtgttttatagcacattttaaaaattgcttgtctaggctaagcgtagtggttcatgcctgtaattccggcacttctgggaggccgaggcaggtggatcacttgaggtcaggagttcgagaccagcctggccaacatggtgaaacccccgtctctactaaaaatacaaaacttagctgggcatggtggcacacgcctgtagtcccaatggcacatgcctgtagtccctgctacccaggcggctgaggcacgagaatcgcttgaacctgggaggcggagactgcaatgagctgagatagcaccactgcactccagcatgggcgacagaacgagaccctgcctcaaaaaaaaaaaaaaaaaaaattgcttgcctgatataacaaggtaactaagctttactcgcaaaggggcctaatcagaacctctcaatactaaaataccttctcaaacaaccacaacacccctatgtttacagagtacacaaatcaggtcataacgaacagaacaaacctaaaacttcttattcactttaaaatgcaattaaaacctgtggtcaactcaatcctctacagaagacgcagagacactggttacaatgtagcattactagagatggaagagtagccttagtgacagtgaagaaaaaagtttagtatagttacttcactttcttctcaccttgatatgagttcacaagtgaactaaggcctactcattttctaacttccagaattttcctcaacaggaaacactcacgtaacaaagagtgctctgcaggtttaaccagagaaataacatgtgtaggcaggaagaaagaaaatcagacaaaaatttaacatctcacgttggtaaagcaccaaagtcaaatacgaatgttctgaacgtggctttcagaaaagatgcaagaaaacttctaaaatacttcacttcagtggactcatatagatggaaagaccgaaaatcccaccctaccataaaggctctaataattcttaactgatcattcttttaactggtcacaatcacagacactggtatatactcaaatgaggtggccatcagtgacaaccatcttcaccataatatagacattaagaacctttgtaacatttaatgtttccctccaagtagttcaaaaaataaaaagtcaatcacctcaaattatgaggtactaacaaatacaccaaatatgctaaaggtcgaaggaacggcacactttgttgcataaacctagtggaaatccaattcagaatttcatgactgaaggtagttattccacatttataatacattttttaaattcccaagggatgagcatttttaccttgccttatttttagaactacacatcacactgcacatatcacatgacatgatgtaactgttagcaaagaaaatggtccaaaccattgacaatgtacatggtaaatcaggatcaatgcatactcaagaaccacatttcgtatttactttaaaaaaaaagtttcttaattcaaaatgttttttcaaattgaaaaaatgtctagtaacctatgtagaaaaaaccagaaatgtacttcgtattttataaaataggagtttacccaattatgggaaaaactgatataaagaaacagataaaggaataacatacttctaaaactacaggattaaaagtaaaaattttctagatcaacaccgaaatgctaataaatacacttagcattaggcacaaaacaattactactcaaaagtattcactgttgataggttaaaaaaatagttttaactgacaacgcctgtagacaattgaaattttctaaattggtcagacagcatgctagaaaaggaaccaagtagagcctataggaaaggggaaagggaaaacacacccacttaagcctttgtaaatagtggtcctttaactgacccaaaaagcagagaaaacagaaattacagaccatcctgacaaatggaaaacatattctaacgtactagtttccatacttgaaaggactttcaaaatgaagttcagtagcaatctataactatatcatgattatgcaaggcaaagattatgtaattttatcgtttattttaaaatgttctccgactctaaaactaaaacaagtaaaacgttttgatctctccaaagcgaaaaggaaaggttcctctgagctgcaatttaaaaatataaacacacaccccaaaacaaacaaaaaaacacaatgattgctagccacgtgacaaaggagatggcaacaccaggattgtgaatggaggggagggaggcgaggctggaggaagagagatttctcggaactttggggaccgcggcagtcggtctgccgaccctaggagcactaaactccagcccctacgagttgtgcttctaacaccctcaagtacagttttattaataagtcacagaaaatgctccagtgacctccaggataaaggggggtgggggggaccgaggaaaaggaaagagagcaatttaaagtggcgccatcatgtcaccccttctcccctaaagcaatcagtaagcaatagttaagtagcacgtttctctataaatccacattgggattccaacattggaaaacgaggatttttaagtaagacacgggagtagcgctgtttatcgtatggaaaacaaactatttgctaagaatcaaaagaccgtcagccggaaaacaggcccccaaaaaggcagttaagattccaactcacttaaaagcaaataaatccctcttcctctttagtttaaaaaaaaaaaaagtccgcctgagggagactacatctgaaaacgtaagtgacctgaatttacaggcaacaaaaataataaatgaaacaatcagagttgtgatacaaaccgtgcaacgcgccaagatgtgtgtttcgagcagagaaaggccttttgcagtcaagagaagttcaaggcgagagccagagtttgtttggggggttcttttacgggaataaatcatgttcttcaggccgcctttttaaatagaacgccaaaggaaaagctggcgaacgaggcggcagctcctggggaagggcccccgcacacccccgcccttggggcgactcccagcccggacccgcagcagggaagcccggagaggccatttaaagttccgggggatttttctaccctgccctgcctttctagttacaactaacaaagagagagagaaatgggagccacagggagagcgaggagaaggagaaagggcagcaggaggaggaggagaggagcagcagcagcacctaccacgtgatggaggagcgtagcccgggcggattcagccccacaaaatgggcgcagtttgcaaacagccccccggcctgggcgccgagggccagcggcgggcgggggcgcgcgacggcggctccggcccgggcccgccgctctcctccccccgacgcccggagccgccctgactttccgggcgggggggcgaggcagagggggaggggaaggcggcggcggggagcggctgctttttcttctctttcgggccctttcccggccttgctccgcaccgacggggcccgagcacggctggagaccgcagcccggccgggagggcgggcgggcgggggcagagagtgaaaccgcccccccgccccgcacaaacaagcaccgccgtctgcagcccgaacccgcacccaggccgccacccccggccgcctctttccagccggggagcgcgcttcagccgccccccgcgccgccgcggcgagacgagtcggcttcgctacggtgctcggttctcccgccggctcggcgagcggtggcggcggtggcggcggcactgggaaaatggcggccgagctccttttccctccccccctttaatctgaagcggagggagaatggagcgagcgagcaagcgggcgagcgccggggacacggggaggagggacagcagcgcctccgccggctgcggctgcggcggcgaagggccgctccaccccggcgcgccgccagggggcgcccgccgcgccgcccccgcgggccgccaggaggcgcggccgccgccgcctcagtcatggctcctcgccgtggccgatgtttttgtacctccatctgcggaggccgcggcgcccggccccagctgccccggacgtgcggcgacggcacgcagcactgcggcagggggaagccagccctcgctgcggccgaggtgagtctaacctgaggcactgacgccgtcacatgccctccgtgctggggccggcggtgcggctcgccagttgaggggcagggcgggccggcgccgcggagcgagaggacgtgagcgaggaactgtttgcactgtgtagtaaagagggtaaggccgtcggcaccacactattccaaggctaaccctgcagaaagctccctgaccagtgaagcggcttccgccgcccgccctttgtccctagcagccagcctccgtatactgcagcacggctgggcactagccccagcaccgcgctccgcagccaccagagttgggcggggtggggagggtgcacgtagtcactgcgcaggccccagccagggcccgcgccgggccagcccgggaagggacagccgggagccagaggggaagtgatggccccgccggcgccgggcccgctgggaactgtagttttcgtgaagaaacacgcgtcttgttttgggtgtcatggcttggcagatccgccaaaacaggcaaatggcattacacaatgagtatttatgcttcctgccgccaccaaaaggaagttcactgccatgctaaaagtttaacaaagaactccataaagaaacacaagtctcacaacaaaaagccaacttcccacctcgttaccagagttggtttaaagtggtggcaccttatcatttctcatgaccagtttatcagtacagaactttatattgtccccaaaataggacctttaaaataatggaacctttcctagacttaaagaattcataaacataatgtaatacaaagtgtcacacaaagtgtaattctaccaccctttaaagttgccaaaagatgagtggagtatcttgagatttaaaagactaatctaggattcatcaaaactggcttaaatgactgaagaaaaaatcgttcaaatcattaaatcatcaaattcggcagataagaagggtatgtatgctctactaccaaaaaggaagacgcaaaatgcttcacacttttttgtggcttaccagaaccaatatccggcattatacgtcacttctgcttatcaaaaaacaccctcacagtcgttacagaacggttttagtcttcccacaaagttacactaactcacctgcccctgcaacatctgcacctaggtttctgcgaatttccatttgtactcctaaaatcacactctcaagcatagtcatagttctcaaataccaaaggcaggcagtttggagtcatagggtcaaattacacaaagaataaactaatatttgtatacacatccaaaagaggtctttagtcttggatttttaatttacaaccctggggaaaaactttgacttttttattgtacacacatacacacataaatagtaattccacaaaatacagtagaagggtattggaccaacagatggcgaactagagccccaatctgaggctcctgaaatctaaattagcagaatgaaaaataccaaataaggcaaagccctttgcagcgtatacttaaatattaaattcagacacaccataacaaaataatcttactgctgctccaaatttttaagactgaactgtcagatttaattaggcaaccaaataagcaagattatatgaaatatatttttctaatggattaggagaaaactggaaaatgctcatttttaaaaccatgtatttgggggaactataaattccagtttcccctttctctcattgcttagtgcaagagtcaagagttcacagggtttatggcacttaaatcagtcaacctgttgtatattcttatctaaaatcagacatctttcttattaggcatccacttgtacttttatttttttgacagggtcctgctcggttgcccaggctagagtgcagtggtgcaatcaaactcactgcagcctcccaggctcaggcgatcctacctcagcctcttgagtagctggcactacaggcatatgccaccatgcccagctgttatttttttcactcctttttgttttggtagatacagagtctccctatgttgcccaggctggtctcgaactcctggactcgagtgctggcattacaggcatgagccaccacacaaaaatcttatgaagagaaacaaattttcttaaatttccccccaaaaaatagtggatgtccaaaaggctgattgaaaacacctacatacaaaataaaacaaacaaacaaaaaaagatttaaagaaaaaggcctggtgcagcagctcactcctgtaatcccagcactttgggagggtgaggtgggaggatcacttgagctccggagttagagaccagcctgggcaacagagtgagaccctatctctacaaacaaaattttaaattagccaagtgtggtagcatgtgcttacagtcccagctactccagaagctgaggggattgcttgagcctgggaggtcaaggctgcagtgagtcatgatcatgccattgtagtccaacctgggcaacagagcgagaccatctcaaaatgaaaagtgataaaaaaataaaaacaccaacatatttcaaatcactcttggaatagtcatgttgactctccaatatccactctattctgattagttttaacccattctctttgccaatgattggttaggaatggccatgagatgtgagtagaagccccctggacagcctccaaaagagaactgtgagaaaaggttcttcaatcctaaaaatgatggaggaaaaaacagtccctcttcctcagacagtgacacctcaaactgctacagtcacctttgcagcaagcctgaagatgccaccaacatcaaagggaatagagagttggtccttggtgatagcattaagccactgtatcaaccaatcctgacaatttgtatgacttctggatttccagccacattacaacaatgtaacaataaacatttattaattgcttaagccaatttgagttaggttccttatataataaatgaagtcaaaaaacaatgattgagttctaatgttttttagtatttgtatcttactttatgattacagtattttatataactaatcttattatttcttcctcagaaaagacattccatggccaggcatggtggctcacacctataatcccagcactttgagaggccaatgtgagagtattgcttgagcccaggagtttgagaacagcccagggaaaacagcaaaacttcatctcttcaaaaaataaataataaaaaaatttagccgggggtggtggcatacacctgtagtccaagctactcagaggctcaggcaggaggatcacttgagcccaggaggtcaaggctgcagtgaaccatgatcacgccactgcaaaccagcctgggcaacagagcaacaccccgtctccaaaaaaagaaaaagaaaggaagggaggaaggaaagaaagaaaaaaggaaaaggtgttccctcttacacacagctctgtatccatccatctttgtctgtgttctctctacctagaaaaagaggaccatccctcattaccaccattccttgttaattcctctctccaatccacctacaactcatgttatcctcttatattccaccacaccactgttatcgtctactcacttcacttgacaataatgtaggctgggcgtggtggctcatgcctgtaatcccagcactctggaaggccaaggcaggcagatcacctgaggccaggaattcgagaccagcctggccaacatggtgaaaccccgcctctactaaaaatacaaaaagtagccaagcatggtggtgcacgcctgtagttccagctactcgggaggctgaggcatgagaatcacttgagcccggaaggcagaggttgcagtgagccaagatcacaccactgcactccagcctacgcgacagaaggagactgtgtctcaaaaaaagaaccaataatgtacagagttggcactacattacccttggttaaatgctgtctgtaattcctctgagtttgttttcatataccagtcttgccacctcaagccagcctgaaagcccttgcaggcaggaactgtggttgttctaatttaagatctgtaactcatctatagataataaacgtattccaaaaaggcactctctaccttccctgccacagaccttctaaacaagccagaaattcctaaacagaataatctcacaaattcagtacctcgtatgtccaaactaatctcaaaaggacaatgaataactttttttgcacttaagaaaaagcaattattatatattaactcaggacaagttctaaagcctaggccatttagtttcaaaagcacaggggcccatttttttggttacttacctaggacctagcccagggcctggcacaaaagagacacatcataagaactgactgaataaatgaaaaaggtagagtgtagtacttaagcacacaggacctaggtagcccgattctaatcctgcctccctcacttattctttgtgttactttgggcaaagtacgtattctgctctgtaaaatggagatagtaataccacctacctcttaagtttaactattattattagtgaatgaagctattttccacagttctaaactttaaaggttaaaatctgagtgaagcaaaaatcagcacctctttcctaattcaaacttcaaacacctatctacttaggacttggacctactttaattaaaaaaaaaaaaaaaaaaaaaaaaaaagcctggatgtggtgactcacacctgtaattctagcactttgggagaccgaagcaagtggatcacctgaggcctggagtctgagaccagcctgggcaacatggtgaaaccctgtctcaactaaaaatacaaaaattagcctggcattgtggcacatgcctatagtcctagctacttgggaggctgaggcaggagaatcgcttgaacccacaaggtggaggatgcagtgagccaagatcgcaccactgcactccaacctgagtgacagagcgggactctgtttcaaaaacaaaatccctgtctagactctagcaaacaatgttttcattcatgaacttagataacactatatataaaaatacttttagctccctaaaaacatattctgagaatgattatttacaatcataaatctaatgccacattaaatacttcaaatacatttaattcaacaaaaatctagtgagtacctattaagctcaagaatttattctagatatcacagaaatgaacacataaacctatgtaaaaacccatattaaaattataaaagaaacatctttaagctgaaactgaggcatgttctcacattaatatttaaccagctaaatattaaatagccagagtcaactaaaccaaagttaagaaatttaagtcaaaaaatttaggatgtagaaggaatatgttcagccgccacattttattagtgtgaaaatgaggccaacagaaagaagccagttaagagattgccaaagcgtcaaagctggaatcagggtctctcagtcttcaattctcacttttcccacttctaattcaccagtgctactcaattggtgaactggatgtgcaaacatgctaaaggcattaaacctaaaccatactacctatttcacagtgtcacaagtataaagatttagccaaatgcaagtagaagaaaatcctcatactgattacaatgactacaaagctcagaaatcaagattttttttcattaaatggaggccttagctgattcaaaatatcatacagtatttttatgtactgactgaatccagtagaaacaaactttcagtaagattaaacaaaagcatttcataaatggcaaagtattacaagaatgcatagcattccttcatttcaatccaacctaacaagatattttcctcctcatactactgatacaaactgcaggatttacataaagatattattttgccatctcaccacagaactgacccaataattcatacaaaagaaaaactaattattaggcagcctcctaatttaactgtgttagtaatgagaacaatactgttgtaggttaaacctaaatgtactagtaagtctagaaataatttactttaggataattcagaagacaacattaaagctcagctgaatacaattatatcactgaaagaaacaagtcaggttctctcaggccatcagctattgttaaaatctaacacccaagattgttggtcttctccacagtggtggatttaatagcagctaccagcactcatttctagtgcaagcagtttaagcaggattttatacgaacattttaataaagttcctcaatgagtttacacacacacacacacacacacacacaccctgattattttggtgaattttagttaattctaatgtttttaactttagaatattttaaaattctcaaataactagaatgtgtgaacgttcaatgaccaaacatagaaggagtattctaatatactgattttgcagattaagcaatctacgcaggacccaaactttttatcagataataaagctgagtgtcagaatttggccaaaatgtaccaagaaactacctgagttcttttccaaaggaaacataaaggtaaatatgcagaacttcaaggcagctgtgagcagccaagttgtggagggcctgacaaaagtgagtcagaagggaaaatgttcaaagagaaaaggaggcagcaggtgtacaaggcaaaacacaccttaaaaaatatctttacaggctgggtgcggtagctcatgcctgtaatcccagcactttgggaggccaaggtgggcagatcacgagatccggagatcgagaccatcctggccaacgtggtgaaactccgtctctactaaaaatacaaaaaattagctgggcatggtggggggcacccgtagtcccagctactcgggaggctgaggcagcagaatggcatgaacctgggaggcggagcttgcagcgagcggagatcacgccagtgcactccagcctgggcgacagagcgaaactctgtctcaaaatatatatatatatatatttttctttttacgtcagttgctgattctaagttatgatgcaacttgtaaaatcttgttctgatggcatggcaaacctagggactttggaagatggcagacctgtttcctccaatgaagcagcataccattcttggaaagggaattactttttttttttttgagacacagtctcactctgctgcccaggctgccaggctggagtgcatggcaaaatctgggctcaccgcaacctccacctcctgggttcaagcgattctcctacctcagctgcccaagtaggtgggactacaggcgcgtaccaccatgcccggctaatctttgtatttttagtagagacggagtttcgccatgttggtcaggctggtctcaaaatcctgacctcaggtgatccgcccatctcagcctcccaaagtactgggattacaggcgtgagccaccacgcccagcctagaacattatttttaacccactaattcttggattcttgaacttgtttctatgtacactcaggaacatacagctacaaacggggagtaaccaaagccactgaatatatgcaggagcaacttttttggagtatcaatttaatcaaggattatagtaaaatcagatatacttttgttaaaataaacacaaatatattacaggttgaccatccctaatctgaaaattcaaaaccctccaaaatctgaaactttttgagtgccaacatgacacctcaaatggaaaattccacacgtgacacctttgcttctgatggttctctgaaccatcagaaacactgtttatttcaagaacaaaattattttaaattttgtataaaactggtcggttgtggtagctcatgcctgtaatcctaacactttgggagaccaagatgggaggatcatttgagccctggagttcaaaaccagcctgggcaacatagtgagaccctatctctgaaaaaaaaaaaaaaattaagtccaggtacagtggctcaggcctgtaatcccaacactggaaagccatggcaggtgaatcacttgagctctggagttcaagaccggcctgggcaatgtagcaaaacctatctctaccaaaaacacaaaaaattagccaggcatggtggcatgcacctgtagtcccagctacacaggaagccaaggtgggagaatcacttgagcctggaaggtggaggctacagtgagcagagatggcgctactgcactccaacctgagtaacagaatcagaccccatctcaaacaaacaaaaaaattagctgggcttggcaccgtgcatctgtaccagttagtaccagctacctgggaggctgaggcaggagaatgacttgagcccaggagttctaggctgctgtgagctaggatcacattactgcactccagcctgggcaacagtatgagacatcatctcttaaagaaaaaggtaaaaaaaagaaattatcttcaggctatgtgcataatgtgtacatgaaacatagaatttcatgtttagatttggatcccatctccaagatagtacattatgtacatgcaaacatcccaaaatctgaaaaatctgaaatccaaaaaacttctggtcccaagcatttcggataagggatattcaatgtatacagagcaaaaggcagaattctcactgtttcaagatagaaaaggagtcctcagagagatatgtcctgcttgtaacaaacagctccaaacagccctagaccctgaaaagtactttaaggaaagataaagaggtactggtttagaccatttatagataaatatgcatggctaaaacccctgaatgtaatccttccaggcagaagataaaacctgaaatctaacgtataaattgtcatgggtacaatattataaaagagaccataagttaccgagaacatgactggaattcaggaaatgctaaaggtcctgtcttatctctgtaactcatttacaaagaaatcatgtatgattttctcaactgcaatcttttttgtttctgaattagactgacaaaaattatagaatataatattcaatattttccaccatattccaaattctcactatcacatttaaacacaattttatctaatgaaatgtgtcccaaatgaaccaactttaaccagcatcagaaaaaataaaataaaatagttaaatgaaactgtatcttctttggtataagaagtccttcaggccagacgtggtggctcacatctctaatactagcactttgggaggccgaggccagtggtttgctagaactcaggagttcgagaccagcctgggcaacatggtgaaaacccgtctctactaaaatacaaaaaattagccaggcgtggtggcatgcgcctgtagtcccagctactcgggaggctgaagcaggagaattgcttgaacccagcgggaggtagaggttgcagtgtcagtgagctgagatcgcgccactgcactccagcctgaacgacagagcagactccgtctcaaaaaaaaagaaagaaatccttcagcacagagggtaggaaaaaacaactactcacacttcccagaatacctaccgtggcaataccaaaatatgaccatgcttgttaatatttgggctacggcattaaatgtttataacataacacaaacacttgtaatccaaatgtgaatgattatcttcaattttcagtaaaataagaccctataaaagccctaccattaatacatattcattcataaacatactgagtaccagtggatgttaaacactgtagaatctctaaggaaagaatactcggtcactttataagctatgtggtagtcaagaaaaatcctttctactcattgatacgttaaatgatcaaaaaatccaaagctaaaaaatgatcagagaacaatgaaaaaattttagtggctttatgcttccaattccattttcttctggactcttttctgaagcttgcctaaatcatcccaggaatgctaaaattgggtgttatttatggcataaccaaaatgaaataacaaagtaagtaccccaaataaaactaggagaaaaaatccagggaaccaagcaggcagtaaggatctaaagttctatacttggaacctctaccctgaatgttaaataatagatgttttttaaatagttgactaccaagtgtggtggcatgtgcctgtaatcctagctacttgggaggctgaggtggagagactacttgagcctaggagttctagactagtctggacaaatagcaagaccctgtctcacgggtaggggagcaggggaaggcaaccaagctgggtgtgccatgtgcctctagtcccagctacttgggaggctgagacaggaggagtgcttgaaaccataggccactgtactccagcctaggcaacataggaagaccctatctctaaaacaaacataaacaaaaaggccgggtgtggtggctcacacctgtaatcccagcacttgaggaggctgagttgggaggatcacttgaggtcaggagttcgagaccagcctggccaacatgataaaatttttgtatctttagtctctactaaaaacaaaaattagctgagtgtggtggcaggggcctgtaatcctagctacttgggaggctgaggcataagaatcatttgaacctgggaagtggaggttgcagtgagcggagatcacaccactgcactccagcctgggtaacagagcaagactctatctcaaaaaaacaaacagttatatctttaattattatcttcattcagtaattaggcaattagaatttacaattgctaaatgaatgttcaaagttcaaccaaaattagtccaagatgaagccaagaacacatctcaactcattcaataaagccattattactctgatgccaaaaccagacatagatatcacaagacaactacagaccaatatatcttatgaatacagatgtaaaagtcctcaacaaagcaaaatgaatccagcaacatattaaaaggcttatacaccattgctaagtatgacttaatcccagggattcaaggttggcttaacttctgaaaatcaattaatgtaatacaccatattaataaaggatacaaaccacatgatcatttgaatagatgcagaaaaagcacttaacaaaatccaacatgctttcatgataaaaacactcaacaaagtagaaattgaagaaaacatcttcaatctaataaaaaatacctatgggggaaaaaaagaatacctacaaaaaccccatagctaaaatcatacttaatggagaaagcctgaatgctttctccctcaggtcaagaacaaaacaaggatatccactcttaccactctgtttaacactgcactgaaggttatggccagggcaaataggcaagaaaaagaaataaaaatcactcaggcttaaaaaaaagaaggaaaactacctttatttgcagatgatataatcttgtatatagaaaatcctaagaaaatcccacaaataaactattagagccaataaacacatccaacacagttacaggatacaagctcaatatacaagtagtaatcgtatttctatacacaagcaataagcaatctgaacatgaaaagtttttaaaaattccacttacaatagcatccccccgccaaaaaaaaaagacttagaaagccaagcacgatggctcacacctgtaatcccagcactttgggaggccgaggcaggcggatcacttgaggtcaggagttcaagactagcctagccaacgtggtgaaaccccgtctctactaaaatataaaaattagttgggtgtggtggcaggtgcctgtaatcccagctactcaggaggctgaggcagtggaatcacttgaacccaggaggcggaggttgcaatgagccgagatcacaccactgtactttagcctaggtgacagaatgagacactgtctcaaaaaaaaaaaaaaaaaagacttagaaataaatttaacaaaagcagtgacaatcttatactctgagatatataaaaattacaaaagaagttacagaaatcctaactaaatggaaaggccaggtgtgatggctcacacctgtaatcccagcactttggtagactgaagtgggtgggctgcttgagcgcagaagttcaggatcagactaggcaacatggcaagaactcatctctacaaaaatacaaaaatgagctagatgtggtggcatgcacctgtaatcctagctgcttggggggctgaggagggaagatcacttgagcctagtaggttacagctgcagtgagccatgattgcattactgtacttcactgcagcctggatgacagaacaagactgtgtcccccaaaaaaaaaaaaaaaaaaaaaaggaaagatatcccatgttcatggatgagaatggatcagaagatacaactctgttaaaatggcaatattccctaaattgatctacagaatcaatgtgatcccagcatacccaaaagaaatttgaataggaaaaacaaagttgggggactcacacttcctgatttgaaaacataattcaaagctatggaaatcaagacagtgtggtagtggcataaggataaacatacagatcaatggaatataagtgtgggttcagaaataaacctttacactgacagtcaattgattttatgacaaaaatgccaagacaattcagtggaggaaagaatggtctttttaagccaagtgctgtagctgacacctataatcccagcatttggggaggctgagacaggaggattgcttgaggccaggagtttgagactagccagggcaacaaagcaagacccccatctctacaagaaacaaacaatggtcttttcaacaaaccatgctgggacaactgaatattcacatgcagtagaatgaagctggaccactatatctcacaccatacacaaaaattaattctaattaaatttaaacacggattatagacctaaatgtaacagctaaaacaataaaattcctagaagaaaacaaagctaatcttcatttcatttggtggcctgacatcaaaaccacatgcaacaaaggaaaaaacaagtaaatttggcttcatcagaattataacattttgtacattaaaggacaccatcaagaaattgaaaacacaacccatagatgggagaaaatatttgcaaatcatgtatctcacaagggatttgtatctagtatatttaaagaactcttacaactcaacaataaaaagagaatccaattttaaaatgggcaaaggctgagcatggtggctcacaccagaaggagaggatcccttgaggcaaggattctgagacctgccagagcaatatagcaagaccctgtctctacaaaataaattaataataataaaaaaaaacaattagccaggcatggtggcacacacctgtagtcctagctactcaggagcttgaggcagaaggaacccttgagtccaggagtttgaagttccagaaactatgattgggccgggtgcggtggctcacgcctgtaatcctagcactttgggagtccaaggcgggtggatcatgaggtcaggagttcaagaccaacctggccaagatggtgaaaccccatctctactaaaaatacaaaaattagctgggcgtggtggtgggtgcctctaatcccagctacttgggaggctgaggcagagaatcacttgaacccaggaggcagagattgcagtgagccaagatagtgccactgaactccagcctgggtgacagagcaagactccatctccaaaaaaaaaaaaaaagaaaagaaaactgcgattggccactgcactctagccagagtgacagagcaagacctagcctaaaaaacaatagtgtataaaaataaaattaaaatgtgcagagaatttaaatagacatttctccaaagaagatatatgaatggccaataagcacatgaaaagatctcatcaggttgagcacaggggatcaggcctgtaatcccaacactttgggaggccaaggtgcggggactgcttgagctcaggagtttgagaccagcctgggcaacatggtaaaaccccatctctacaaaaaatacaaaaaggccaggtacagtggctcatgcctttaatcccagcactttgggaggctgaggcgggtggatcacctgatgtcaagagtttgagaccagcctggccaacatggtgaaaccccgtctctactaaaaagacaaaaattagccaggtgtgatggtaggcgcctgtaataccagctactggggaagctgaggcaggagaatcacttgaacctaggaggcggaggttacagtgagccaagatcacaccactgcactccaacctgggtgaaaggcaaaaatccgtctcaaaaaaaaaaaaagtttcaaagataaaacaaaaatcttgttaaagataaatacacgagatgctaaagaaataatctacttcttcaagtcatgctatcaatttgcaccaaaattttcatttcctatgtgtaggtgttgagggtcttgtacccatgataaatgacatacacctgttctgggctgacttttgttccccaaaagagatatatagtactccaaggggctgggcacagtggcacatgcctgtaatcccagcactttggaaggtcaaggccacagcatcgcttgagctcaggaattcaatatcagcctgggcaacatggcaagaccccggctctactaaaaatataaaaaaatagccaggtgtggcagtgcacacctgtagtcccagctacccgggaagctgagatgggaggattgcttgagcctggggtttagggggctggaggttgcagtgatccaagtgccactgcactctagcctggatgacagagggagaccctgtctcaaaaaaaaaaaaaaaaaaaaagatatgtagtactcctaacattcagcacctcagaacctgatcttagagacaggatcttcaggccaggtggcttcccttcctctccgcgtcagtctgtcccacctcagctcagcccaccggagacagagggtgcaggaacctggaggcggaggttgcaggaagccgagatcctgcaactgcactccagcctgggcgacacagcaagactccgtctcaaaaaaaaaaaaaaaaccttacaacaaaatgatgcagcccgggcgcagtggctcacgcctgtaatcccagcactttgggaggccgagtggggcggatcatttgaggtcaggagttcgagaccagcctggccaacatggtgaaatcctatctcaactaaaaaaaaaccaaaaactacagaaattagccaggcgtgatggcgcatgcctgcagtctcagctgcttgggaggctgaggcaggagaattgcttgaacccgggagtcggaggttgcagtgagccaagattgcgccgattgcactccagcctgagtgacaagagcaaaactccatctcaaaaaaaaaagaaaatgcaaagtcacctaagagacagtttaaatacataaaaagctcgatgccaaataaaactggatgggtcacttgataagtgggattgataaaaagcaagacagctgatattatataattcttatttgcttcgatatttactggggaaggtagaggggaaaagctatctaaattactcttaataagcatacaaatctctaatagtgaatcaaatgcatcattaaatatactaaattcctcaaactgatatgtcagatgtcaggtagtcatgaagacccaaaatagtctccatgggttttttgttgttgtttttttgagacagagtctcactctgttgcccaggctggagtgcagtggcaccatctcgactcactgcaacctctgtctcccgggttcaagccattctcccacctcagcctcccaagtagctgggattacaggcatgtgccaccacatttggctgatttttgtatttttagtagagacagggtttcactatgttacccaggctgttctcaaactcctgacctcaagtgattcacccaactcggcctcccaaagtgctgggatttcaggtgtgagccaccacgaccagccccttctctgtgttttaaaggcatttaagtataaattattaaactgcaggacagaacatattagctgacggtcatatgagtgaccttctctaaatgccaggaggatagaatccacttttcctttatcaatattttccttgctcaacttctgacatattaggtactcaataagtatgtgctgaaccaaaacgaacaaaaaaatgctgtcatcaaagtaacttccatctactcaagtaggctgcaacttcaaactgcccaaactagcaaatctctaataaagatgggctcagaagacatatcagcatgaataaccttctgaggaaaagacaacatggattctaaaagtggacatcacaccacaccagttcacccaaattctctgagaaaataaatatgtgtggctgggtgacggtggctcatgcctgtaatcccagcactttgggaggctgaggcgggtggatcatgaggtcaggagatcgagaccatcctagccaacatggtgaaaccccaactctactaaaaatacaaaaattagctgggtgtggtggtgagcacctgtagtcatagctactcgggaggctgaggcaggagaaacgcttgaacccgggaggcggaggttgtagtgagccgagatcgcaccactgcactccagcctgggcaacagagtgagactctgtctcaaaaaaaaaaaaaaaaaaaaaaaaaaaaaagacctgagtggccacaggatgagaacatttactgtagactggacataactgagacacagaaaattataggtagatgctgaggtacttccccaaatgaagaagtaaaaacagaagattgaaaatttttttagaaatgctatatttaacattttaatatattgtacaaaaaatatacagagaattccccattttgcagatgggatgatgagattcctaataatgaaataccacacgagttggaaaaataagggaacggagtgatggaaagggtttctaaatatattaaatgagaaacatttgcaaaaactaagatttatattcagcttagagaatgctttggcaagtataaaagctgtctaaatatgtgaagggttatctagcagaagacaaaccagacttgctctaagcagttcccgtgtagacaaaattgggcccaaagtggcaattccagaagggcacgcttcaactcaagctttctaaccatcagacctaactaaaaaggtggttcttaccttggattacctctaagagcccactgagatatgagtgttaaaaaattacatgcgaggaaatggcaggtatgttacagcatggacaaatgaaaagtaaggcatttacaggaaaaaaaatctaagctatacttaaaagactcatgccttcaagtcaaaaaaggaatttttgaataattatagaatattccctaaagacaatgtgatgttctatgcaaaaaaaaaaaaaaaaaaagggagggagggaggaccaaatcctattaggaaaaaactgtaaatcaagggtacccaatcgtttggcttccctgagccacactggaagaagagctgtcttgggccacacataaaatacactaaagtaacaatagctgatgagctaaaaaagaaaatcttaaaaaaaatctcataatgttttaagaaagtttacagatttgtgttgggccacattcaaagctgtcctgggccgcatgcagcctgtgggccatgggtcggacaagcttgctgtaaatagaacatattttcttatccttctaccaaatcacagtgtagttataactaaaatgcagttctgagtagttatcataaatccagaaagggaaagcaatgctgacaaagatcctggaaggaggtttcactggagattaaattaaaaagtcaagcatcttcagttgagaaacatgaaagcaaaggggcaatgtgatcaaaatcagaaaacgtatcaatatggtaaatactaatttattcaccttttatgcttgaaaagtatttctttatataacagataaaagaaacttgtggattgtgttaccacaatctacaagttaaaaatagattcaagtgctcggataaatgtaggtatattaggtccattcaggtcctacaggatagaagtgctatcagacgtgaggccctaaatttctgaggttaacatcttaacagataacaatgtttcacctgaaaacatcacttggtgccaatttagacagaacaattggttggacagaccccggacagacagactcaaggaggctggttggtatagacttccttccattcttttacctcagtatgtatgtgtgtgtaatatatacatacatattatactagaacatatatacattccttatctttatacacttagaatgctccttatatagctctgcaccctgaatttttcatttatcatttactcaacatcctaagacattaaaaattctttttttttttttagacagagacttgctctgtcaacaggctggagtgcagtggcaccatctcagctcactgcaacctccaactccctggtccaagcaattctcctgcctcagcctcctgagtagctgggatttcaggcacgtgccaccacgcccagctaatttttgtatttttagtagagatggggtttcaccatgttggccaggatggtctcgatctcctgacctcataatccgcccacctcggcctcctgaagtgctggaattacgggcatgagccaccgcacccggccagaaaaattctttcaaatactattccatggttgtaaatgtccatccttaaatataccatgatttattttcctataaatcttgctgctcatttaggtttattctcaattctcactaatatgaataatgttacaatgaacatctttgttcacaaatctttctatgtatcttaatttttcccctttaggataaattcctagatgtgcaattactgaattaaagaacgtttttaattttgccaatatatgttgccaaaatatctttcaaaaaaactaggcccaatgcacactccactagcagtttcagagattgtcccctcaccaccttcgacagcacagtcaactgtaaatctgataggttaaaaaaagagtatgtcatttaatctgcattcctttgattacttatcaggataaaaatgtttctcatatgcttcttggtcatttgtatttcttccttatgaactctgatcatgttctttgccagcaaaacttttctttctcttggccgacaaactttctgtggaaaaccagctgagatggaatcatttaaatatcagcaactgcagctccccctgctgacagataaattaccaccaccatcaagtgcccagtaaaaaaaagtgagctagaaccatacgcttgcctgtcttctgggctgctgctacaaatacaaattatacacggtaataaaaaagaaaatactgtgtatctaaactcatacttaacagagctgtgatggagaaggcaagggggacaagcgttttatttgttttttgttgttgttgttgttgttgttgttttttgagacggagtctcgctctgtggcccaggctggagagtagtggcgtgatctcagctcactgcaagctccgcctgctgggttcacaccattctcctgccacagcctcccgagtagctgggactacaggcacccaacaccacgcccggctaattttttttttttttttttttttagtagagacggggtttcaccatgttagccaggatggtcttgatctcctgacctcatgatgggcccgcctcggcctcccaaagtgctgggattacaggcgtgagccaccgtgcccggcccaaacgttttctaatgtgcaggaactaggcggggtgcagtggctcacacctgtaatcccagtactttgtggaggccgaggtgggtggatcacctgaggtcaggagttcaagaccagcctggccaacatggtgaaaccctgtctctactaaaaatataacaatcagccgggtgtggtggcacgtgcctgtagtccgagatactcaggaggctgaggaacgaggattgcttgaacccaggaggtggaggttgcagtgagccgagactgcgccactgcactccagcctgggcaacagagtgagactccatttaaaaaaaaaaaaactaatatgcaagaactaatgtcacaaacaattctaaaaatcaattccctgccaaatatactacctggcacatataaacatcacagacctaaatattcatttccctatactttaactatgtgaaaacactctaaattaccaaatgacactgggtggtcagcaaactagttctctttttccaaaagcaaaaacaacaaaaacacttttgccctttagcattcaaagaaagagtattaaaaatcttaattcttggcaatccttattccaaagttgcttgcacttatcagactgggaccaatagatccaaagagtaaggccaagactggcaaatgcatgtgactctcagcttttccactgataccctcctaaagatgcatgtcccaagtccagcaatacagtctttaacactcatttactaagtgccatcaagagcaagcagtgatggccgggtatggtggctcacgcctgtaatgccagcactttgggaggctgaggggggtggatcacctgaggtcaggagttcgcaaccagcctgaccaacatggtgacaccctgtctctactaaaaatacaaaaattagctgggcgtggtggcaggcacctgtaatcccagctatttgggaggctgaggcaggagaatcacttcaacctgggaggcagaggttgcagtgagccgagatcgcgccgttgcgctccagcctgggcaacaaagagcgaaattccgtctcaaaaaaaaaagaaacaaaaacagcaagcagtgaggataaaagacaagagcaagtcctcactctcaaagaacctagacactagctgggttcaaagtggagcaaactagcaatcagtacaatagaagtgctaggtctgcatatgcacactcacatgcacacacactaacagtttcagagattgtccccttaccacctttgacagcacagtcaactgcaaatctgataggtaaaaaatagtatgtcatttaatctgcattcctttgattatttatcagaataaaaatgtttctcatatgcttcttggtcatttgtatttctttatgaactctgatcataaagtgataatacctgggtccagaggaagcactcagtgtcagctactgttattactattatcactactgttattttgttttaaggctaatcaagtgaagcagtgggagtggagaaggaacaaagaaatctgtaactggctgtgatcaattaatagtaaacaccaatatacttggaccagccactactgttattaaagactagggggagtaagtttccagaacagggtagagtccatcttaagcagaggtaactgcttgtgtgaagacccagaggcaaagaacaacagggttcacagaaggaactgggcacaagctatctgtactactgcgtacaggatgctcaggaagaagtggagagatgatctggcaaaacatttcaactctaccttcaaagctagttgagccatggtggaagagggagggatatgatcatacgcttgaacatgcattttacaaggatcatgttggcagcgacttggaagagagaaagcagtcaaggagaatgattacaagacaacagaaggtcacgcagccaaaagggcgatgaaggtctggactcaaaaaggagaagtaggatgactaggaaaatattatgagctaggatctcaagaatgtggtgactagaatggcacaagaaggaacccagaggcctctcaaatccctgatttgagtgactggctgggtgacactaccgctcactaagatacgaagataggaagaggttggactggggaagtggataagatcattttaaaatgcccataagatggccagatgcagtggctcacgcctgtaatcccagcactttgggaggctgaggcaggtggatcacctgaggtcaggagttcaagcccagcctggccaacatggtgaaaccccatctctactaaaaatacaaaaactggccggacgtggtggcgcacacctgtaatcccagctacccggaggctgaggcaagagagtcgctggaacctgggaggcagaggctgccgtgagccgagaccgtgccactgcactccagcctgggggatagagcgagactccgtctcaatagtaataataataataaaaaaataaaataaaatgcccataggacatccaagtagagatgtccaggaagcaactgtgtatatgggattggagatcagaaaactagtcagagctggaaaaacacacatttgcaaatcatcggcatatagacggcaagtgaggcacaagtttatctaaggcattcctcataaactgcacagggtgagaggaagaagggtcaagggaaggcaaatactaatgtttttaggagcaaaagaggaaaaaagtctgcaaagaaaaccaagagtatgggccagacttggtgactcacacactttgggaggccgaggcaggtggatcacctgagatcaggagttcgagaccagcctggccaacatggtgaaacccatctctactaaaactacaaaaattagccagatgtggtggcgggcacctgtaatcccagctactggggaaactgaggcaggagaattgcttgaacccaggagacggaggttgcagtgagccgagatcacgccactgcactccagcctgggcaaaagagcaagactccgtctcaaaaaaaaaaaaaaaaaagtttcaaagataaaacaaaaatcttgttaaagataaatacatgagaagctaaataaataatctacttctttaagtcatgctatcaatttgcaccaaaattttcatttcctatgtgtaggtgtcgagggtctagtacccatgataaatgatatacacctgttctgggctgaattgtgttccccaaaagagatatgtagtactccaggggcctgggcacagtggcgcattcctgtaatcctagcactttgggaggccaaggccacaggatcgcttgagctcaggagttcaatatcagcctgggcaacatggcaagaccccatctctactaaaaatatttaaaaatagccagatgtggtagtgtgcacctgtagtcccagctactcaggaagctgaggtgggaggattacttgagtccaggggttagggggctggaggttgcagtgatccaagtgccactgcactccagcctgaatgacaaagggagaccctgtctcaaaaaaaaaaaaaaaaaaaaagagatatgtagtactcctaacattcagtacctcagaatgtgatcttagagacgggatcttcagaccaggtgcagtggctcacgcctgcaatctcagcactttaagaggccgaggtgggtggaccacttgaggtcaggagttcgagaccagcctggccaatgtggtgaaaccccatctctaccaaaaatgtaaaaattagctaggcacggtggcgagcacctgtaactccagctacttggaaggctaaggcagaagaatcacttgaacctaggaggaggaggttgcagtaagctgagatcaccccactgtactccagcctgggcaacaaagagagactctaaaaaaaaaaaaagagataggatcttcaaagaggtcataaagttaaaatgaggtcatcagagaggactctaatcccaatatgacttgtccttataaaaaaggggaaattgtggacacaaagaaatacacacagggaggctgggcgccgtggctcacgcctgtaatcccagcactttgggaggctgaggtgggcagatcacttaaggtcaggagtttgagaccagcctgggcaacaaggtgcagccctgtctctacaaaaaatacaaaatttaggctgggtgctgtggctcatgcctgtaatcccagcactttgggaggccaaggcaggcagatcacctgaggtcaggagttcaagaccggcctgggcaacatggtgaaaccctgtttctacaaaaaatacaaaaaattacctgggcatggtgacacgtgactgtaatcccagctacttaggaggctaaggaaggagaatcacctgaacctgagaggcagaggttgcagtgaaccgatattatgccactgcactccagcctgggcaacagagcaagactctgtctaaaaaaacaaaagaaatacacacagggagaactctacataaggactggagttatgctgccaccagaagctagaagagaggcttgaaacagatcctgtcccagttgcttcagagaaagcatgcctctgcccttagatttctagcctccagaacagggagacaataaatttctgttatttaagccactcagcatatgtcactctgtggcagcagccttagcaaacagatgtcataagaaaattcgcagctcaggtttactaagtacctaccaggtgctgttctaaacactctgcgtgaataaactcatttaatccttataaagtccactctaggatctaggtactatcattataccctttttacagtgtggacaccaaggttctaagaggttaatgagcttacccagtatcacatagccagagccctctctctcaccactagtgtatgaggagctattattaacagtaattacaataagagctggcgtggtggctcacgcctgtaatcccagcactttgggaggccaaggcgggtggatcacttgaggccaggagtttgagaccagcctggccaacatagtgaaaccccgtctctactaaaaatagaaaaataagccgggcatgctggcatgcgcctgtaatcccagctacttgagaggctgaggcaggagaattgcttgaactcaggagacacaggttgcagtgagccgagatcgtgccactgaactccagcctgggcgacacagcaagactccatctcaaaaaaaaaaaaaattagtaattacaataagaacagtagtagtccactgaaccaaacactgccctatgtcctttacagatataatacaaaagtcctctgaagtaagtgttattatttccagtatgaaggaggaacctgaatctcagagagattaagaaaatcgcccaaagtcacacggttaagagtgctgagattaggccgggcacggtggctcatgcctgtaatcccagcactttgggaggccgaggcgggtggatcacctgaggtcaggagtttaagaccagcctggccaagctggtgaaaccccatctctactaaaaataaaaaaaaaattagctggccatggtgacaggtgcctgtaatcccagctacttgggaggctgaggcaggagaatcacttgaacccaggaagtggaggttgcagtgagccaagatcacctggacaacaaagcgagactcttgtctcataaaaaaaaaaaaaggaagaagaatgctgagattatatctaattgctaacttaaggggatatacaatgaaaacctgtttttactaaaactttaagaacaagttaattttttttttttctttaatgagacaagagacaaggtctggctctatcacccaggctggactgcaggggcgcaatcacagttcactgcaacctccacctcccaggctcgagccatcctcccacctaggcctctcaagtagctgcaactacaggtgcacaccaccatgcctggctaattttcttttgtatttttagtagagatggggttttgccatgttgcccaggctgttctcaaactcgtgtgctccagcgatctgcctgttcagcctcctaaagtgctaggattacaggcgtgagccatcgcgtctggccaagttaaattttttaatgcctgactttgcagttcaatactagaaatatacatctataaattcaaaattcttgaagatcccaagagaacacatgtcctagattatgggcccttttgcgtgtgtatcccctcaaccactgttcaagaactattctctcggctgggcacggtggcccacgcctgtaatcccagcactttgggaggccgagttgggcggatcatgaggtcaggagatcgagaccatcctggctaacacggtgaaactccgtctctactaaaaatacaaaaaattagccgggcgtggtggcgggcgcctgtggtcccagctactcgggaggctgaggcaggagaatgacatgaacccaggaggcacagtttgcagtgagccgagattgcgccactgcactctagcctaggtgacagagtgaggctccgtctcaaaaaaacaaaaacaaaaacaaaaaaactattctctcagttagaacccttgccatttctctgacttccagacacagaaagagaagaaaaggaaggattgagatgctgttctttaaaatttttttttttttttgagacggagtctccctctgtcgcccagactggagtgcagtggcacgatctcggctcactgtaaactccgcctcccgggttcacgccattctcctgcctcagcctcccaagtagctgcaactacaggcgcctgccaccacgcccagctatttttttgtatttttagtagagacggggtttcaccgtgttagccaggatggtctcgatctcctgacctcatgatccgcccgcctcggcctcccaaagtgctgggattacaggcgtgagccactgcgcccagctaaaattttcaattttctatttaatttttaaaatctgatacaaacatcagaaagtgtaaaaagatataatgcaatgagaagtctccttcctactctgtcctctacctgaacaattcctagacctaacaggtaaccagtgccaccattttcttatttattcttctaaaggtttgtgttgttgctgttgtttgagacagagtctcgcttggtcagccaggctggaggacagcggcgtgatctcagctcactgcaagctccgtctcccgggctcaagcaattctcctgcctcagcctcccaagtagctgggattacaggtgtgtgccaccatgccccagctagtttttatattttcagtagagacggggtttcaccatattggccaggctggtctcagactcctgacctcaggtaatccacccaccttggactcccaaagtgctgggattacacgtgtgagccaccatgcccagccctaaagatcttttttttttttttttgcatacatacaccaatgcaaattatctttttctcctgtttttttttttccaaaaaacacaaagggtatcaaatcatacatactgttctgcatcttgctttcatcacttaactgtctgccttgcagatctttctatatcatattaaattatgttttaattctctcgttttgcttgtcaagaacagtttttacttcatttcaccatagttcagtctagcacacaaggcatccagcagccctaagaactacctgaaacaactgatgatggctccatgctacacactaaagaccctgtatcttttctctcctcctcatcttcatttcactcttttctccgactcactcaattctccttcctttccctattcctctcccatctcacccactccttagccctaaccctgacaactagaccctagtaacatcactgacattgcttagtcgtggctagaaatattcaggctttaaaaaggtacagacccctaacacagagaaaaagggataaataataatttccatgagaacttctaattaacgagagtgccttaaattgaggagttttggcttggagttattcttccttgttacttgcctcctctggcattttcatttgtgaagactgagtgagtgtgacgctattttctatacgcatggaaacaagcacatactcagtctaacatttacgcaatgcctgacagaacgacagagttcattctacaataagataattggaaacaaaatataagatctatataaaataaacatttgggctccaaaatatgcactttaattaacctatcatttctttttacttaaattaagtagctccaatctgaaactacatcttagaaatgttttaaggatattcaccaatgaaaaagagaataaagttccctctccccacttttattttccagcccacaaactcaatgctatcctccccgcaaaaaggacctttttttctgaccagacgaacactgtaatttttaaggtttctaagtaataaaaataggaagaaaacattaccccccaaaattggtttacacttagaagatgtttcccactgagcaaaggattggtaaggaacataatattaaggcaaccacctaactgcattcttaagtagtaacaggtggtaactcacgatatggagctgatttcctttctctattcctgccatgccagagacctctagtagaacttctgaggttactgtattacaacccaggttcagagagatttagaggtaaaaccttaaacactggaaatatctttaaaagtagggctttgtgtaccaaatacattcgttaaaacctaggaaactataaaatgaaatccaatgtattgatctcaatccccttgcctgcttcctaaagaggacagaggccaccaacactggtgctcaacacttgctaagtcgaaacactcttacacaggtcctctgattcttaacgggttcagaacttctggttgcattccccatgcaacccctccaactctacagggagaatgctggaaaaactgtgtcactttggcttcctgtatattaatataagcactcttatccagcaatagcagctgaaacataaatgaagatgagaactcagcctacatgacctaagatttcccacaagtccagatatttaggttacacacactgcactattgtctgatttctcctctgcatcaatctggaagtccacagagcagattagcacccaacaatcttaactaagctagtatcctactctgaagaaaggcgaagctggtggagggtttccaagactccttatccttctctgtccttcctcccatcccctccttacgtcttttctgtttgtttttatttaattttttttttaatgtatttttagtcacaagaaaatcaaagaagccacctacttaagtcttaagctctgccctttgcttagtcctaatggagagttctttggccatctatgtacaagagattagaggagccaaagagactggagaaccacatcaatgggagctttttcatctaaaggtcatctgtccacactgtccaaatgaggtttaccctgtgaaataaaacttggtgtaagtgctacctgctgagaaaaatagtatgaaatgtcacacaaaggactggggtgcagcaggaggactctgaaagagtcatacgtgtaaaccagcaggtcttagaatgccctaatatactatatgaagtttcagagtaaacaaatggttaatgacacatcttttgtaacacatgaatcagctactgatttgcaagagtgggacacaccctagtacctatgactctaaagtacctgtttgaaaagtggacctagatgtttgaattgccaacccatcctaagaccggaacataattttacaactatgtaagttgccataatttaaagttaaaaagatcactgcctttcattataatggaagttaatttgagaacttcattaaaacattcacaccgataatcaaagaacagtagagatacaaagtaaaatatagccaatcaatcctaggaagcaaacacaagaggcaagagaaatggcaggtaaaggaagtgaagaatagcaaattcaaaaactacaatattcccaattctaaagaaaaatgaataaaatgaggctggtaatgaaaaaataacacatcttaccttaagaggcatccaagtagcattcatagtgtcaggatataaagacaatactcagaaatgagcaagaagtcttagtaattccctcggttaccaagtataagcaggtaggaaaatcttttgtttcgagaaggtatctgaaagagaggattttcatttagactaaaaaataatcaagacaatgcaaatagtttaagctacctgggcagggattttgaagtactatttgcctcatcgcactaaaaaagtatagaaaatacagtcccctttagaaaagggcaaatgtgtgtctccatatatatgtgtgtagaaacatactttacataaaaagagaaataaatatgtaacacgtattttagataatgtaaaattgcttatcaaacaattagccaaaatcccagagagaataaagtaattttccagggtacttcataaacactaaacgtgatttgttaactaaccgtctaaagaaagacccttgccacatttaattatatttagtaaagtaaaacttctctaatcatcccgactgtcccaagattatgcttaagtttcagagtcaattccacatgaaaagtaaaacctattcttgactgaagtactagaaacaaataaaagacccttcttccccagagatcgttaaaagcagaccgagcaacttaattttgagggtgggaggaaggtaaatttgcctggaggcaggaggatggactaaatgacctctggtaggatcctcgttcaagtcctgggcctgtatacaattccagcttaaccagttactgcttcgcttaaaatggaggcttgcctgcgtagggacaaaaataacagcacccacttcttaaaaataaatgtcgaaaagtacccctttttaaataaaaataaaaaataaacacctctggagtggatgtgttcttgctatgcgtttgtcactgaggcttcgaagacttggcatcactttccttaccgctcaccggattttgggggaggagcggggggcgacagtttgactcttgacccaagtctcaggcggacttcagagccccacaggggcccccaactccagagccagagggagcggagaggcgagagcccgagatcgcacctccccccaccgcggaccccagtcccaaacccacccctcacctccccgcagtggggcgcctccttctgccccattcccattgttagggagggcagagcgcggggtgggctcagggcaggggcgcccgcggccgttgcccggctcgcttcaggaggggcgccccgcgggatgcggcttcccttcctctccgcgtcggtccgtcccacctcggctcggcctggcgccccgaggtccgctccgcgcccccggccgcggccccggcccgccccccgggcagccaggccctcaggccagtcggccggcagccggcgtcccaggcctacgagtgggcgctgggcgggggtccccgtgccccacacacgcgtcccctctcccccagccccgccgcttccagggccctcggcggcgcccgctccccgggccccgcggccccccgcctcccagccgggccgctccctcgagctcgtcgggtcagggacacctcctctacctcaccatcaccctggcccactcgtgcccccacccccaggggcaccagtgccaaaggcagctcccccagccccggacctacctgcacggttcaaccaagcctagaagtgggggcg

SEQ ID NO: 690 - DNA, 3152 bp, Homo sapiens
cgccaggaggcgcggccgccgccgcctcagtcatggctcctcgccgtggccgatgtttttgtacctccatctgcggaggccgcggcgcccggccccagctgccccggacgtgcggcgacggcacgcagcactgcggcagggggaagccagccctcgctgcggccgaggtgagtctaacctgaggcactgacgccgtcacatgccctccgtgctggggccggcggtgcggctcgccagttgaggggcagggcgggccggcgccgcggagcgagaggacgtgagcgaggaactgtttgcactgtgtagtaaagagggtaaggccgtcggcaccacactattccaaggctaaccctgcagaaagctccctgaccagtgaagcggcttccgccgcccgccctttgtccctagcagccagcctccgtatactgcagcacggctgggcactagccccagcaccgcgctccgcagccaccagagttgggcggggtggggagggtgcacgtagtcactgcgcaggccccagccagggcccgcgccgggccagcccgggaagggacagccgggagccagaggggaagtgatggccccgccggcgccgggcccgctgggaactgtagttttcgtgaagaaacacgcgtcttgttttgggtgtcatggcttggcagatccgccaaaacaggcaaatggcattacacaatgagtatttatgcttcctgccgccaccaaaaggaagttcactgccatgctaaaagtttaacaaagaactccataaagaaacacaagtctcacaacaaaaagccaacttcccacctcgttaccagagttggtttaaagtggtggcaccttatcatttctcatgaccagtttatcagtacagaactttatattgtccccaaaataggacctttaaaataatggaacctttcctagacttaaagaattcataaacataatgtaatacaaagtgtcacacaaagtgtaattctaccaccctttaaagttgccaaaagatgagtggagtatcttgagatttaaaagactaatctaggattcatcaaaactggcttaaatgactgaagaaaaaatcgttcaaatcattaaatcatcaaattcggcagataagaagggtatgtatgctctactaccaaaaaggaagacgcaaaatgcttcacacttttttgtggcttaccagaaccaatatccggcattatacgtcacttctgcttatcaaaaaacaccctcacagtcgttacagaacggttttagtcttcccacaaagttacactaactcacctgcccctgcaacatctgcacctaggtttctgcgaatttccatttgtactcctaaaatcacactctcaagcatagtcatagttctcaaataccaaaggcaggcagtttggagtcatagggtcaaattacacaaagaataaactaatatttgtatacacatccaaaagaggtctttagtcttggatttttaatttacaaccctggggaaaaactttgacttttttattgtacacacatacacacataaatagtaattccacaaaatacagtagaagggtattggaccaacagatggcgaactagagccccaatctgaggctcctgaaatctaaattagcagaatgaaaaataccaaataaggcaaagccctttgcagcgtatacttaaatattaaattcagacacaccataacaaaataatcttactgctgctccaaatttttaagactgaactgtcagatttaattaggcaaccaaataagcaagattatatgaaatatatttttctaatggattaggagaaaactggaaaatgctcatttttaaaaccatgtatttgggggaactataaattccagtttcccctttctctcattgcttagtgcaagagtcaagagttcacagggtttatggcacttaaatcagtcaacctgttgtatattcttatctaaaatcagacatctttcttattaggcatccacttgtacttttatttttttgacagggtcctgctcggttgcccaggctagagtgcagtggtgcaatcaaactcactgcagcctcccaggctcaggcgatcctacctcagcctcttgagtagctggcactacaggcatatgccaccatgcccagctgttatttttttcactcctttttgttttggtagatacagagtctccctatgttgcccaggctggtctcgaactcctggactcgagtgctggcattacaggcatgagccaccacacaaaaatcttatgaagagaaacaaattttcttaaatttccccccaaaaaatagtggatgtccaaaaggctgattgaaaacacctacatacaaaataaaacaaacaaacaaaaaaagatttaaagaaaaaggcctggtgcagcagctcactcctgtaatcccagcactttgggagggtgaggtgggaggatcacttgagctccggagttagagaccagcctgggcaacagagtgagaccctatctctacaaacaaaattttaaattagccaagtgtggtagcatgtgcttacagtcccagctactccagaagctgaggggattgcttgagcctgggaggtcaaggctgcagtgagtcatgatcatgccattgtagtccaacctgggcaacagagcgagaccatctcaaaatgaaaagtgataaaaaaataaaaacaccaacatatttcaaatcactcttggaatagtcatgttgactctccaatatccactctattctgattagttttaacccattctctttgccaatgattggttaggaatggccatgagatgtgagtagaagccccctggacagcctccaaaagagaactgtgagaaaaggttcttcaatcctaaaaatgatggaggaaaaaacagtccctcttcctcagacagtgacacctcaaactgctacagtcacctttgcagcaagcctgaagatgccaccaacatcaaagggaatagagagttggtccttggtgatagcattaagccactgtatcaaccaatcctgacaatttgtatgacttctggatttccagccacattacaacaatgtaacaataaacatttattaattgcttaagccaatttgagttaggttccttatataataaatgaagtcaaaaaacaa

SEQ ID NO: 691 - DNA, 558121 bp, Homo sapiens
tggagaagagaaagcggtgatgcgaagagggggcgggaccagagagtggatggcagaggtgggctgtagagccaaagtggggtgggagcgcgaagatggcagctgctgaggaggagccgaagcccaaaaagctgaaggtggaggcgccgcaagcgctgaggtgagcgctgccggacttggggaggagggtgacggcgctgcaagcaagccagggcccacgtggggttgcacggccccgacgctgggtggtgtctctcactgccagcttggggccaacacgcaggacctcccccagctgcccgcttggccgcgaccccttgccagacgttctctccgtttggctgagtccccgcctgtctggtgcagctccggctccagcagcccttcgccagtcgtggcccgcagggggaccgagctggctgaccgcgccacctgcgagcaagcccaggctgggctggtgcgaccccggagggtcggaccggagcagcgtctgtaggcggccgccttctcttcccgggggatggcgggaaagaggctcggcaactgctgtacactggggcaaagtcagaattcttggggatttttcagagtgttgcggaagggcacgttgaccttccttttcgtgcacattctgaaagcccgtacctttgaggaccctctaccagggacccagacccctccgatgctttgcaggggcagcatttggatgaatggataggaaaggttgatttctcttttttatttacactttttggcagcaacggggacagtgctgcccctaacacctgcctcacatgtgattgatgttgcaacttttacttatgaagagtcatttgttaaaatatcccttcctaataagtataaagtgaagcaggcagtctttgatgatttggaaatgttcgctgaaaggcagcgatttttttttccatcttaaaatagacatatcaaactgatttaaaactattaggacactcctgattaaacaggacatatcccatttcttccagtatcactcttcttcacctccaaaggaaggaatcactcacaattgaaaagaaaaggacacttaggggcctggtggtgtgttcatgctgctttgaatggagggtgaacaaatccttgccagttcctttaatgtattcctactaccctcaaagggttagtgtgcctaccttataccaagaacataaactttaaaataaaaaccctcaggatattctatttttattttaaatattccaactatatgcagaataaaaagcaacggcttttgaatcagacctacctgagttcaaggcatgtgctttccctactctgccctttattagagtatttccttataaggcacctccttcgccaaactggaagacagatgcaacttttccctaccatcctactgaacatataacccttagatttccttagatttttccttaataaaaattattatatataatgctgatccattttcactgtgttttcctatttattatcttgttggacagttctgtgatcaaaggaaggcaagaattatgcctattttacaattgaagatattgaagcccaaataaaacaattagtacaggaacagaaataggaactagctgagcatgttttcttatacctgcagtcctggtgctttgtgaggctgtggtgagagcattccttaggcaactaaaattcactttatacaatatgaatttagtgccacctgtagacatgaagttaaaagattagacacttgagtactgggacaaatctctaattttgtggggagacattttaggatcggctattattacttttattatattaatttgctttcagactcaaagtgtgataatgcattgagtatttacactgaatttatgatgacttgcttgacaggggattgctactggttttggttaaggagaatggattataaagactttgcataatttaatgtgcagcatcagtgggaacaaataatgagatatatttgtagatgtcaggaaaaatatttagatttagggatttgtgagaatttggtcagctctgggataataattctccaccaggggaaattttgccctccaggggacatttggcgtggtctagaaagatatttttggtagggagagctattggcacctagtggatggaattcaggggtgctgctaaacatgctacataggacaacccccacaacaaagaattatctggccaaatacgtcaacggtgttgaggttgagaaatctgttctagagggagcatctgacaagactagtctgcctttctcaaatatctattatttttctaggctcggttgcttttcagcatataacagttgcttataaagaaagaatcaggctctgacatgttttcacgtgggattaggggaaagaagggaacgttaattgagtgctagacattatactatgtgctctatatatgttatctcttttaaccctcccagtgacctatgaggtaggagcaatgattcctgtgttacagacgagctattttgtgatgaaagaagtggagaaacatttttgggaactgctccctagatgaaggtgttccatgatgatcacttatatttaagacaacttagttttcttttctctcctttggaaatctcatccaagttcatttctttagcgatcgcctcttaagaggctacagtgccttccaaggcttgttgagcacgtgccaagtcttttccttcagtttgtctttcaagtacatgctattttagacatggtgttaaaaactggatatatatagagagagaaagaggtaaggcacaggtaccatcctcttggtgggaaataagtggggtttgggaaaatgacacctgagtattcttaaagatgactaggagttaaccagtcatctgtgactgtagggtatctgtgaagtagggtatctgccttataggaaagtttgtttggtggcagaactgggagagagctgcctcttggggaagtgcagatagtctgactgaagcagagatgtatggggtccaggctttgtattagacactctcacatgtgtcctttctatctctgtgcctctcagttctcagatcttaatttaatttaattttgtatatatttttgagttggagtctcactctggcgcacaggttggagtgcagtggcaccatctcggctcactgcaacctctgcctcctgggttcaagcaattctgctgcctccgcctcccaagtagctgggattacaggcgtacaccactatgcctggctaatttttgtatttttagtagagacgggattttgccatgttggctaggctggtcttgaacttctgacctcaagcgatccacctgcctcagcctcccaaagtgttgggattacaggtgtgagccaccgtgccctgccttcccagaccttaatttttactgtctgctgagtatgtgcttctgagtgactttctgacatttcgaagtcatatataccaaactaaattatctgttatcctgaatctgtgcatttttccatatttcctgcatctgttaatggcaccagtaacctcctttactccaaagtttgagacctagatatttgattcattttacatccacattataatgtctttccttttccattcctgctgccacaccttacgtttagactttatcttttgcttagattttgttttgacttcctaagcagtctctttaccttcagcctcaagttctgcctacttttctttaggcacagctctacttattcatcacggcaaatatttgtaaactctgaagttgatgttaggaaacgttgaatcctgaaagcccatatcattactccatctgacattagcaattaaggattattaaggatcatgacttttaatagtactaaaaaggaaacaaactacagttctctaatcagcaaatgctgagcttttctcaaatattgcttcctaactgtttcacttccatggaccccttttattattttcctctatctcctacctcactatggaccctgtgttctaaaattaaacctaggagctgggcatggtggctcacacctacattccagcactttgggaggccaaggtgggaggtttgcttgaacccagaagttcgagaccagtctgggcaacaaaatgagaccctcgaatctttaaaaaaaacgaaacaaaaactagctggacatggtggcataagcctgtggtcccagctacacaggaggctgaggcaggaggattccttggcttcccaaagtgctgggattacacgtgtgagccaccaagcctggccttaattaatgtttgttgcatagagtggcactgataactttcatttttctagaccctatatatatatttttttgtttgtttgtttttgtttttgagacagagtctcgctctgtcgcccaggctggagtgcagtggcacagtctcggctcactgcaagctccgcttcccgggttcatgccattctcctgcctcagcctctgagtagctgggactacaggcgcctgccatcacgcccggccaattttttgtatttttaatagagacggggtttagtagagacgtgttagccgggatggtcttgatcgcctgacctcgtgatccacccgcctcagcctcccaaagtgctggattacaggggtgagccaccgtgcccggcgaccctatacttttaataatgcagcctaaaattgagctttgctactattttcttttttcatcatgataatctactattgaaagagtttggttatttttggatgatattgcatgccttttacttatattcgcaaatttaatcctttaagattaaggctttgggctatgaaggaatggaaaacaaaagtcccctaatgcacttagtatgaatgccttaataagatcctttcctgggcaatatatactagtgcagcgtgagggtggtagagagagccagaggaaagcttgcatggatggttctgggtatccagggacaagcatggaagtgcttgaaactcagggaaagtgggaagggccttaggaaaacaaggggcattgaagactatgtttcttattttgggtacaggcctagactgaatattcagcctcaaataaaacatgaggctgatgtgctgcttttttttacctggaatatgtctttgctttacttccatcaattaaaatcctggccacatggtgtggctcatgcctgtaatcccagcactttgggaggccaaggtgggaggattgcttgaggccaggagttctagactggcctgggcaacatagtgagaccctagctctacaaaaataaacttagccaggcatggcagcaggttcctgttgtcccaaccactctggaagctgaggcactggcactactacattccagcctgggtaacagcaagactctgtctcaaaaaaagaaaacaaaatatctttcctgtgtccaaagtgtttacagttaggtgggggaaaaaaagtatcaaaattttaaagagcattctggtcagaatggatcccagtagagcagtggttaagagcatggtctctggcatcagctatctggtttgacccttgatccttattagctagtgatctcgggaagattggctacttgccccatacctcttttctcacctgtaaaatgggtatagtaatagtacgaacctcataaggatgttgagagggaaacgcagcaattaaaaatttaaaaaggaaaggaaaagatatagatatactcaagaacaagataaacatctccagggaccaagaacagaaaagaaacatgcagttagactctgggttcaggagctagtagaaataacatgtaggggacctagggtcagatgctctgtatgaaactgaagctgggctgagactggatgaaagagggctgaaaacatctgctcttggctgttgctttaaaaagctgtggacctggagtgaagatgcagaagtggctgagctgccagatggctcagagtcaggaactgtggtttccccactatcagctagtacaagagcaccaagcttggaggtcgtggactctggaagaggggtggcctatcacagaacccctgggaaaagagggaatgtctgagcctataaacacacgaggaagaccattacttagaaaattaacacagttaccaagagataaattcacaaaaaatctgatggaaatatgggtaatttcaaaacaattgtaagtattttaaagatccttaaaaaagataaaagaaataatggtcataaaaaaacatgaatcaaaaataggtagatatgaaatagatggctatattaaagaaaaaatggaattattgaaattaaaaaaaaaataggtcagttgaactctagaccagacaaatttgaagggaaaattaatgaattggaagaaagtacccagatgtatcacagagaaataaataggaattaacaaatatgagctgggcgtgatggctcatgccggtaattccagtactttgggaggccaaggcgggcagatcacctgaggttgggaatttgagaccagcctgaccaacatggagaaactccatctttactaaaaaaaaaaaaaaaaaaatacaaaattagctggatgtggtggtccatgcctataatcccagctactcaggaggctgaggcaggagaatctcttgaacccgggaagtggaggttggggtgagccgagatcgtgccattgcactccagcctgggcaacagcgcaactccataaattgagaggcaccaacttacatctaactgggagttccaaaaagaggaaataatgtgaatggtggagaagccaggttggaagagctgatggctgagaatttaccaaaatttaagaaagaccagttctcagcttgaaagggcattatatgtatctagtaagatggaaacaaaaatataaactaaaacttcagagattttcttgctaattatattaatgtatctattatagaaagactgaaaatttagacactccaaatttaatagtgggcatctttaggtggaagaattatgaggtttaaaaaaaaacttgtattttccaatgtttctacactgaacatattaggaatcttgcttttaagttggagagacttgaagtacactgaatatataagtggccaagtgctgtgtggctaaatattatctttacagaatggacctctgggataccaaatacctctgaaacttggtaacataattattatgactttattgtaggctataatcttttaagctatatttctgaaatcccaaagctctggaagctggaagttttttaaaaagtttgagatgaattaatttggcagcaaaatttgaactgatgtaaaggtgtcagtagtatttatttgtctgacacaaatgtatatgctttgctatggaaatattaggctgttaatgacatgccacatgaattcctcctgggtgttctacaaaatatatagtgcagtgttaccttcctaaaatccataaaattctgaattccaaaacataccctgccccaaggatttaagaaagggtttgtggacttttattacttatttatagtttacttttaaaagttggctactgtgcaggaacaataatttctcatcagagttagttcctagatttttttctctagtcactgttctgcacttctatgatactaagtagatgctcatttcaaagatactttttggctagctctactgtaataccagtacagttgatgtcactgagttattaggcttttcttcctctccagtagtaactgaaaagacagacttctcttcaacttttggacttgaagatttggaaggctgttttacaaaatggtctcccaaactgaagtttcacatactgcttgaagaagatacattctgatgatttatcaaagcagatttagagtttttgctctcatttatgtgtattatttctgatgttgtttgtacttttggcttcgtaccatttctttaaaaatttggttcatacacttcagatctagaagcaatgtgattagcctttgatataagaacatctgagtttctatttgcatttttactttcattgcatgcatgctgactttagtattttctttacaatttagaagatatatatgtatagcaattatgtaagaaattcttgccttctgtaggcacaacagtttggttactgtattaacatggtcttaaccattttgtcagcaagccacatttggttagtagtgagtcctgctattttactatgttacctgcaaacaggattgcagatgtgaaggtagcctgtgtgatcattggtcactcactgaattagggattatcagaaattatattgaagtggtcacttggctacttgccttctacatgcttaggctagactttggttcatacttagaaccattttgaaatctctgaaagactcagttgactcaacctaactggaaagtccatctaatttttttttttttgagatggagtcttgatctgtcacccaggctggagtgcggtggcacgatctcagctcactgcaacctccgcctcctgggttcaagcaactctcctgcctcagcctcccgagcagctgggattacaggcatgcaccaccatgcccagctactttttgtatttttagtagagacagggtttcacaatgttggccaggctggtctcaaatgcctgacctcaggtgatccacctgccttggcctcccaacgtgctgggattacaggtgtgagccacagcacctggcctaaagtccatctaaatatgactcaatctaggagttcaccgcttgtctctgttgtcctttagattcaatttatctctcacgtaggccatttcagtgtaacaagatggcagttctcaactccaagccaaaatctcatgagtccaaaggaagagagtttttctatatgcttgtatcagttttgagagaaatttggttctgcctgtgttacacactaccttgaaccagttgaggtaggaggtggggctcagacactggaccaaattgaggactagctaaaacagggacagagtggaatcagctttccgtaagtcacacctactaatgtgccatgtcagtttcccattgccacggcaacacccagaagttagcgtcccttttcatgacagtgtcctggaagttaccacccttttcctagaaatttctgcataatctgcctcttaatttgtatataattaaaattgggtataaatatgaccacagaactgcttctgagctgctactctgggcatactgcctatggggtagccctgctctgcaaggggcagtacctctgccgatgctttacactgctgcttcaataaaagttgctgacacaccactggctgacccttgaattttttcctggatgaagccaagcaccgtcctgggctaagccccagttctggggcttacctgccctgcattacaatcactgtatcagaggtggagatttgggctggccttggatacattctcactgtctgcccgtctgttgtgtgcgtgcatgcaggtaggggtgtgtgcgtgcatgcaggtaggggtgtgtgtgtgtgtgtgtgtgtgtgtgtatgtgtgtgtgtaggtagtactaggtatatggggagccagtgagtgtaggcattgttcgtatatggggggaaatggatgggtgttgatgggtacactgtaatcaacaactccgacaggaccttgtagagtaagggaggtagtgtcattccctcagcaagagaaaaatccattttagcatgtacaatatttattaaaacaaccttcctcttctccccttccaaaaaacccgacaacctcagtcttcaaggtctagccaaattctctcttctctataaaacttttctactcaccaaacctagaaatggtttctcctttgactgtttgtactttatactttgcgttattgcaatgtacagtatgtgcatgttttatctcacctattgctacttgaagttgggaaactagttgaataactcttagtgcctcataactgatcacttcattgcaatataacaggctctgaatttctgttgaatcaaggaattcctatttatttttttgagatgaagtctcgctctgctgcccagactggagttcagtggcatgatctcggctcactgcaacattcacctctcaggttcaagcaattctcctgcctcagcctcccgagtagctgggactacaagtgcacaccaccacacctggctaaatttgtgtatgtgtgtgtttttagtacagacggggtttcactgtgttagccagtatggtctcgatctcctgatctcgtgatctacctgcctcaacctcccaaagtgctgggattacaggcatgagtcaccgcgcctggcctatttattttaaaattttaattaattttttttttgtttttagagacagggtttcactatgttgcccatgctggtcttgcctatgcctgtcttgaactcctggcctcaagtgatcttccctctcagcctcccaaagtgctgggattacaggtgtgagcaaccattcctggcagaatcagggaattcttaacactttttttttttgttttttttgagatgagggggtcttgctgtgttgcctaggctggagtgcagtggtacaatcatggctcactgcagctttgacctcccaggctcaagcgatcctcctatctcagcctccagagtagctggaactacagggatgcaccactgtgcccagctaattaaagaaaaaattttcttttgtagaaacagggtctcactctattgcccaggctggtcttgaactcaagcagtcctcctgcctcggcctcctaaagtgctaggattacaagcctgagctgcatgcctggcctcttaaccctttaaagatttttttgtttgttttttagacagagtttcactcttgttgaccaggctggagtgtagtggcacgatcttggctcactgcaacccccgccttctggtttcaagcgattctcctgcctcagcctcccaagtacctggggttacaggtgcccgccaccacacctggctaaattttgtatttttagtagagacagggtttcaccatgttggccaggctggtctcgaactccagaccttgtgatccgcccaccttggcctcccaaagtgctgggattacaggcgtgagccactgggctcggctgcttgtagcatttaatggtgcaaaatggattcatgtgttgtctataaattcttaccaataatgggagttgatggagagaactattacctgaaaatacttcacgattctttggcctttcatttttttgttaaatggagtgagcttgtgtgcaaaatcaacctgatactaaaggataagaaaggtactcccgattgcatttcttttgtgtgtgtgtgtgtgtgtgtgtgtgtgtgtgtgtgtgtgtgagacagagtctcactgtgtcgcccaggctagagtgcagtggcatgatctcacctcactgcaacctccacctcccaggttcaagcaattctcctgcctcagcctcctgagtagctgggattacagtcatgcaccactgtgcccagctcatttttgtatttttgtgtttttaggtttcaccatgttggccaggctggtcttgaactcctaacctcaagtgatctgcctggcttggcctcccaaagttctgggattacaggtgtgagctaccacgcctgtccccagtttgcgtttctgttctttctggtgaccatagtgagctcgattataatagccatttattatatttgtctatggggaaaaattccctcagaataaatacacttctcctacgtgaacagtaacattttctttcttttttttttgagatgagtcttgctctgtcacccaggctggagtgcagtggcatgatctcggctcactgcagcctccaccttccgggttcaagcgattctcctgcctcagcctctgagtagctgggactacaggtgcccgctaccacacctggctaattttttgtatttttagtagagacggggtttcaccatgttagccaggatgttctcgatctcctgaccttgtgatccatccgcctcggcctcccaaagtgttgggattacaggcgcgagccactgtgcccggccaacagtaaccttttcttaaggtcccgtggttgatgtcttcactcattctttcttcttttaatatagtagaattgcgtatttgggggaggaatagagtttctgaaagagtgaatgtacaaagaagatcccagtgacctgttagaatgatgaatctcttttctctgtgttagcaagcctttaattagtaaggctgtttgcagtgtaattagaactgcacaagcatggaaggtcagtaatactgttcagaatttcataatgtactgtgtaacataacatactgtgaaatgaatccatagtaccacaaaatttgtttttaaagaagtttgtctctattgactcatctaggaggggtcacttaaaaacaaaatagggcaaaaaagtcaaattcagatgtcttaggttttctcaaattcctttaatctcgatatagcaaaagaaactgtttccttcttagccctagaatggcagtctgaaaaattatctaagtttttgaggaaacaaattgaaatacaagaaaattatttcctttacaaataaacagttctcttgtttgtctttgaacttaaccacatagagatttaaatagtttgttgttttataggcttgactgaggaagtcttctcctaaaatagaattttttaaaatagttttttctcagcccagctgagaccttagttatcatttttagttcttagttttgttgaagattgaagccattaagccgtagaagtgatgcagatttatgctgttgtctatatctgttctcacctactcaggatgaattgattataaaacattttatcataggatagcatgttgatgcatataaaacatagtgatgaaattctactttgtcttgttttacttattgcttgttcatccaaatgtattaaatttgattgtttaggtttgagatattataataaaacttggttacattattaaattcagtacatagtataaaatgtttattaaaaatagtattttaggctgggtatgttggctcatgcctgtaatcccagcactttgggaggctgaggcaggcagatcacttgaggtcaggagttcgagaccagcctggccaacatgttgaaaccctgtctctactaaaaatacaaaaattagctgggcatggtggtgggcgcctgtaatcccagctacttgggaggctgaggcaggataattgcttgaacctgggaggcagaggttgcagtgagcccagattgctccactgcaccacagcctgggcgacagagtgagactccatcttaaaaaaggaaaaatttgtcctttttttttgggaggggagtgtaggttcttctctacataatacattgacttccttaggggtattcatctctgtgtttgcatatcctaagggtgttctttagagaaatatatacatttctagacttatactcgtagattcttatctttgcctagtttcctctggaggacaagaatctcttctttagcactatttcccccatatttgtgtagcattcctacatttttcaaatgtaaaaaaacaccacatcagagacctttgacctcagttctctgtgaagtttcaataaactcgattcctgagaagacgtgttagtttcttgtagatatcaagtcaaactcaaagatctttaagtgttttctttgtttcccaagatgttgattctttactctcataaaacaggttaaagcaggctctctcagcctttctctttgagaaactactttcatatttccgaagactgcttgggaatgctggtgggagttgggataggagcagcggagggaggagatgcctaagagtgcctgttctcaggtagagttggaaatgttccctcctagagctgagatttcctgcaagacatcgagttggggtgtgaaagcagcagatttcagtatcagccagatgtggctttgaaatggtggttcacagtttcttgtgatttttgaaaactctgaacatattttagactttttagattattagtgcttgatgaggtacttaaaatcagagtctaatatttgggttgtacagttgagggtattaaagcccagagaggctaggtggtatcagtaaggtaacacagtaagttacagctactaagtatccaaggtgagatttgatcctgagtcttataacttaccgttgctctaggctctggaataagaaatgaagcatcaatttcctggggagcttttttttttaattaaatttaattttttttaagataagaataacatatttgaagaaaatgtcaagtactttcacttacattttcttattgatctccacaagaagacaaccaggcaatctgtctttagctgaggaaacagacccccgagaggttaagagtccctaagtagtaaacattcatctcacgttcaggacctctgactcatgtgtcttgctgtttatattatgtatgaagatagaaattgagaagctgtcagtaaattctgtatgtgctagataagcaccctgtttaaagaaattctgtggcaattgtcaattgtgttttataatcttgtctagacttgtgtctctcaagttttcttattcacacatatgtagttttatcccccccaaaataattattctcttgtgggatctacttagtggtatggtttgcaaatggattaactcattgaactggaatttttagtagattatattttcttttttctcatgtttctttgagacagagttgctctgttgcccaggctggagtgcagtggcctcctgggtacacttccacttcctgggttcaagtgattctcctgactcagcctcccaagtagctaggattaagggcatgcgccaccacacccagtgaatttttgtatttttagtagagacggggtttcactgtgttggcctggctggtcttgaagttccaaccttaggtgatctgcccgcctcggcctcccaaattgctgggattacaggcgtgagccaccatgcccggccagtagattgtattttctaatcaaaactttagacaaaccaattttgcttgtgtttaattaaaatgttctagttaagaacaatttattagtactattttttgagatggggtcttacttggttgcagaggctgtagtgcagttgaacaatcttagctcactgtaacattcacctccgggctcaagccatcctcccaccgcagcctcccaagtagctgggaccacaggcttgtgccaccacgcccaactaattttggtattttttgtagagatgaggttttgccatgtcacccaggctggtctgaaactcctggcctcaagtgttctgcccacgttggctactcaggaggctgaggtaggagaatcgcttgaacttggaaggtggaagttgcaataagccaagattgcgccactgcactccagcctgggtgacaaagtgagactccgtctcaaaaaaaaaaaaaaagaaaaaaaaaaaagaaatggttaaaataggaaaagtctcagttcctcttagctatttctgattgctacatgacttccatgaagctttttaagctttcactcagttctgaggtgtttatatgagcttgtgaggaacttctggttacaaactgtaatacctattggcttttagcatggtgcaaggaaaagagctttggattagggataaggacacctgagtcctattaaggtctctgtctggatttgtgaatgcacctgttaagtgagttgtatagactaaaatgttttccagactacatgagcctttttgagtattgcacaagtggtattttataaacgagaaatagaataaaaaatattgtgcattgagtacctaagaggtaagtattgctctgtgaatcattgtttcagttatatgtatagggtactgggttacaatgtaaaaaatgtatttttaattaaaaaaatataaatgtagaaaaatataatagagatgaggtctcactatgttgcccaggctggtcttgaactcctaagctcaagtgatcctcccgcctcagcctcccaaaatgttaggattacaggcgtgagccactgtgtctggccaaaaaatgtatttttcacacagtttggttttctattccaaaatttggtggcttaaaataactactttattagatgtcatgatttttggattaggaattcagacacagcttggcctgttgattctgttctatatggtgaataagatcacttggaggtgtttagctgacaacaggtctggtctggagggtccatcttatctttattcactcaccttatgccttagggtaactggaggcttggctcaactgggcttctcttagtgtagtttgagatcctctctgtggtttcttcagctgggtagttggacttctcacgtggcagctccaagagaccaaagcaggagctggcagccctctcaaaggctagcttagaatctggcatagcatcaccttcactatacactattggtcagaggagttccaggctagcccagatttaagagaagggaacatagacttcttgtctctaagatattgttcccattttaagtctgccacaattatgtaaaataatttagaaaaacatgactgaattatatatccaagcttttaattctgttattgccctttgaaggatgatcacttttaaagtgttttttcctccattgggaaatttgtctgcttttggtaaattttcatagttcaatttgagtatgtatattatttttccatggaatactgagggttttatgcttttgaagaaatgatttaaagtttaaaatttctttctctacattgatctgctggttttaattctttgaatagcacttatgatcatttgatgctgttcttttttgttacttgattattcatctttctctccttagaatgtaagttctaaaagggcagcacatgttcttgatctttgccaaatctgtagtgtctcctgtagtagaacagatgctcgataaatatttgttgagttaatgaatgaacaatttaaaagattgtgagctgggcgcggtggcttacgcctgtaatcccagcactttgggaggccgaggcgggcagatcatgaggtcaggagatcgagaccatcctgtctaacacagtgaaaccccatctctactaaaaatactaaaaaattagcggggcatggtggcatgcgctgtagttccagctacttgggagcctgaggcaggagaatggcatgaacccgggaggcggagcttgcagtgagccgagatcgcgccactgcactccagcctgggcgacagagcgagactgtctcaaaaaaaaaaaaaaagaaagaaagaaaaaaaagattgtgaagtatcatagatcagatctacgttgaaatgataaaaataaggaaaatctttttttagacggagtctctctgtgtcgcccaggctgtagtgcagtggcatgacctcggcccactgcaacctccacctcccgggttcaagcgattctcctgcctcagcctcctgaatagctggaattacaggcatgtgccaccacacccggctaatttgtgtatttttagtagtgatggggtttctccacgttggtcaggctggtctcaaactcctgacctcgtgatcctcccgccttgtccttccaaactgctgtgattacagacgtgagccaccgtgccttgccaaaataaggaaaatcttttagatagaaaatataggaccggtgtggtggctcatgcctgtaatcccagcactttgggaggctgaggcaggtggatcccttgagctcaggagtttgataccagcctgggcaacatcgtgagaccacatctctaccaaaaaattagctgggcatggtggcgtgcatatgtggtcccagccgctcaggaagctggggtgggaggattgctcgagcctgggaggcggaagttgcagtgaaccaagattgtgccagtacacttcagcctgcgtgacagtgggaccctgtcttaaaaaaaaaggaaaaagaaaatatatttcataaggttagcaacaagcttttgagaagggctattctttatttctgtgatgtactttctatatttttgtattaaaatcccttttctgttgtgaaatgatagtgatattcacttctatagtttaaaaatatgttctgtgcagcataaataattgataagcagtgttatcttgtactttcagattggagttgcctttgagagtcaaagatttgtagctcacagaaaataaagaagtactgtgtgggtgtgcctgggagggagttttgctaagaattcttactaaataaagttcaatcagtcaaatgttattgtactcttcaaattctccagggaaataaattgccagcttccatttaaagattgtattttgtttgaatatgtgatgttaaagtgaaatgtgacatataagaatctaaagatgattattaaaagcaaacaacataatagcattcttacaatgtcttttgcaggagagaattaatagatttagcagtgtttctttgaataaacttgtccataatgaaagctaactaaaattgcattaaaatttatcaactcctttaaaaaaattcaatatgttttgagatacaagtatgcacaagtattttctttcattgtctaataagaacttaaaggaacctgagatgtcacctataacaaactcctttgtgtttcagaaaaggaaactgatggtcaaagaggtaatgatttgtcaaaagtaataaagttattggtaagtccaggattcgaatcccttctcattcccaggcccctgacctttacatggctgcacactattttagggagacaagttttaagaagtttctctttttggatatgatatagattctttaaataatattattttactgatttttgaattcatattaaatgagggtttgtatttttaagtaacatgcagggaaaacattccacattcatgttatgacagctgggctcgtcaaggctttgcaaagctctaaaagtaggatacacacttttaacttttgtcaagttgtgatttaaaattaatcaaaaaaatcatgaggacaccttatttttgttattcctgtcttaaagaatctttatacatgaaaaaatgaaacatttataaaattagcccaatttgtctaaaaataagggtagttttgacggttgtgaatttctttttttaaaaaaactcaggaacaaggttatgattttaaaaatgcaagttttcaaaaagggcaggagtaagttttgtatttttaagccatttaaaaaagatagtaaggccgggcacggtggctcacgcctgtaatcctagcactttgggaggccgaggcaggcggatcacgaggtcaggagatcgagaccatcctggctaacacggtgaaaccctgtctctactaaaaatacaaaaaaaatttgccgggcgtggtggcgggcacctgtagtcccagctactcgggaggctgaggcaggagaatggcgtgaatctgggaggctgagcctgcagtgagccgagatcgcgccactgcactccagcctgggcgacagagcaagactccatctcaaaaaaaaaaaaaaaagaaaaaagatagttgatatttaataataattataaaaattataactataaaaccagtattagaaaattaatgatggatgaatgtaaataaagtaaaattatgcataatcctactttccagagataactaataacatttaggtgtatttctttccaatcatttttttctatgcatatatggtgtgtatttttttaaacacagtcaagttcatactctacttccttttgttttgcttttttcatttaacattatatcatgagcattttcttatgtccctaaaaagtctgtggaaacattttataatagttccataacattctgtaattatttaactattaccctatttctggttatttgggatataataaatttttgctattgttaataaggctgaaatgaataactgggtatacaaatctttatacacatttgtctctcttttaatgatagttgcctaaaagttggaattactgacacatattgccaaaattctttatagtagaaatgtactaatttatactcccattaattttatatgagagtgcttgttttatcgcacccttaacaaactggttgtgtttgaagagaactttgctattattttggggcttgaagcatttgttgaagagattagtggatgggtccacatttttggtatgctatttggaggcacttagctattttgggttatgtatctgattgcttttatagggccagaccacaagattagataaagtatatggaatatttacatatcagtcttacgaagagcaaactattcagacccacttatcttgattcagctattctaattgtaaaaagactactgaaggttaaaaatttcagttgactattttctcctaaagtaggataagctaggcttttaggaaaaaaatagggttgaaataaattgtttagaaaattgatcaaaagtagtagttactcagtactctctctctcagcgctcactctctttctgtctctctctgtctctctgtgtgtgtgtgtgtgtgtgtgtgtgtgtgtgtatttagaaaaagagtagaatggaaagattagaaatagagcatgaaaggctggggaagggaagttgctgtgaataacagaacttctgcctttacctgggaaaatatatctttacttttgtcgctacattattgactctgaaagatcacatgagtcctctttcttgaaataatatttttgtgtttgtaactgctgacacgactggtacttaaattttgagagaataaactttttgaaaatttttttgaccattaataaaaaacttttttttcatttcctacagtacatggattttctttttttttttttttttttaagacagggtcttgttctatctctcaggctagattgcagcggcgcaaacacagcttgctgtagccttgaactcttgggctcaagccatccttccatctgagcctcccaggtagctcggactacaggtgtgtggtctccctatgttgcccaagctggttttgaacccctaggctcaagtggtcttcctgccttggtctccctcagtgctgggattacaggtgtgagccattgcacctggctagacagctgattggctgggcgcggtggctcacctgtaatcccagcattttgggaggccgaggtgggcggatcacctgaggttgggagtttgagaccagcctgaccaacatggagaaaccccatctcttattaaaaatacaaaatcagccgggtatggtggcacatgcctataatcccagctgctagggaggttgaggcaggagaattacttgaacctgggaggcagaggttgcagtgagccgagatcgcgccattgcaccccagcctgggcaacaagagtgaaactccatctcaaaaaaaaaaaaaaaaaaaaagcggatcacgaggtcaggatatcaagaccatcctggccaacatggtgaaaccccatctctactaaaatacaaaaaatttgccaggcctggtggcgcacgcctaggggattgcttgaacccgggaggcagaggttgcagtgagccaagagtgcaccactgccctccagcttggtgacagagtgggactccatgtcaaaaaaaaaaaaaaaacggttagatgcaaatatcaaaaatgagttaaaaaatatctttggtgtggcttcaattttattaactattttaatattgcagacccatatcttcccttaattatactgaatttagtatatttgttaaaaaataaagttttaagactacctgttttggtatcaaaattagttttttttttttctttttttttgagatggagtcttgctctgtcacctaggctggagtgcagtggcatgatctctgctcactgcaagctccaccttgggttcacaccattctcctgcctcagcctcccaagtggctgggactacaggcacccgccaccacgcccggctaattttttttttaatttttagtagagatggggtttcactgtgttagccaggatggtctcgatctcctgacctcgtgatccacccgccttggcctcccaaagtgctgggattacaggtgtgagccactgcgcccggctaggttttttcaaattgaaaattttttttctttttctttctttttttttttcttttgagatggagtcttgctcttgttgcccaggctggagtgcagtggagcaatctcagctcactgcaacctctgcctcccaggttcaagtgattctcctgcctcagcctcccaagtagctgggactataggtgtgtgccaccgcgcccaactaattcttgtatttttagtaaagatggggtttcaccatattggccaggctggtctcgaactcctgaccttgtggtcctcctgcctcagcctcccaaagtgctgggattacaggcgtgagccactgtgcctggctttaatttgaaaattttaatgttacaaatcaaaggtaggtgttaccaaagtatgttaagcatgagcaaaagtgcatttgattgttcagagggccaagttcatgttagctttgggatcatgcctccagagatgtaagtttaactattatgataataacaaagtaataattatgccatgtgccaaggattctattagactctttactatagttaattaaattttaatcttcacagtgccctgaacagcatataatgggtaaaccgagggacagacagtttaagaaccagtttaaaggctgggtgtggtggctcatgcctgtattcccagcattttgggaggctgaggtgggcggatcacttgaggtcaggagttcaagcccagcctggccaacacggtgaaaccttgtctctactaaaaacacgaaaaaaaaattagctaggcatggtggtgcgtgcctttagtcccagctactcgggaggctgaggtgggagaattgcttgaaccccggggatgggggcggaggttgcagtgaaccgagatcatgctactgcactccagcctgggtgatagactgagactccatctcaaaaaaaaaaaaaaaaaaaaaaaaagaaccagcttaaagtcatacaggtaataggaagtcaagcagaagttgcaaaccagataccttttgctacctttacaggcttgctactcagcctggcccacagaccagaagcaattagtgagacctgggaacataaagaaatgcaaaattttggtcactgatacctgcagtgccaaacctgcattttaacaagatccacgagatttgtatgcatgttaaagtttgaaaagcactgatggtgtgaaatgtggattatctatcaacattttccacaagagaaggtgggtaactctagccagtgtctccaccactgtgaattgctaatccagctgctgctttgcttcagatcctgtttaatccagaggaacaattgactaattctgcttgtggaccttcggtcaaagtcttaaccacgccaagtatagctcagtgttttaacagcttttactcatggactgaacacatcagttttatagaccatggcttcattctggataggcatttcccaggttaaagagaacagtgctaaaaatagcattttctaaagaaacttgaaatcttctggaatatttgatgtgttttatggctagcaagaaaacagatttgtataaactggcttccttactaatttcattttgtgaacttaattattctatcacagggacagtgataggtaaagctaacttagactagagcagcactgttctgtagaaatataatgcaagattcctgtaattttaaattttctagtagccacattaaaaaaggtaaaaaagaggccaggagtgttggctcacgcctggaaggctgaggcgggcagatcgcttgaggccaggagtttgagaccagcctggccaacatggtgaaactccgtttctaccaaaaatacaaaaaaatttagccaggtacggtggcgcatgcctgtagtcccagctactcgggagcctgaggcacaagaatcgcttgaacccaggaggcagaggttggagatcgcaccactgcactccaacctgggcgacagaacaagactccagctcaaaaaaaaaaaaaaagtgaaatgtagtccaactaaaacaatacaattgtgtttagtggaaaaatatattgcttcagttataaaatttaaatgaattaaaattaaataaattaaaaattaagttcttcagtcccatcagccacatttcaatatcggatggtattggttgcttctgatataactgatttcagacatatgaaattgatcaccatcctagatggtcagtaagttaatgccacaggatattgtagtctattaataacattgtagaacagggcccagtcgttcacacctatattcccagtgctttgggaggccaaggtgggagggttgcttgaggctaggagttcaagaccagcctgggcaacatagtgagaccctgtctctacaaaaataaaaaaatgaaaattaaaaaaattattgcacagagaataaaggaataaaagcaatttggatcataaagcatttactgattccccccttttcatagttggagttaattttccttttattggttcacaatttcttaactcttcaactgcattaaactgtaagattagagccaggagttagggtgccatccacttttcccctctatggtcttagattcttttttttttatagcccgcatgcttctttggaaagtgaggtaattgtgtcaaataggatagccttgagtggggcccagaggttgtaaaattttatgtctgtacctgattcacctggtaacttgctaaaaataccgatgtccaggcctacctttctagattcggatacataaagtgacactttccatattaaataagctgctctaagtgtttctgaagttcaggaacgtttgggaccatcagatccagcaattgactctcaaaggctgcggactggaattagtacgtcgtgctgccgttgccaggcattttatattttcctaggctgaggcttcccaggctgttgctttttttccccccacctttgcagatggattttgcaggctgttaaatcccactcccgaagacctgccctgacagcgcctctttcctaagtgctgttacagggagctgagcttgccgaggtagacagtggccacgtgactgctaaaccggttgccagaggcgcggccatttttggggcgggcacccaatctctcgccctgtaaactgcggggtgacgggacgctgttactaggactcaagatggccaccgcgcccgctagtcatctcgctagcccgcgcgccagtgagctggcacgagacacgcggtggcccacggcgtctggggacgatctccagcccttcgcacggggcggagcgcccgccttccctccaatcagcacgccgggccggctagccaggggccgcccgcgcgcggggtgtgtgaggacgcgctcccagtcgctgagtgcctgagccgggaagcagttgctgtggtacctgctgctgcccgagcggacgtagagcatcggacgcgggcgccgtggcgctgggcaggagggcgaagccatgacgtcagtcaggtaacgagcgggcggctgccttgactgctccgagctgggcgttagcctcccgagcgcgtgagcactgtcgctccttctcgcgggtggtctggagcctgcctccgcctctggtccccctcgtgttgggggttccctccgcacttttcatttgggcatttctgctttcctcagaagttttcgggtctgtggcacattgcggagttctgtgtgtcgctgcttggtcgaggtgaccctcgcccaaattccagggttgcaagcgttcttgggtgtgtagtggatttcccatgaaaaatgtgccccacccgcgcccccgggggcggcccagggccggagggagcgtggcgtgcacagtgtgtgtcatgcctgcgtgtcatgccctctgacagaacttcattgttggccgggagcagacctgcaaagttggcccttctctgatgcaggtatattgccctcaagttgtgaaattgtgtgtctctaaaatgtttgctcatgactggaattaggaccctggttcccgaaggtaccatcttgtttctttactccttttatctcagagtcacaagtgaaatgagttgagagatactgggcatgtagcgaaatccatgaaactggagactttcccccaattgctcttccagtttggaaggttctttttttgttaatgaggacaggataatgggcttgtccactttctcccagtagccttgactgaatgtttaatttacgctagttcaactatttataaaaagagataaattgccttatatacccagtgttctgactggcctttttaaaagcagaacttgggctttgttgtcccagagaaagggaggccccagcacaaaaatgtgaagagaaataaaataagctcatttttggtctatgagctttccaggctccacccgtcctggtgatttgagggcttctcaatgccaatttttactacattgtgtttaagagacagcttgggaacctaaccctcagtaagatctaactgtgctgaactcggacatagtctgtctcttaaattgcataattatatatatatatatatatatatttttttttttttgagacagagtttcgctcttgttgcccaggctggagtgcaatggcgcgctctctgctcactgcaatctccgcctcccgggttcaaacgattctcctgcctcagccatccaagtagctggaattataggcgccagccaccacacccagctaattttgtagttttagtagagatgggggtttcaccatattggccaggctggtctcgaactcctgacctcaagtgatccacctgccttagcctcccaaagtgttgggattacaggagtgagccaccgctactggtctaaattgcttcattctgtactaacatagacaaagtacttatctcattatgcagaaggagattcaggtgctgaaacatggagacccacatggaaggatttcacagtaaattatattggggcatataaatctagcttttaaagctaacagtattttaggatgaattagaattaggctattatacccagagttaattccccttcttcccattcccactcttattatcacagaatgctactaattaggtgtaggggtcaaatactttctgtgttaagaatcagttgttatgtggattcagttttaattgactatcatcttcctgaccgtgcctcattggagaaacatccaaatctaaagcttctgctgtttaataagtgacagcaggatgtatcttttactgtaggggttgatagttttttttaaaagactgatgtaaaggttgacaccagccttacttgacatgttttgaaaggatggataactgataataaaatttatttatgcttgtttcttcagatgtcagtctgtattttacataatcttgaactatggtaacatggctcgagaaagctcttttagatgttatttaaaccagctattacattttacacctgaggaaactgagacaaaagttgagtgccttgtgcaaaatcagcggcaaaattaggaattgaatccagatttccatgatttagtgctctgcatggtgcctttgtagaaacaatatactatttaaacttcctgaaaaagctgtttctgtggacagaaattgtaaagtatcatgagagacaactatagtaactcttttgctttcttcttatcctgcaacgaacttgataactggggtttagaagtaggcagggttagccaagagaacacaactactgggtgttgggaagtgcagggaggccattgaaagtgaagtgactctgtatggtgatagttttgaatgagttggtcatcctacagataccagccatttcctggtgaacactacatttaatacaattatgtcatatctttagtttttgcaataatgatgtcagacatgttcctatcagaggcatttgagccagagcgactccatcttgaatagggtctgggtaaaataaggctgagacctaccagggtgcattcctaggaggttaggcattcttagtcacaggatgagataggagatagtcagaagatacaggtcacaaagaccctacaacaggatgcagtaaagaagccagcaaaaactcaccaaaaccaagatggtgatgagagtgacttctggtcatcctcactgcttattatacactaattataatgtattagcatgctaaaatacactcccaccagtgccattgacagtttacaaatgccatggcaacgttcagaccttaccctatatagtctaaaaaggtgagagaccttcagttctgagatatcagaactgatttcttcctttcctggaaaactcatgattaatccaccccttgtttagcatacaatcaagaaataacaagatacttagttgagcagcccatacccgtgctctgtctttggaatcgtcatccttttgtttctttatttctctaataaacttgctttcactttatggacttgccttgaattctttcttgcatgatgtctaagaaccctcttggggtctagatcgggacccctttctgttaacattcccattttgtgctcagtctaacagtagcctaaaaggtaggtattattgacccccttttactgataagctgaatgattacaagatatccaactctgactttgtgtccaatgttcttgttttataccacccttaattgttgctaaatatagtagtatgtgactcttttcatagcaatggctatgaaagaatacaggattggaaatcaatgaggaccaatggtcagaatatcttgggccccactgagggccttttctgagttactgagcttccatttctcttttctttttattattattattattattattattgttattattaattattattttgagacagtgtcttgctctgtcgcccaggctggagtgcagtggcgcgatctcggctcattgcaacctccacctcctgggttgaagccattctcctgcctcagcctcccgagtagctgggtttacagacgcctgcctcacgcccagctaatttttttctatttttggtagagacggagtttcatcatgttggccaggctagtctttttttttttttttttttttgagacggagtctcgctctgtcacccaggctggagtgcagtggtgcgatccggctcacttgaagctccgcctcctgggttcatgccattctcctgcctcagcctctctagtagctgggactacaggcgcccgccaccacgcccagctaattttttgtatttttagtagagacggggtttcaccgtgttagccaggatggtctcgatctcctgacctcatgatctgcccgcctcagcctcccaaagtactgggattacaggcgtgagcaaccgtgcccggctggccatgctagtcttgaattcctgacgtcgtgatccccccacttcggcctcccaaagtgctgggattacaggcgtgagccaccgcccccagccccatttctcttttctattctggacatttgtttaatgaaataactcagtagcagagatactaatatgcatcctaccagtgttgttggataagtgtaaaagtgcttttaaattttaaagcattttaaaaatagaataaaagcactttgagccctctagagaatggtgtcatctgaggaaaaaaatgtttaaatcttaaatttttagacaggaaacaaatttacctatctaattttctcattttacagttgaattaaagcccagagatagtgtgacatgttcaagttcacacagttacatatcttgaactagatatgagatctctagataccttgttcagttccctttctagtatagcattcaactctgaggaattcctaaataatgatttttttttggggggggtctctttaggaattcctaaataataattttaaatgaaaacttttctttttttttaacttaagatctttgaatttggctggagttagtatttcatcatttgtattctattctacttaattactgattaagagtctaaatttacagcctctgaaaccagatatccttggggaacaacttatatcctttgttatgtatatcagattcctactggtcttcatttgggaaatgatagaacatatttgataaattgatgcttttgtcattttaaattggcccaatagttaagttggcgcctgagttaagttcaggagacagaggaagatgcagaatgtcaggattcaaagaggatcttagcattttactttttttccttttctatactggatcttgtgtccaaagtaaagtgaaatgtcctacttagacctagtggtagagcctaagatagaatttagaccttctgactcctaatttatgtatttttcactgagcaacactatttcaaaattcccctctgaatattgccttgttttcctaacatcagtgtctagtctggttttgggcatcgcttacagcttgggtttgcgccagggaagactaggaaatggagttggggaatatttgttgtagagctaatgagccctattctttggtctgcccagataggtcaggtttggtctaaaactattctgggactctggacatcactgtgccctacatgatgattctggaacccacttttgtgggttaagcctacattggaaaatttatgtgggcagtgggtggggtcgtggggtattttccttctaacactcgaaactttttgaggtatgtccaatagaatctgccaagccactcagaacattcatatggagactaaaatctggctaagattgaaactgtctttgttgagttggtttctttagagccttaaagttttcaaactcatttttacctgtgtttttaaaatacgaattgtaaattcacattactgcacaattttttttatgctgtgggatgtttttagagaggtaagtgagcttttaaactaaaattgtttcatttatggaatattttgaagaagtaaaacagaaatctttttatttatttatttatttatttatttatttatttttgagacacagttatactcttattgcccaggctggagtgcaatggcacaatatctgctcactgcaacctccgcctcccgggttcaagcaattatcctctctcagcctcctgagtagctggaattacaggcacatgccaccatgcccggctaatttttgtatttttagtagagatggggtttcatcgtattggtcaggctggcctcgaacttctgacctcaggtgattctcctgccttggcctcccaaagtgctcacaggcatgagctaccgtgccggccaggaatcttttatgtgcaacgttgtcagctgttaatgctcctatttatgaataggtcacctttgtttgaaaaaagcgtacaaggttttctaactccaaatctttccagccacaatattgctacgttaagcagaactgtcaaagataaaacttgaaccaaagtgattttctagactgtttgaatgttaaccctttcctgcaatattggttaacagtcacgtctccctacctcttcatacctccttggttttattttattatttttattttttgaggcacggtcttgccctgttgcccttgctggagtgtggtggcatgaacacagttcactgcaacgtcaacctctgggcttaagtgatcctaccacctcagcctcctgagcagctgggagtagtcccacttgtagtccctacagtcccacctgtagtcctgtagtcccacctttgtattttttgtagagatggggtttaaccatattgtccaggctggctttgaactcctgagctcaagtgatccacctgctttgacctcacaaagtgctgggcctcccaaaatgctgggattacaggcatgagccgctgtgcccagccacatccttggttttaaattgttatttaaaaaatactgttgctgggcacggtggcacatgcctataatctcagcactccgggaggccgaggtgggaggatcactttgaggccaggagttcaaggccagcctgggcaatatgataaaaccccgtctctacaaaaaatacgaaaatttgcagggtatgatggtattgtgcctgtagtcccagctacttcagaagctgagtcaggaggatcccttgatcctgtaatgaaatatactatttttttttttttgagatggagttttgctcttgctgcccaggctggagtgcagtggcgccatcttggctcaccgcaacctccacttcccaggttcaagcaattcacctgacacagcctccctagtagctgggattacaagcgtgtgccaccacacctggctgattttgcatttttagtagagatggggtttctccatgttggtcaggctggtctcgaacccagcctcagcttacccacccacctcggcctcccaaagtgctgggattataggcacaagccaccacgcctggccatgaaatatactactaataaaataaaatactgtgataaaacataaataaacatttttattttttactttttacttttttagctggcattctggtctgagattattttattttatttttattttattcgagacagagtctcgctctgtcacccaggctggagtgcagtggcacaatctcagctcaccgcaacctccgcctcccggattcaagcaattctccctgcctcagcctcccgagtagctgggattacaggtgcccaccaccacgccctgccaatttttgtatttttagtagagacggggtttcacaatgttggcaaggctggtcttgaactcctgacctcaggtgatccacccaccttggcctcccaaaatgctgggactacaggtgtgagccactgtgcccggcagagatttttattttttaaatggcaaagctaggttatgaacaggatgaccatatgttccagtttgcccaggacaattctggatcatgcctgttatcctgacattattatttattattattttttcttttgtagacacagggtcttgctctgctgcccagctggagtgcagtagtgcaatcatggctcactgtaaccttgaaatcctgggctcaagtgatcctcccacctcagccctccagagaggctgggactataaacacacaccaccatgcctggctatattttgtgtgtgtgtgtgtgtgtgtgtgtgtgtgtgtgtgtgtgtgtcaggggggtgggtaaagatggggtcttgccatgttgcccaggctggtcttgaacctcctggcctcaaactcttggtcaagtgatcctcccgcctcagccacctaaagtgctgggattataggcatgagccattgtccccggctatcctgacacaattattaatagacacataaatgtgtctcatttactctcaaaagtgtcccatttggataataaattatctggtcacctacatatgcattacaatcattttgttgtactaggttttgtttgttgaaatgttatttgaactaggaccataagataatggaattttggcctattttgggtacatttggatgtttttcattggtcagacatttttattgtatggagagttctgagtgtacaaatgtatattaaatagtaatgcacatgatttgaaattagggattatttgttatcttacttttgggaggttacataaccttgaggaacctcttgtttcctcatccgttaaaaagagataatagcgatacctatcctacatgggtgttttgaagatattaaagaggtgacataccaaaaaatgcattttaagttgaaaattgttatataagtgttagtcatgtcacacatgtgcctttctgcaattgaatttaaaatgaataattttacctagtttggggaacttactatttgatagagcactggtagtgttttgctgtaaaggagagcagggaaataatggtagttggaagtacatgctgggctaaggttttctgcggggaggttttgaaattttcacatttgtgtgctgaaaagagtggtccaatagaaagcagaaaaaatagatgatgcttgacagaaggaagaaatcaatgttgagtaggaaagaaggatagaatctagaatacatatggaaggattggctttacgtaaccaagaaacacatttccctagtctgttcactttaaaaaaaaatgccaacaatataatttttttttttttttgaagcagagtcgtcggccgggcgcggtggctcacgcctgtaatcccagcactttgggaggccgaggcgggtagatcacgaggtcaggagatcgagactatcctggctaacacagtgaaaccccgtctctactaaaaatacaaaaaaaaaattagccaggcgtggtagcgggcgcctgtagtcccagctactcgggaggctgaggcaggagaatgccgtgaacccgggaggcggagcttgcaagtgagccgagatcgtgccagtgcagtgcagcctgggcgacaaagcgagactccgtctcaaaaagaaaaaaaaaaaaaaaaaaaaaaagaaacagatcctccctctgttgcccaggctggagtgcagctgcccgatctcggctcactgcaacctacctctcctggggtcaagggattcttctgcctcagccccctgagtagctgggattacaggtgcgccccaccgtgccaggctaatttttgtatatttttgtagagatggagtttcaccatgtcggccaggctgctctggaactcctgacctcaagtgatctgcctacctcggcctcccaaagtgctgggattacaggcgttagccactgtgcctggctctctcagtataatttacctaaagtcaaatcagccttccctttccttcccttcccttcccttcccttcctttcccttcccctcctttcccttccccttccgcctttcccctttcccttctcccttctcccctttcccttctcctttcctttccacagggtcttactttgtcgcccgggcttgagtgcaatggggcaaacacgtctcactgcaaccttgacctccccagcccaagccatctacttgcctcagtcccccaagtagctggggctacaggtgtgcaccaccacgcctggctattttttttgtattttttgtaacaatgccgggggagtggggtgggggtggggtcttgctatgttgcccagggtggtcttgaactcctgagcccaagtgatccacccacctcggccttccaaagtgctgggattacaggtgtgagccactgtgcctgatccagcctctttttaattaattctgtcccccttctcacccaggcaaccacttttggacttcttttactatagatgttagttctgcctgttctagaacttcacataaatggaatcatacagcaaggagtattttgtgtctgattacttttgttcaatataatattttttagattcacccattttggtgtgtgtatcagtagtttttcccttttattgtgaagtaatattccattatatgtatgtagcaacaagtcttctattgatgggctttgggttatttccagtttttggttactatgagtaaagttgctatgaacatttttgtatatatctttatgtggacttgggtaaatatctaggagtgaaattgctgtgtactagggtagatttatgtttaactttagaaaccactaaacttttccaaaatggaaaatttaacactttttacattcccaccagttttttttttatgagagttcagttttccacattcttcacaatgtttggcattttaaaatttaggcattctcctgagtgtgtacttgtatttcatcatggtttttgtttatatttccttgatggctaatatgtgattattggccatttgcttatcttttattttgaagtgtcaattcatttctgaaatattatcactgaataatatttcattgtatagatatgccacaatttatccatttatcacttgatagatatttggattattttcacttttgggctattatgaacaatggtgctataaacatttatgtacaagtttttattaaacttttatgtgcaaccctattttattgggttgtctttttgttgctgatttgtaggagttctctttatatctgaatgcaggttatttgccaggtttctcagattttacacgcacatacacacacacacacactctttctctctctctctctaaatattttctcctggtctgagctatgttgttgcattttcttaatgccttttgagagcagaacttttaagttttgagcaagttgaatttgttgatttattttattttatggtattaccttttctgttctaagaagtctttccttactctctgctaggcttgtgaaactattctctcatggtttttttctagaagctttatgtttttgtcttttgtatttaggcctatgatctatcttaaactactcttttgctatcatgtaagggtttctcaaaaggattttcaattaattgattagatagctgtgggtcttttcttggatttgttctattctgttgatttatttgtatcttcttatgtcaatgccacactgtcttaattattgtagctttataagattggtattgttactttaaattttgatagaattaatcagtgcagccgtgtgggcctggagtgtttttgtgggaaaaagcagaaggttttaaattagtgtaattacttttacaggtttaattactttagctgatatataagcattcaggttcttcactttttcctgtggcagttttaagaagttgaatttttaaatgaatttattctcaattgttgagttgttataaagttcataaaatttcctaatattctgttattgcctgtatgaactgctgtatgtctccatttgcattcttgatgttggtacttcttttgaatttttggatcagttttgctaggggtttagcaattaatcttttcaaaaacccagattttgttttgttgaatttctattttggacatgtatttttaatttttttttttttttttttttttgagacggggtcttgctttgtcacccaggctggagtgcagtggcgcgatcttggctcactgcaagctccgcctcccgggttcacaccattctcctgcctcagcctcccgagtagcagggactaccggcacccgccaccacacccggctaattttttttgtgtgtttttagcagagacggggtttcaccgtgttagccaggatggtctccatctcctgacctcgtgacctgcctgcctcggcctctcaaagtgctggtattaggggcatgagccactgcgcccggccaccttgctctcctcttgtggatttgatttgctctcttttttctaccttttttgagttagaagtttagattattgtttttaaacctttcttgttttctaatgtgcatttcatttcattcattcattcatacattcattcagagacggagtcttgctctgttgcccaggctggagtgcagtggtacgatcttcgtttactgcaaccttcgcctcccaggttcaagcgattcttctgcctcaggctcccgagtagctgggactataggcgtgcaccaccacgccaggctgatttttgtatttttagtagagacggggttttaccatgttggccaggctggtctctaactcctgacctcgtgatccgcccaccttggccccccaaagtgccaccgctcccagccacatttctttcattattattattttttctttgctaacccctagtagtcattctaatgtacatttcttatataattaacattttcttctaagtactcctttagctgcagcatacaatttcgatgtgttcaattcaaatttctatttccattgtgatttttctggtccacaggtcatttagaagtttattgtttcttaatatttggggattttttagctattttcaattttacatggtgttcagggaatgcgttgttgacatattgtgtacatatctgtaccatatatctgtaaatgataagttgtttatcattttaatcctttgatagctactgagattagttttaaggcctaccctgtggtggtctgttttggtgaatgttacctgtgtctctaattccgctctgcaatattttgaggttttcagtgtagatattttatgtatcttttattaaatacggtgtatactgcagttattgaatttagtgttctataatttatcaattaggtcagatagttttatgtgtttgttactatataactgagatataattcagctactgtaaaatgcaccacttaaaaattgcacagctcagtagttttcagtatattcacaaggttgtacagccatcggcactatttaattccagaacgtttttgtcccccaaaatgaaaacccatacccgttagcagttactcttcatgtctccctaacctctaacccctggcaaccactaatctaccttgtccctacaaatttgcctattctgaacatttcctaagtggaatcatataatatttggccttttgtagctggcttttttttttaactaagtatgttttcaaagttcatacatgttgtagcgtgtatcagtatttcattctttcttatgactgaaataatatttcattgtatagatatgccccaatttatccatttatcacttgagagatatatgggttattttcacttttgggctgctatgaataatggtgctataaacattcatctacaagtttttgtggtgttctatttttctatttcccctaagggtagaattgctggggcatgtggtaattttatgtttactttttgagcaactgccaaactattttccaaagcggctgaatcactttataatttgcaacagcaatgtatgaagattccagtttctccacattcttgtcaatacttgttactgttctagtcttcgctgagaggctctgtgtgcttgttggagcacactttcagcactcaaccaggctttcagttcatccatagccttgacttcctgttttgccgagcttcatgctcagtcagtggtgattgcttagggccttctcaggtctttcttgagtatgcccataggcctgggcacactgttttcatcttccagggtcttaggaatttcagaacttttcaaaactccctatggacatctcattctcctacttttccttttgtgttttttggttagcttgtttgccccagctgcttcagggagctgaaatgttaagcaattgtagctgattgtttttgacaaataaataccttgggggaaaagcctgttagcaatgggcaagctctgaatcaggttaaatattaggaagtcttgggagtggggtttttcagggaattgctagtcagctcaaataataactgtactctgaaaatgggactttgaaggaactctagccctgttctgtcacctccactggctgctaggctccaggattccacagattgtggtttgctgcttttcagggctagcctggagctgggaagaggggcatgggaataaggcatgttaaaatgccacaaagcttgctattcttactgagatgcagccatctttttttgaataaatgctccttggattgttgcaaactttttggttaatattcagagttctgaaaaaggctatttttgactttttttttttttttttgagatgcagtcttgcattgtcgcccaggctgaagtgcaatggtgtaattttggctcactgcaacctctgcctcccaggttcaaacgattcccctgcttcagcctctggagtatctgggattataggcacctgccaccatgcccagctaatttttgtatttttagtagcgacggggtttcaccaggttggccaggctggtctcgaactcctgaccttgtgatctgcccgccttggccttccaaagtgctgggattacaggtgtgagccactatgcccggcccaagtcttgacatttttttgccagtgttcttgttggttttatggaagagaggatttttggaggtccttactctgccattcccaatgatgtcacccaatttgttttttaagcattaaaaaaaattattttaaaatataaagacagggtctcactatgtcaattaaaaagacagggtctcgcccaggctggtctcgaactcttgggctcaagtgattgtcctgccttggcctcccaaagtgctgagactacaggtgtgagccaccacacctggcctaaacatttttaatatatctgtttttatatcctgttcctcccttttcttttgaaatacaactcacagaaattgcaaaaatagtacagaaagttcctgtgcaccattcactcaacttcccccaatgatatatcttttataactatagtgtgttaccaaaaccaggaagctgatttcggtgttatacaatagtattaaattaactatagacgttattagaatttcacgggtttttgtatatactgtttttaattgaggaggtggtggtgtatagttctataaagttttatcatgtccagattcatgtagctattaccacattcagggtattaaactattctgttaccacaaagaaatttcttcatattatttctttatggttatgcttttctctgaaccctaacccctggcaactactgatctgatttccatcactgtaattttgtaacttcgagagtgttatataaatggaatcatatagtaggtaacccgtagatacggcttttttctcacttagcacaatgcctttgagatccgtttaagttgttgtgtgtgtcatagttcattcctttttattgtttctcttttatgggtgtaccatagtttgtttacctatttacttgttgaaggacatttattatgtttccagatttttaccatttttttttctttttctttcttttatttgttttttttgagacagagtcttgctctgtcacccaggctggagtgcagtgccgcgatcttggctcaccacaacctccgcctcccgggttcaagtgatttttctgcctcagcctcctgagtagctgggattacaggcgcacactaccacacccagctaatttttctgtttttagtagaagcaagttttcactatgttggtcaggctagtctcgaactcctgaccttgtgatccgcccgcctcggcctcccaaagtgctgggattacaggcgtgagccactgcacctggcccattttttttttttttcaaacagatatggttttgctctctctgtcactcaggccagagtgtattggcatgatcattgcacactacagtcctcctgggcttaaagaattctcccacctcagcttcctgaggaactaggagtagagacatgcacaactgcacccagctagtaattttaatttttgtagagatgaggtcttactatgttgcccaggctggtcttgagctctggcctcaagtgatcctcctacctcagcctcccaaagtgctgggattacaggtgtgagccaccatggctggcctagtgttttacaaataaatctgttaggaacatttgtgtacagatttctctgtgtacttaagtttttcttcctctgggataaatgctgtgtagtgtgattctttaatttttggtgtgtctgcctgttttactaattactgaaagaagggtgctaaactaagattatgtatttgcctatttcttttgtttctaagtttttaaaaaagtattttgaagccattttatttggtgtgtacatattttgtattgttacctttagcatttcttttcttgatgatttgacctattttcatgaaatccctttgtatctggtgatactctgtattttaaagcttaccttgtctgtgtcttaatatagccactgtatagtgtctatatagtgtcttaatatagccactgtaatttatgattagtgttttctttttttttcttttttttattatactttaagttttaaggtacatgtgcacaacatgcaggtttgttacatatgtatacatgtgccatgttggtgtgctgcacccattaactcgtcatttaacattaggtatatctcctaatgctatccctccctcctcccgcctccccccaccccagtgtgattagtgttttcatggtgtgtctttttgctaactttttattttcaaaacttctttgtctttataaaagtgtatcttgtgctaggcatgctggctcatgcctgtaatcctagaacctagggaggctgaggcagaagtatagcttgagcccaagagtttgagatgagcctgggcaacagagggagacccagtctctattaaaaagaaaaaaattaactgggtatggtggctatagtcccaacttattgggaggctgaggtgggagagcttgggaggttgagcctgcagtgagctgtgattgcaccactgccctccagcctgggcaacagaacaggagcctgtctcaaaaaaagaaagaaacaaaagatcagaacctataatcacagaatcactgaaaacccatggaattatcatatgctagccattgggaatacaaatgtaaatgagatttcaaaaaaatctttaccctttgttgtctaggtggttaagatcagttgattgagataaagttcaaagcaacccctaaaatcaactaaaaagttcatcaaaggacttttagaactgagcaggagggaatgaataaatctttgggagggagggatgcagtgccttgatatacagtaccaggagccattttctacattgttaacagcactcttgagtgatgttggtggcagcttgtatatcttatgtggaagcccttgggtaggagtcgatcaggaaaaacttcccaagacaggtagcatacagggaattttaaaaagatgaatgggagtttgccaggcaaaggaagcaggagaagaactttacaagcagagtcttattcaaagaacagtaaggcattatgattaaaatagtttgtatatattagaatggtgagaggtaaggttaaagaattactgaattttgattatcttagtgtgcacatttcttcccattttaacaactctgaaattggcatacatcttacaactgattgtgttttgcatcaccattggaaattgggattattttatgaataatggcatcttagatatgatgaaatatggtaagtttgagtagattcaatgtcctttaagttatgcttttggattttatcctattaataatcagaagctaggtagattttaagtagaaaaatattatgtctagaattgtttaaaataatatgattttggtgatattgtgcaggatttattgtggctaaaacaattgctaacaatgtagaaattcaggcaatgtctgcagagggcctagtgctagtgggtgtattgtgggaaatccaggtacaggaagcgtttgataaaaccaagatgatgtcgttactagtaagatggggctagttgacgtagagagaagagtcatataaagctgaggtttctggatttaaagagaagatgactggtgtaacagttaaaggcagtcattgttagtgtttattctggcatcataattaaatgtttctattactgagagggctaatcaacattcaaacattaatatatcaatagccaagaaaagattttctcaggaactcttactgtaaaatatatgtcagtataaaatttgttgactgtccaataaaataataattatagtgtaggtttatgttggctgcaagcctaaattatgagacatttataaaattactgaccgctcccccccccaaaaaaaaaagattgttcagaatctctcatcctagcatccattccaagaaaaagatattgctaacatttggaataaaaagtaatcccagtacgggttagtcatagtttttggctatagactaaacctcatcttgttcacattctagtagaacaagataaaaacaaatgcttattcatatagtatgttcatcatttaagaaggtcatagtatttactggcctggacactagtttatatgtgtttgtatttaagaaactagccattataatctcaattatgtgcagtgaaggagagagaaacgtgacatgagcaaagttttatttgcttttgaaaataattgtatcttttttacttaacttactatttcaagatatcttttatatgctactttatttaattaatttgtttttaagacagggtcttattctgtcacccagggctggagtgcaatggtgcaattacagcttactgcaacctcgaccttccaggcttaagcgatcctcccacctcagcctccctggtagctgggattatgggtgtgcaccaccatgcctggctcaattttttatatttttctttttctttctttctttctttctttctttttcttttctttcttttttttttttttttttttgaggtagtagcatactcatggctcactgtagcctcaacctcctgggctcaaggattcttccacctcagcttccctagtaactggggctataggcacatgccaccacacgcggctaatttttgtattttttgtagagatggagtctcgccatgttgcccaggctggtcttgaactcctgtgcagaggcaatgcgcccgcctcagcctcccaaagtgctgagattacaggtgtgagccactgtgcccagccaattttttgtagagatggagttttggcatgttgccctggctggccttgaactcctggactcaaaccatctacatgcctcagcctcccaaagtgctgggattacaggtgtgagccaccacgtccagcctgtgctaatttaaattattttctcctcactgctgtactagccacaacttctgcaaccagtttcatgtgggctttggacaattgcagcctaacagcatcactcatcagggtctatgttgcatacgttctcccttggggaactgtaatgttaagattaggctgggtgcggtggctcacacctgtaatcccagcactttgggaggccaaggagggcagatcacgaggtcaagagatggagaccatcctggccaacatggtaaaaccccatctctactaaaaatacagaaattagctgggcatagtggtgcgtgcctgtaatcccagctacttgggaggctgaggcaggagaatcgcttgaacctgggaggcggagtttgcagtgaaccgagattgcgctactgcattccagcctggtgacagagcgagattctgtctcaaaaaaaagaaaatgagcactaataatcttttctatattacagttttataataaaaatgcattacatattaaacagattcacaaagtgaactaatgacaatttacgtctgtccctatactttcagttgtaagtaactaaaaaccagcctcaaatggaaataaacaaaactaccgacatatgtaattgaaaagtccagatacctgggtgatgaaataacctgtacaacaaacccccatgacacaagtttacctatgtaacagacctgcacttgtacccctttacttaaaaaagcaaaacaaaacaacagaaaagttcagatggagtataggtttcaggtaaagctttattaggtggtccaacaacttcattaatgacctggtttctttcagttttcgcactctgctttctgtggtgttaaatttatcccaaggcagccacattgaagccattaggtttttaaggcttctagcaccttcttcatttatatctattagggaaaaatatgttctgtatctgagcatcatagaaaaaaatcttgggttcattctgattttcctggcttaggttacatgccagtctctgaactgattactaaggctagagaaatatattgtgctgattggcttaggtttgccccagggatcaattccacccaaattccattcttgagtgaggaaatttggggtaaaagagggaggatagcaaggaaaagatgacagacacacaattccagtttattataagaatgacttcaaatgaccttaactgaattgtaatattatttgggaacaagtcaaacattattaacatttaggcccagagatggtagatggcttgcttaagtctcccagcaagctacctcaagaactgagacttgggctgggcgtggtagctcacacctgtaatcccagcactttgggaggcccaaggcgggtggatcatttgaagccaggggttcgaaaccagcctggccaacatggtgaaaccccatttctactacaaatataaaaattagccaggcgtggtggtgggcacctgtaatcccagctactcagcaggctgaggaaggaattgcttgagcccatgaggcagaggttgcagtgagcagagatcatgccattgcactccagcctgggtgacagagagagactccgtctaaaaaaaaaaaaaagaaaaaaaaaaagaactgagactcagaagtgaattatttgactcttgaattgtacttcattcttagaatcaattattggcctctctgtaagactgtctttactgagtttttaaacggagtataataaactcttttgggaatgcggtagatgttcaaaggtttgacttcttaaaaagaggtgtaacaattatattccttaaaactgagaggggaccaattgagggtagagggattgatgtgggggcaggaggatacttttttgttgttattgtgatgaaaatgttccatagttttgtggttatatgactgtatacattgaactggatgcttacaaacggtgataaaaagggtgaaggaaaataaaaaaccaagtagcccaataacactgctcatccttgtttttttgttttgttttgttttttaaataacaagttctaggagtttttgtttgaataagaatatataaatcaggcagagtagtcccagtgaaatcatggttagattttactgtatttgtctgttgatccttcaccttctaagcacttaaaatacttttttattagacttgctttgatcacatatgcaatttaagtgtgaataagtaagtgtattatctttccctcctccactcagctttctttaaatagaaaagggacaaatatctctttattgcatattcagccatagttgctcaatctatggtgttaataagagactgtaattttatcttctaaaaatcattacagattataattataggctgtacctcattctcttaaagaaatattggcatgttagtccattgatattactgatagttgccaaatggtgagaatggtaactggtttggaggcaactgaaagggagggggaatcatcagtaaactggagaccaataaaaaattacacagaaacaaatctttttggataaactagatgaatgtctcttattgagactgatccaacagtattcactggcccatttcttgctgctagatgagcttctgtttaaggcatcacttgtggtggagttctttcttttatttggattggaaccatactgtgatctcttatggaaaacagacttcctccaagtctgttaaatataatttaaaattatatcgtttcttgttgatttgtttgtttttgttttgctttatttcatgttataggcatctgaaatgaatccttatatatataacatacaagtatatgtatgagaagacatgaatataagaagtataggaaacataagacatgaataaaagttttagctagacatttttagatgaaaagatgtgcatttaaatttgtaaaagttacaaatcgttctataaaaagttagcatatatttaaattttttggatacataataagagaattatatcacttctgatatccattgtgaagaccctaccacagtcatttttttgtgaagggtagatagggctcttgcttgtactcttccaggatgtgccacgggctccctaataacattcaggggagtgcatgtgcaggtttgttacatgggtatatcatatgatactgaagtttggttttgtaatgatccccatcgtctaagtagtgaacatagtaaccaataggtagtttttgagcccttgctttcctgtctccctccctgattttggaatctccagtgtcttttgtcccgacatctttgtgtctctgcgtacccagtgtttagcttccacttataagtgaaaacatgtgatatttggctttctgtttctatgttaattcacttaggataattcagctgcatccatattgctgtaaaggacatgatttcgttctttttttatggctgcatagtattccatggtgtatatgtattgaattttctttatccattctaccattgatgggcacctaagttgattccatgtctttgctattgtgaagagtgctgtaataaacatatccctttttggtagaatgattcattttttttcattttttttattttttaggcagagtctcgctctgtcgcccaggctggagcgcagtggcacgatctcgactcactgcaacctccacctcctgggttcaagtgattctcctgcatcagcctcctgagtagctgggactacaggtgctcgccactacacctggctaatttttgtattttttatacagatggggtttcaccttgttggtcaggatggtcttgatctgctgacctcatgatccacccacctcggcctcccaaagtgctgggattacaggtgtgaaccaccgtgcccagcctagaatgattcatttttctttgggtatatacccataatgagattgctgggtcggatggtaattatattttaagttttttgagagatctttaaacttcttttcacaggggctaacctaatttgcattcccatcagcagtttataagtattaccttttctctgcaaccttgacaccatctgtttttttttttttttttttttgactctttagtaatagttattctgggctgggcacagtggctcacacctgtaatcccagcattttgggaggctaaggcaggtggatgtgctgaggtcaggagttcgagaccagcctggccaacatggtgaaaccccatctctactaaaaatacaaaaattagccaggcatggtggcaggcacctttaatcccagctactcaggaggctgaggcaggagaatcacttgaacctgggaggtggaggttgcagtgagctgagattgcaccattgcactccggcctgggcgacaagagcgaaactccgtgtccaaaaaaaaaaaaaaaaaataggtattctcattggtgtgagatggtgtctcattgtagttttgatttgcatctttctctgataatcatctttttttctaaatgtctttatgctacctctaaaatgttctacgtataataggcaaatcaaatgtttaataaactggtgtgttaggtttattttcaggttgaaatgaagatagttatttttattttgtgtaccttttacatatcaacttacttttagaagtatttctaacttgtgttttgtgtttttttagagaaaatattctctttggaatgggaaatcctctgcttgacatctctgctgtagtggacaaagatttccttgataagtaagtattaaactcttcatatgcactatgtggaacttacatttgaagaagaatggatgaaaactttagaagtgaatttaccaccgaatgtcttcaattaaaggaaaactcaggaaatttaagtttggtgatagcaagtgtgctatcattaactattgaataactgagtacagttttccttgggaaaacttatatacattgctatttttacttaaaacttttttgcttattatttggaaggagaaaagtttatataatttacctaattatttaattccccaacttttaaactactgtcagtgagctacgtctataatggtatcataatctacagacattctaccccgaatgtgcccagtctggtttcctctcagaagctataatgggagaagaaagatgattagagaagacaagagaacgtgcaggatataattcagaggatatgaagctctgctgtttccgctttattagtaacttccaatgtttcaacttagctgagaaatcagtttgtttatttacctaagtatttgaggccatttcgtacaatagtccccacttgtgtccttgttttcagtttctgaggtctcagttacccataggacagtgtaataagacattttgagagagagacatgcaccacgtccacataacttttattacagtatattttaatagttgttctatttttagttagttgttgttaatctcttattgtgcctaatttataaatgaaactttatcatagtatgatgtgtaggtatgtatgtgtaggaaaaacagtgtgtgtgtgtttgtgtgtgtgtgtatatgtatgtatgtatgtatgtatgtatgtatgtatctatctatctatctatctatctatctatctatctatctatctatctatctatatatggttcagtactatccatggtttcagatacccactggtcatcttacaatgcatctacctcggataacgggggcactactatatggcaaatttaagtagtaaaaaagattaatgatgagaaagcaagatcccccctctcctcacacaccctgatttctgtacccaagagtaattactttttaaaaaattgaggcaaaatttatatcgcataaaattgatcgttttaaccattataaagtatacaattcagtgactgccagtatattcacaaagttgtacaaccatcaccactatctaattcaggacattttcatcaccccaaaatgaaatcccatacccagtaagtagtcattcgctattccctcctctaacccagtctcctgggaactactagtatacttagtttttctatgaatttgtctattctgagcattttatagaaatggaatcatataataatatatgatcttttgtgtttatatatatgaccttttgtgtttgggcttattttacttatgtaatgctttcaaggttcatccatgttgtagcatgtatcagtccttcattccttttaatagtggactattccattgtgtggatagaccacattttgtttatccattcattggttgatggacacttatgttgtttttattttttgtctattaggaacaatgcttcttatgaatattcatgtataagcttttgtgtaggaatgtgttttcatttctcttgggtatacacataggagtggaactgctgggtcacatggtaattctgtgtttaacttctagagaaaccaccaaactgttttccaaagcagctgcactgttttgcattcctaccggcagtgcataagtgttccagtttctctacgtctttgccaaagcttattttttattttttaaattatagccatatgagtgggtgtgaaatgatgtctcattgtgattttgatttgcatttttctattgaaaacttttgatgttagcatcttttcatatgcttattggatatttgtatatctttgggaaaatgttgaagctctttgcccattttttaattgggtcgttgtctttttgttaagttgtaaaagttctttttatattctggatactagaccctatcagctagcatatgatttgcaaacattttctcccattctggggatttactttaattttttgatagtatcctttgatgcacaaaagttttaaattttgatgatgtccattttatttttcttttgttgcttatgcttttgctgtcatatgtaagaatctattgttaaatccaggatcacaaagatttgtgcctgtgttttcttctaagagttttgtagtttaaggtcttagatttaggcatttgatcaattttgagttaatttttgtataaggtatgaaataagggttcaactttattcttttgtgtgtggaaatccaattgtctcaacatcatttgttgaagagactattcttttccccactgaatgatcttgatactcttgacaaaatcaggtgaccatagatatatgggtaaatttctggactccattctattccattgatacatatgtctgtccttatgccagtatgacattggtgtttttgtgtatgtgtgttttgttttttgttttttttttggagacagggtcttgctctgtcacccaggatggggtgcagtgatgcaatcatagctcactgaaaccttgaactcctgggttcaagtgatccttctatttcagcctcccaagtaactgagactatatgcaggtaccaccatccctagctattttaaatttttttttgtataaacagggtctccttatgatgcccaggctggtctcaaactcaagtctggcttgatcctaggcccaagttgtcttcccaccttggcctcccaaagtgctgggattataggcattagccaccatacctggcctgtacgacactgttttgattactgtagctttgtagtaaattttgaagtcaggaagtgtcagtcctccaactttgtttttcaagattattattattattattattaatttttaatttgagatccctcacaattccatatgaatttttggggatagctttttcatttctgtaaaaaaggcagttggaattttgattggaattacattgaatgtatagataaatacatgattaagtcttccgagttatgaagacagaatgtctttccatttatttaggtcttttttttttttttttttttttggagacagaatcttgctctgttgtccaggctggagtgcagtggcatgatctcagctcactgcaatctccatttcccgggttgaagcgattctactgcctcagcctcctgagtagctgggattacaggtgtgtgccatcatgcctggctaatttttgtatttttagtagagacagggtttcaccatgttggtcaggcttgtctcaaactcctgaccttgtgatccacccgtcttggcctcccaaagttatgggattataggtgtaagccactgtgcctagccttaggtctttttaaaataattttagcagtgtttagtaggttttcagtgcataagtcttatacttctttggttaaatttaattttattatttttgatgccattgtaaattgggattgttttattttcttattgttcattgatagtatgtagaaatataagtaattatgggggacaataatttttttgaaacttttttttatatcctggggattacccctgtaagtatatttggctaaactcaaatgtcaaagggtaaggcaagaatttataaatgtgtaaatttgacttacggtaatataataggaaatgtgctgggggtctaggataaactgggagatgtgttttatcctaagacattcagatagaaactttaaaacacactttcccagtcagaaaatactactatatacagttactttaatgattttagttcttttggttaccttgtacttttaaataatatactatacttacatttcttaaaatttctttttctgtcaaatttcaggctgggcgtggtggctcacgcctgtaattccagcacttttggaggctgaggcaggtgaatcacttgaggtcaggagttcaagtcatgccaacatggcaaaaccctgtgtctactaaaaataccaaaaattagccaggtgtgatggcacgcacctgtagtcccagttactcgggtggctgaggcaggagaattgcttgaacccgggaggcagaggttgcagtgagctgaaattgcaccattgcactccaacctgggtgacagagttgacactctgtctcaaaaaaaaaaaaaaaaaaaaaaaaaaaaattaaaccaagccaaaccacaccaaaacaaaaaaacccaaatttcaatggaatccattgacttctcattatggagaacgagattactggtgcccctattctttcctatgctacttcttctatctttctattctattaactgtgtttttaaggttgatgttttcattctgttatctatctataattgttttcccaactttgaatacaaattcataatgaaagttgaaaatgacttacccacattatcactctgtgtatcatttattgcagaattaagtagtgtaccaggaatgtagagcaggttaacatttgaaatgtaattagaagactgggcgtggtggctcacgcctgtaatcccagcactttgggaggctgaggtggatggatcacttgaggtcaggagtttgagaccagcctggccaatagggcaaaattccgtctctattaaaaatacaaaaattaactgggcatggtggtgtgtgcctgtaatcccagatactcgggaggctgaggcaggagaatcgggtgaacctgggaggcggaggttgcagtaagctgagattgcaccactgcactccagccagtgtgacagcctgagaatctgtctcaaaaaaaaaaaaaaaaaaaagaaatgtaattagagtaattcactatagtaagaaactaacataacagtctaagaaaactccatataattatctcaatagacaaagaaaaaccttttgacaaaatctaatatctattcctgatgaaaaaaaataacttaaagcaacctaggtaactatgtcgataactttcttaaccctataaaggttacgttaggggaaaactggtagtgtgatgcttatatgggtatataacgtatcaaattgtatactttaaatgtctacagtttattgtatgtcagttatatatcaaaggctgtaataaacagaaaataaaatcagttggacatgaattcatgggtttaaaattagatctcttttgtttgtgtagtgtgagatattttgttcaggaagtcaactaattcatggtcactattttaaaaaaatcatgatgtataaaagtaaagagcaacttaaaaatttgaaattttatcgtgtatttcaaaagtaaaataaagtatagagacaaacccataaatgtagaacattttatatgggaagcaagaattgaaatttgggatatacacacagaccaggtggtctttgctatgtctgaagaagaaagataagattggaagttttataaaaaggtgaaatgttttgtattgttttgaaagaaagctcattggcactagttttggggaggtggcaagctttgattggtgagtgactgcagtgagtagaactagtcttttagagtcacagctcattgtttcagtagctactggataaaactgttttcagatgacaacaggcagtttcagcagccaggcttgcagagaattaccttcttggagcaatgttatgtgtgctgagtgctcttccccccagcctgtcacctgttttagtcagatatgacaagaatgacccaatttatatgattagctttcacacatatataatcagtgttgttattttggtgaacatgcctccagatgtttgttaggcatatataacctgaagatgaatgtttatgggctaatactatgtgtagtctttgttagtatgctgtttttcactcaacattatgtttttggatcactgtttttaaaatttcaggcaaatgtgatcagagtgattatgacttggcagctgtgtgatgatgtcacaggatccttagggtgtcgcttttccagccagaagccactgtggttggtggagcctttgcctgaggtttgcttgtgcctgccaggcttgttctgcttgtttggcctggcaggctgcgttcggctcatgctaccagcctggatcccacacctgccaagggcgagccaggtgcagagtggcgtggcaaagagtgtgtgagcaagcgaatatgggatctggccactgtgtacagccactcatgctggctgctgtggtggggtgggcatctccaggcactggcacaggtgctggcttcatgcaagcttgcggctggatctgatgcatctcaagtggcttccactgtaggaacccacgtctggacgaggataatatggtggtgcccagaagcttggagacaccagaaaccacagagccccaaagagagtgtcacagccctggattgggaaccccctaggtctgggctctcagaagggctgcagctcttctttccttcttgttgcctgcaaggtgctgagtggggtgaggcatattttagctctgtttgtgttacagctgtttcagtcctgccacttggtgggtcttcttatcctgcatccatgaacagtgaggtatggggacaactggagggtgagcaaggtggagaggagcttcattgagcaacagaacagctctcaggagacccgaagtgggtagctcctttctgcaggcaggtcgtcctgacaagtgttcacctctcagtgagatgagaccccgagggggtaactcctttccacagttggtagtcccaggtctcttctgtaagtctggctgagtccagggtttttaatgggcttcacaagggagaagtgtgtgctgattggtccatgggcggctatgggtgggtctggaaaaagcaccatgagtctcactcccctcagtggaccccacctggaactgatagcctggcccccatgcttcaggctgtccctggcttgaaggcagggcttcacctgaacccaccccttttttcccaggagagtgtctgcctcctgctgccatcaatcatgttgtccacagtgtgcaggctgttggtgatgagggtacttgctggccccattgagctgccctcagtcccaccttggcctccttcccatgcttctctgcacctaaagtccagagggggctgagggggcagggggctggtatgtcagtgctgccccgagcacatgcacacctgctgggttgtgacagtgcctgggcttggccacgactttgctccaccctggagcaggtgctgggatcgaggagaggccaggcatgggaacaggcacttctgagtctgcaggggaaagggggacttcccgggccccagagagtgcagggatacctgggtccacagccatggctgggtggctgcagctgcactcaggagggtggggctccagccctgccaacttggaagtgggtgtggctcccacctgttcccagctcccatgggctctgtggagcatgcagccctggctgcatctccccaattgtagccagtgtctttgcagcagctgctctagacagcctgctgctgccatcaatgacgctgctgggagctcgagtaacttctttgttttacatgttttactagcagctggtcctaagtggctagctgaagttctattttatatttggaaggttttaatctttaactttgattttcaaataagtacttgaagataaaaaacaagtctttggaccctaacaataaaagagtcttctctattgttactcctggctatttcttccaaatatatttaaaaacttaccttatgatataaacgaatcgtgtttagcctacattttgagccaccattagataagtatttagataagtactatgtatatatatattttttatttttttatttttttattttttatttttgagttggagtcttgctctgtcacccaagctgcagtgcagtggcgcaatctcagctcactgcaacctctgcctcccaggttcaagcgatcctcttgcctcagcttcccgagtagctggaactacaggcatgtgccaccatgcccggctaatttttgcagttttagtagagacagggtttcaccatgttggccagggtggtctcgaactcctgacctctggtgatctgcccacctcggtctcccaaagtgctgggattacaggcatgagccaccgcacccagcatagataagtggtatattgctatggtttgaatgatggtatcctctccaaaaattcatgttgaaacttatccccagtgtagcagtataagaagtgtgactcttgggggttgaccaagttatgaaggctctgctcttatgaatggggttagcacacttgtgaaaggactcaaggttgaagggagagctctcctgcctttacattccttctgtcatgtgaggacacagtgttcctcccctctggaggatgcagcaacaaggttccatgttagaagcagagaaaagcctcgccagacaccaatcttgctggtgccttaaccgtggatttcccagcctccaggaatgtgagaaatatatttctattgtttacaaattaccccaaacaaaataagaaaaataaaacaacaacaaaacataagtaagtaaataaataaatagcctggtctgtggtatttttgttatagcagcacaaggggaccaagacatataccaaatgaatgagatatatactgattagtatcttacactgtgaaagtgagttctaattgtcaaaattcatttgataaaatatttttctgattctgatttttttttttttagagacaagtttttctgtttcccagactggagtgcagtagcacaatcatagcctagtcactcactgcagcctcaaactcctgtccctcccaccaaaaaaagaattgaaagttattaggaacacctgtggcagaaagtacattattgaaaagaatcttttctagtaaactgtagggacacagtgggcatgaggggataggaaatgtggaacatatgaatacctccagttgagccctggtctgtaattatggaggtatgtattaatagggatgaaaaaggcagggaaggaatgtgtaaggtaggtttgccttggtttttcctgacactagataaatatgaaagtaagaggaatgagagaatgaatgaaatggtaattgagaaaggaaaaccatcagtagaaatgaaaatactcagttttggctgggcgcggtggctcacacctgtaatcccagcactttgggaggccgaggtgaacggatcacctgaggtcaggagttagagaccagcctggctaacaaggtgaaaccccatctctattgaaaataaaaaattagctgggtgtggtggcacacgcctgcagtcccagctactcaggaggctgaggcaggagaatcgcttgaacccaggagcggaggttgcagtgaaccgagattgcgccactgcactccagcctgggcgacagagtgagactccatctcaggaaaaaaaaaaaaaaaaaaaaatagaaaatactcagttttatgacaggagtagttgaggagacgtgtttttcttacagatctaaacctttaataaacatacaaaccttacatgagtttttattaatctgagtatgcatgaaagatgttacttaatgttcaaacctaaaatgcccgaagtagctggctgtggtggtgcttgcctgtagtgccagctacttgggaggctttagctgtagtgcatcatgattatgcctgtgaatagccactgcactccatcctaggcaatatagtgagaccctgtctctaaaaattaaaaaaaggaaaatgctcaaagtaattggccataaattttagtgctgattattcagtgccaataatttacaactgaattatttctataaataaaaatttatttcttctacaaatgggtgtatgttagctttgaaagtgaaaaaaatatttagtgtcaagtgagactgcatgtgttaggttaaaagctagacatttaattgttttgctttaaaatgaattgtaaactgctctgacacttttgtagttaattttttttttctttgagatgaagtttcactgtcgctcaggctggagtgcagtggcatgatctcagctcactgcaacctctgcctcccgggttcaagctattcttatgcctcagtctcctgagtagctgagattacaggcatgtgccaccatgcctggctaatttttgtatttttaatacagacggggtttcaccatgttgaccaggctggtctttaactcctgacctcaagtgatccacccacctcagcctcccaaagtgctgggattacaggtgtgagctaccgtgcccggtcttttaattaattctttataaagctattgccatatttttttctacagctttcaacattatgttttgtatatttaggtctttaattgacctgaatattctgtctgggattttgtttagtatttatggattaatttggaaaaaagagatctttaccaacaaattttcttatccttacaaatatttctttctgtattttaggtattcttctattatcttttaataacatgtaaaatttaaatacatttaatatgggttacaaaatggttaggctgatttttttaaaaaacgtatacatcttatggtagtgatcatttgctaaatctgttagattcaaaaattctaaaagtaaatgctttttagaaaaaaattcagaccatgtagaagtcaataaagtacaaatgaaatctggggtcagtatctttgcagcagtgtgtgctgtccactagaatgtttcatgattatggaaatgttgtgtatctgtgctatccaacatggtaaccactagtcacatttggctttgatcatttgaagtgtggctagtgcaactgatgaatttcaacattttatttcatgttaattaaattttaatagatataattagcatatatgatattaaccagtacagcttaggtttattgtaaaattttacatttctttttatatgtttatattttttaaaggtatcttcaaaaaaagttgtatctattgtgtatatgatatatttttctacaacatattctagattattggtggtgtttggaaatgcttcttaagtttgaatattttctcttatttgactaccttgtgacctacattaacagatagtctttggttattctgcttctctccttcaaaattctaaattcttagaatttgaaataaactgctatttgaatctttatgtcatttcacatattgagtgattggtcctgagttgctctggggcttcctcaaaaaacaacctaaattatggatactaaatgaacacagactactttccttcattttgcccaaatagatgctgttctttgggttctttgatgttcaaacttaactttgaatattgaaggaaatggtacttctaaggataagtaaacatagattcttttttaacagttcatttcacagctcaacacacactttttggagcatatgttttatggttactcttttgccaaatactgggaatacaatattaaataactgttttgcctttaagcagcttgtaatctaattgaggagacagatgtggaaagaaatcacttacttcttcacagtggcattatagaatagaggttaagagtgtgctctggagctgtgtgaccttggttatctatggaagctcagtttccttgtgagtaaaataaggttattagggttcttgtgaggattgaatgagattatttgaatgtttggcatatgttagctaatattactggctactgagcttgaaatctctcgtgcctctattattggcaatggagagcacttgagagatttaagcaggcagatgacatggttggattcatattttaggattatgtgaattgctttgtctgtagtggatcaatagatttgaggaggctatagtgataaacctgttgcgagatgatgacttgatcactttagttatgatagaatggttgggaagagagtgcagtaatacttttcgtgttatcaaggtaagacttgattgatttaatgaagagggtaaaaggagttagagataacatttgaatttttggttttggtgactgatggtggtatttacaaatgagttagggagtataggaggaggatatggaagaggggcttgaaagattgaattgagttttgttcaagcttgagatgactatgatatccaggcaggcatattcaggagacagttggatttatgtttttggtgggtagaagagtcatggctggactccttttgtttctggagacagggtcttgctgtgttgcccagtctggagtgcagtgagtggtgctgtcatgcctccctgtagcctcccaggcttaagcgattctcttacctcagcctcccgagtagctgggactacaggcatgtgccctaccatgcccagctaattaaaaaaaaatttgttttttagagatgggtctcactatgttgcccaggctggtcttggaatcctctgacctcattctctcaaagtgctgggattacacatgtgagctacagtgccttgcctggactctttaattgtatttaattttacatagtttgacgcaatattattcaataaatggtagctattactagcactatttttattattatgtggctggtatttaaagcaaccagtagatgaaactttctaaaaaaaaagaaagagtaaaaagtaaaaggagtgggctggaagctagaacatttaatagatggatagataaagaatgagtatagaatgagattaagaaaaagcagaactaagacaagctctgatgaagtatgatgagtttatataagaatagtcaataatacctgatgcaacagagatatctagtaaagtaatgcctaaaagggtcccctgtatttgaatgggatgtcagtggcgccctctgccaggcaaatcacagtgcaaatatggagacagaagccagaaataaaatgtattagcaaataaatgggaggttgatataacatgggccggttttgctgatgtgacccaagagctaagcagtgatatcaatatcttccaattccaaattttaaaatgtcctttaataaaatatgtggctagtcattttgaacaattatcagtaaaatttttaaaataaaaagcataagaaaaattaagaatacaaagagtatagttctattttaggtatttaggtttaaatctagtttaattctttcagctttctctaattgagttttaatcctcgtttactttgctaatgagatttaaaaatattattttcataaaccttgtaactttttgcttttttattctaaccctgtgatttactcttaatctatttctttataagcttcttaaatttcagtccagctttagtctcaaacattgttgtagtgattaatggttttgcccccccattttcttcctttgtaatatattttaatcaacttttttttaaattggaagagccaattaaatatgttgtttaaaatcttgccatatccacactgtctacctgattggttttgccaattctgtaaaactttacttgatactgttgggattctttggactatgtggcaatatttgtagatttatagaaattttactgatttaattcttggaaggcaattttagttccaagtatttatagaatattttattgtcatctgctatgtaccaagtcttaacttgacattaactgtgcaacattaggcatggcacctctcttatgactgtcctatttcagaacttcacagtctgttcctgcgcctttcaaggcactaagctctgtgctatgctgatcttcagaggaggagcacatttgaataaaaagtgtttgtttcagtctcattaaaaggctcttataaaagttatgaacatttaaaagtgccctttcctccctttttgagctaattgaattcttcattttataggggtagaagattccaggaagagggggcagggatgagtatttatcataattgttaaataatgcgctggacactttttgtgtaatgttatttgatctggatagcaaccctgtgacataggcaggtttatcctcattagagaaattaagtggcttgcccagttcagaaaacaagttaatgtcagaatcaggatgatattgcaggttttttgatttgtatctagtgatttttttcactcagttgttctctttgtaggggctagaggcagaataaagaggccccttccctgtgctccctcttgcttccccgtcttctattctttggagtgtatgtcatttttctccagtaatttagggcagaaaaaaatgttgaggactaccactgtaccattttgttgtctctgatttttaggaactatgttcatggtaagaattgattataaaagaatacctatctatgccattagaaaacaaaacatccaaaatataggctgtgctttgcatcattctatgaaagccatggtgggaagttgggttatagctttctactaagttgaaagtaggctctgtcgcctaggttggagtgcagtggcacaatcttggctcacttacaacctccatctcccaggttcaagtgattctcctgcctcagcctccccagtagctgggaccacaggcgcctgccaccacgcctggctaatttttgtatttttagtagagatggggttttgctgatggggtttcgctgtgttggccaggctggtctcaaactcctgacctcaagtgatctgcctgccttggcctcccaaagtgctgggattataagcatgagccactgcgcccagctaatgatttttaataactttatataatactgataaatcactcttttttttttttttttttaagacagagtcttgctctgtcacccaggctagagtgcagtggctcgatctcggctcactgcaagctctgcctcctgggttcaccccattctcctgcctcagcctcccaagcagctgggactacaatgcctggctaatttttttgtattttttttagtagagacggggtttcaccatgttaaccaggatggtctcgatctcctgaccttgtgatccgcccgtctcggcctcccaaagtgctgggattacaggcgtgagccaccgcgcctggcctaaatcactctttttagtggactctaaataccactgtgatttgataccccttttattcatttataaaaatacataaacagcttccttttttgatgtttaaaaattttatagtcctttctgtcttgaatttgcatttctgttatacttttcacaccagattctattcttatatgatgtattttatgcataagttatattttgcctgtaacatgcatacattatgaaggtagtatatttttatgcattacagtctttcatgcatattgattaccctattatatgtctttgcagccagccaaaatgtgtaaattttaaaatatctcttagtcattaaattgtaattagcacacggtaaaataacaaatgtattaaaatgttgctaaattattttttatttattaaaaaaattttttttctccttctctgccttcaaaatgttgcttctctgccttcaaaatgttggtacattattaaacagaagaaaataggccaggtgcagtggctcgcacctgtaatcctagtactttgggaggacaaggtgggcggatcacttgaggtgaggagttggtgaccagcctggccaacgtggtgaaacttcgtttctacttaaaatacgaaaattagccgggcgtgggggtgcatgcctgtagtcccagctattttggggactgaggcacgagaattgcttgaacccagcaggcagaggttgcggtgagccacaatcatgccactgtacttcagcctgggtgacagagtgaaactctgtctcaaaaaaaaaaataaaaaaaaaaaagtttcacagacaaaatatgaatcattccttgtttaacacttaaaaggtttttatactcaggcaatagaatagtgtatagtttcattcacaataggtgaggagtatgtcatcctttttatattaataaaaagtgagaggagcccagatggccgaataggaacagctccggtctacagctcccagcgtgagcgatgcagaagacgggtgatttctgcatttccatctgaggtactgggttcatctcactagagagtgccagacagtgggcgcaggtcagtgcgtgcagcgcaccgtgcatgagccgaagcagggcgaggcattgcctcactcgggaagcacaaggggtcagggagttccctttcctagtcaaagaaaggggtgacagatggcacctggaaaatcgggtcattcccacccgaatactgcacttttccgacgggcttaaaaaacggcacaccaggagattatatcctgcacctggctcggagggtcctacgcccacggagtcttgctgattgctagcacagcagtctcagatcaaactgcaaggcggcagcgaggctgggagaggggcgcccgccattgcccaggcttgcttagctaaacaaagcagccgggaagctccaactgggtggagcccaccacagctcaaggaggccttcctgcctctgtaggttgcacctctgggggcagggcacagacaaacaaaaagacagcagtaacctctgcagacttatatgtccctgtctgacagctttgaagagagcagtggttctcccagcacgcagctggagatctgagaacgggcagactgcctcctcaagtgggtccctgacccctgacccctgagcagcctaactgggaggcaccccccagtaggagcagactgacaactcacatggccgggtactcctctgagacaaaacttccagaggaacgatcagacagcagcattcgcggttcacgaaaaaccactgttctgcagccaccgctgctgatacccaggcaaacagggtctggagtggacctctagcaaactccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagagcagaaaaactggaaactctaaaaagcagagcacctctcctcctccaaaggatcgcagttcctcaccagcaatggaacaaagctggacggagaatgactttgacgagttgaaagaagaaggcttcagacgatcaaactacgagctacgggaggaaattcaaaccaaaggcaaagaagttaaaaactttgaaaaaaatttaaacgaatgtataactagaataaccaatacagagaagtgcttaaaggagctgatggagctgaaagccaaggcccgagaactacgtgaagaatgcagaagcctcaggagccgatgtgatcaactggaagaaagggtatcagcaatggaagatgaaatgagtgaaatgaagcgagaagggaagtttagagaaaaaagaataaaaagaaacaatcaaagcttccaagaaatatgggactatgtgaaaagaccaaatctacgtctgattggtgtacctgaaagtgacggggagaatggaaccaagttggaaaacactctgcaggatattatccaggagaacttctgcaatctagcaaggcagccaacattcagattcaggaaatacagagaacgccacaaagatactccttgagaagaccaacaccaagacacataattgtcagattcaccaaagttgaaatgaaggaaaaaatgttaagggcagccagagagaaaggtcgggttacccacaaagggaagcccatcagactaacagcggatctctcggcaaaaactctacaagccagaagagagtgggggccaatattcaacattcttaaagaaaagaattttcaacacagaatttcatatccagccgaactaagcttcataagtgaaggagaaataaaatactttacagacaagcaaatgctaagagattttgtcaccaccaggcctgccctaaaagagctcctgaaggaagcactaaacaaggaaaggaacaaccggtaccagctgctgcaaaatcatgccaaaatgtaaagaccatcaagactaggaagaaactgcatcaactaacgagcaaaataaccagctaacatcataatgacaggttcaaattcacacataacaatattaactttaaatgtaaatggactaaatgctccaattaaaagacacagactggcaaattggataaagagtcaagacccatcagtgtgttgtattcaggaaactcatctcacatgcagagacacacataggctcaaaataaaaggatggaggaagatctaccaagcgaatggaaaacaaaaaaaggcagggcttgcaatcctagtctctgataaaacagactttaaaccaacaaagatcaaaagagacaaagaaggccattacataatggtaaagggatcaattcaacaagaagagctaactatcctaaatatatatgcacccaatacagaagcacccagattcataaagcaagtcctgagtgacctacaaagagacttagactcccacacattaataatgggagactttaacaccccactatcaacattagacagatcaatgagacagaaagtcaacaaggatacccaggaattgaactcagctctgcaccaagcagacctaatagacatctacagaactctccaccgcaaatcaatagaatatacatttttttcagcaccacaccacacctattccaaaattgaacacatagttggaagtaaagctctcctcagcaaatgtaaaagaacagaaattataacaaactgtctctcagaccacagtgcaatcaaactagaactcaggattaagaaactcactcaaaaccgctcaactacatggaaactgaacaacctgctcctgaatgactactgggtacataacgaaatgaaggcagaaataaagatgttctttgaaaccaacgagaacaaagacacaacataccagaatctctgggacacattcaaaatagtgtgtagagggaaatttatagcactaaatgcccacaagagaaagcaggaaagatccaaaatttacaccctaacatcacaattaaaagaactagaaaagcaagagcaaacacattcaaaagctagcagaaggcaagaaataactaaaatcagagcagaactgaaggaaatagagacacaaaaaaccgttcaaaaaattaatgaatccaggagctggttttttgaaaggatcaacaaaattgatagaccactagcaagactaataaagaaaaaaagaaagaagaatcaaatagacgcaataaaaaatgataaaggggatatcaccactgatcccacagaaatacaaactaccatcagagaatactacaaatacctctacgcaaataaagtagaaaatctagaagaaatggataaattccttgatacatacaccctcccaagactaaaccaggaagaagttgaatctctgaacagaccaataacaggctctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcatcctgataccaaagcctggcagagacacaaccaaaaaagagaattttagaccaatacccttgatgaacattaatgcaaaaatcctcaataaaatactggcaaaccgaatccagcagcacatcaaaaagcttatccaccatgatcaagtgggcttcatccctggatgcaaggctggttcaacatacgcaaatcaataaatgtaatccagcatataaacagaaccaaaaacaaaaaccacatgattatctcagtagatgcagaaaaggcctttaacaaaatttaacaacccttcatgctaaaaattctcaataaattaggtattgatgggacatatctcaaaataataagagctatctatgacaaacccatagccagtatcatactgaatgggcaaaaactggaagcattccctttgaaaactggcacaagacagggatgccctctctcaccactcctattcaacatagtgttggaagttctggccagggcaatcaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcatttttatacaccaataacagacaaacagagagccaaatcatgagtgaactcccattcacaattgcttcaaagagaataaaatacctaggaatccaccttacaagggatgtgaaggacctcttcaaggagaactacaaaccactgctcaatgaaataaaagaggatacaaacaaatggaagaacattccatgctcatgggtaggaagaatcaatatcgtgaaaatggccatactgcccaaggtaatttagagatttaatgccatccccatcaagctaccaatgagtttcttcacagaattggaaaaaactactttaaagttcatatggaaccaaaaaagagctcacatcgccaagtcaatcttaagccaaaagaacaaagctggaggcatcacgctacctgacttcaaactatactacaaggctacagtaaccaaaacagcatggtactggtaccaaaacagagatatagatcaatggaacagaacagagccctcagaaataacgccgcatatctacaactatctgatctttgacaaacctgagaaaaacaagcaatggggaaaggattccctgtttaataaatggtgctgggaaaactggctagccatatggagaaagctgaaactggatcccttccttacaccttatacaaaaatcaattcaagatggattaaagacttaaacgttagacctaaaaccataaaaaccctagaggaaaacctaggcattactattcaggacataggcatgggcaaggacttcatgactaaaacaccaaaagcaatggcaacaaaagccaaaattgacgaattaaactaaagagcttctgcacagcaaaagaaactaccatcagagtgaacaggcaacccacaaaatgggagaaaatttttgcaacctactcatctgacaaagggctaatatccagaatctacaatgaactcaaacaaatttacaagaaaaaacaaacaaccccatcaaaaagtgggtgaaggacatgaacagacacttctcaaaagaagacatttatgcagccaagaaacacatgaaaaaatgctcaccatcactggccatcagagaaatgcaaatcaaaaccacagtgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtgtatacccaaaggactataaatcatgctgctataaagacacatgcacacgtttgtttattgcggcgctattaacaatagcaaagacttggaaccaacccaaatgtccaacaatgatagactggattaagaaaatgtggcacatatacactatggaatactatgcagccataaaaaatgatgagtttatgtcctttttagggacatggatgaaattggaaatcatcattctcagtaaactatcacaagaacaaaaaaccaaacaccgcatattctcactcataggtgggaattgaacaatgagaacacatggacacaggaaggggaacatcacactctggggactgttgtggggtggggggaggggggagcgatagcattgggagatatacctaatgctagatgacgagttagtgggtgcagcacaccagcatgtcacatgcatacatatgcaactaacctgcacaatgtgcacatgtaccctaaaacttaaagtataataataaaaaaataaaaataaataaaaagtgaattttaggccattttctgttacttagaatacctgaaactgggtattttataagaaaaggaatttatttcttacagttatggaggttgagaagtccaaggtcaaagggctgcacttggtgagaaccttcttgctgatagtgactctacagattcctgaggtggtgcagggtatcacatggcaaggggcctgaacctgctaatggtagctcaggtctcttctcttcttttaaagccaccagctcccctcccatgataacccattaatccatgaatggattaatccatttatgaaggtggagctctcatgatccaattacttcttaaaggccccagctctcaatattgccccgttggggattaaatttcaacatgagatttgaggggggtcaaatattcaaaccatagcagtgggtttaaaggtacttgtgaaagaggagaccagagaggaaaatcaacatgacctttcaaatggacctatgatccattttcaggcagattaattttaaattttatgaaagggttgagtatgaatgagaattgaagacctgggaattgttgtccattgttgtttatctatttctgtgtacccttcagaaagtctgtttaccttcagcagtacaaatatatggtactgtgaaagatccctgatctagtatttatagcaacctgtattttatgaccagagaaactgagacttaaagatgtagagtacttgcctatggtcacttagctagtaaatggtcaatcaaaaactccaaaacttgaggccgggtacggtgactcatgccagtaatcccagcaatttgggaggctgaggtggttggatcacttgtggtcaggagttccagagcagcctggccaacatgttaaaaccccttctctactaaaaatacaaaaattagccaggcatggtggtgcgtgcctgtaatcccagcttctggggaggctgagacaggagaatcgcttgaacaggttgcactgagtcaagatcgtgccactgcactccagccttggtgacagagtgagactctatctcaacaaataaacaaacaaacaaaaaacacacaaaccctccaaagcttttctttccctcctgtgtcatgctacttagtacatagcctggttcacagtatatgattactatatatttaatgaatgatttacatattatttgtgaagtccaaaatacttaacgttgtagttgttccatcagttttgaactgctgaataagtgtgacattacagatgattcactacagaagaatattgaagatcttcaaagcattgttaaggtgatctcctttcagttcctggagtggtgttcctggaaatgactaatagaacagcaaaaaaccgtctacttgggcattcttggtgttttatcaattaagtcagagacctataacagtgttggagtgcttgttttgaagaggtcagctaacttacgttgacactgtgtgtgtatgaagagtgtaattttcgtttctgttatacaggtattctctgaaaccaaatgaccaaatcttggctgaagacaaacacaaggaactgtaagtgcattaaaccattggttgtaaatagtttactctgtctatgaacttgatatatgtatatgtaaattatctgattttcaaaattatataatgacaaagtataattaacactatgaccttaatcctaacaattatgataacctacactatataatttacactacataaagtttacacaggacataatttctcctgtattcacattaaaagatgtagtgttgtattccatcatctagactaaagtcttactgggaaatatgtcatgctattttctctttccagataaaatattaaattgttcctattttctttctgactgctctaccagaaaaaagtaaaaaataaaaataaattgtcactcttaatttttgggtcttactccggtggatcacccaccttcatggtaatgatagacaaatataattttgtttctgtcactggtttatgcaaaagtaaatgtcaattgtttggtacaaggtaaaacactttattttatttttatttttttgaaacagagtcttgttctgctgcccaggctggaggcgcaatctcggctcattgcaacctctcattcctgggttcaagcaattcccctgccttagcctcccaggtagctgggattacaggtgcccgccaccatgcctggctaaattttgtattttaagtagagatggggttttgccatgttggccaggctggtctcagactcctgacctcaggtgatctgcctgccttggcctcccaaagtgctgggattacaggtgtgagccactatgcctggctgaagacattttattttcacatctaactcaggtcgctcttggtttagtttaatgtaaccttcacttgtactcatttatagggacagtaattttttttcgtagaggacttcaagactattattttcttcttgagattaagtaataatttttttccaagtacttttaaactgctttttaaaaactgtcttgaaccttttgtaaattattttcttctctcctatttaaggtaacataaattgttaattataaaatggcaggaccaatgttcagggaaaggattttcttatgcgttcttaccgtttacacattccactattatgctaacctttcatcagtatttttatatttggcctatccttatttgagtataatctccatagtgggttctcaaatatatatattgtcaagaaatttttttgctctttctttatttcctagtatagtcagtgagggccggtgattgttactgtagcattggttggttattatttataggtctggtaacagagcttcttttgctttgggaattaagtagttggtgagccttaaaagttcctttagtccttagactatgaccaatattaaaaataccagaaatctgcttttaaagaatatgttatttaatatgtaacccattttaatgttttaattcatttgaaagtttttttaactgtccaagatataattcatctctatgggtataacttggcgaactgatacttttttcttacctttttttttgtttttttgagacagactcttgctccgtcacctaggctggagtgtggtggcatgatcttggctcactgcaacctctgcttcctgggttcaagcgattctcctgcctcagcgtcctgagtagcagggattacaggcacccgccaccatgcccagctaatttttatattttagtagagatggggtttcgccatgttggccaggctggtcttgaattcctgacctcaagcgatccacccacctcagcctcccaaagtgctgggattatcacaggcttgagccaccgtgcccagcccctacattttattacgaaaagttttaaacatatgttatgtgttcacccatatatttaccaccaaggttttatcattaacatattactgcacttgttttatctatttattcttctgttcgtgcattacttcatctgttttttggatgcatttcgaagtaaattgtagacatcaatatgcttctctctaaatatttcaacacatataccattaactagagttttatatttcaaagttttttttttttagtttcacctgttctaaaatttcttataaactgagtcatatatatgtcctattttgtataaggcttctgtcactccctgtgtttttgaaattcatcagtgttgttgcatatatcagttaattccttttcatttttgcagattaacattctgttgtttatttgttctattattgctaagtattgccacttgtttgatttgtcattattgatggtcttgatatttttggctgctggctctcttccttgtagtttttgacctacataccaaagaaaactttcagttgaatatggcaccataaaagcagagtattaattttaaaaaattaaaacagttattgaattaatgaatttcatgaattatgaaagctgtttataaataatctcatttgtgtctttgcaactcaaatagccaaaatcttggtagggtggtggtcatggaagtcagagtctgctaaggagtgtataacaactcacctgctgtattaaaaacaaaaaaatctttttgtgttcaagactaagctttaaacaatataagagatatggatataaaacaaaattttatctaatcagtaattccatgctttattctcataaaacattattacaacttcttaatttcagtctgttaaagcttgattaattataaaattgtaaaaatgtgttggcaccatcacattgacctgctctttgaaaattaaccctaattctataagagtaccaataagagagtacagtgatagctctaattatcttgatattaataaataaagagtggcctggcatggtggttcacatgtgtaatcccaacactttgagaggctgaggtggaaggattgcttgaggccagcagtacaagaccagcctgggaaacatagtgagaccccatctctacgaaaaacttaaaaaaggccgggcacggtggctcacgcctgtaatcccagcactttgggaggccgaggtgggtggatcacctgaggtcaggagttcaagaccagcctggccaagatggtgaaaccctgtctctactaaaaatacaaaaattagccaggcatggttgtgggtgcctgtaatcccagctactcaggaggctgaggcaggagaattgcttgaatctgggaggaaaagttgcagtgagccaagatcacgctactgcactccagcctgggtgacagggcgagactctgtctcaaaaaaaagaaaaaaaaattagcctgatgaggtggtgtgtgcctgcagtcccagctgctcaggaagctgaggcaggtagatctcttgggcctaggagatcaaggctgcagtgaaccatgatcattccactgagctctggactggacagcagagtgagaccttgcctttaaaaaaataaaaaaagaataccaataagagagtacaatgatagttctaattatcttgatattaatgaatattaagtatgttttcattaaaacatttttagttcctgaaattttgtgattcagatttcatatacacttagtcactgatgcttcacgagtatacttgtttctctgtctgaggaagattggcatgggaaaacagggaaatattggtcagcagtgacacttgtttttctaagcaaagtggtttttctcaacttcctgtttttcattattctacatactgaagaccttgggggatgattttaagtagagaaagctgagcaattcaagttgtgatgtgatttatctaaaactataggatttatagtttgttctatacatgatccagtaatcaactggtttcattagctttctagtttttttcagttttagttttgtaaatggaataatttaaaataaattaggaaaacatcactattttactaagtattttttcacctactttccattgtgctaggcattaaagaaaagatagtgtgcagctttttatatgtcaattatacttcaataaagcggtttaagaaaaagtaaaagatactgattttatttataaatggaatcttactctccaatagtggcttttcaaaatctttggacacatctgcagttattgaaaatagaaccattttgtttccatgaatatctattttatgaatatataaattttgtattaccttggattatgagatctgatcatatagatttaggtaaggaaagttaaaagttgtctggagttaggggtgaattccaaatgcaaatataaataaattcagaagtatccatactacttaacacagagtaacctggtatctgaagattttttttttgtttgctataaggcaaggggaaaatctctttaaaagggattcacatttatttacttggctttttaagatagctaccaaggtaaacagtgaacttttgtaagcagtgtatactgttctaaatatgaagtgtattttcccttctgatagtgaatgaattccattatgattttttaatgtcaaaaattaaattattttgtcagaataaccccttaaatttttaaatgttgtcttataaaagttaattatattgtgatatttaaatgcttgccaatttacgattatgatgagatggaagaaaataaataaattatgcaataggcatgaaccttcaagggtattaggacgtgctcaggatatgatctttggtgcagtgtaaaaatgtaatttcttagtgaataggtcaatttccaaaccagcaggaaagttataagtatttaaatggaatgtgtagggatatgtcagggaagttagagacaataacatctggtatgctttttttttttttttttttttggtgagatggagtctcgctctgtcgcccaggctggagtgcagtggcgtgatctcggctcactgcaagctccgcctcctgggttcacgccattctcctgcctcagcctccagagtagctgggactacaggcgcccaccaccacgcccggctaattttttgtattcctagtagagaaagggttttgccgtgttagccaggatggtcttgatctcctgacctcgtgatctgcccgtcttggcctcccaaagtgctgggattacgggcgtgagccaccgcgcccggtctggtatgctcttaaattaattgttaatgctgtgacttagcagttctttgaaatcatcaagatcatagactgggcttgtgcctataatcccagcactttgggaggctgaggcaggaggattgcttgagtctacgagttggagaccagcctggacaatatagtgagactcttgtctctacaaaaagttaacaaaagtagccggatgtggtggtgcctgcctgtagtcccagctacttgggagactgaggtgggaggattgcttgagaccaggaggtccaggctgcagtgagctatgatccgtgccactgtgctccagcctgggtgacagaatgagaccctgttaaaagaatcttttttttttttttttttggtaagaatgagctaagaactggatatctgtaaagctaatagaaaaaaatcctgtgaagcaaaaagtcaaaattgaaataagctaggaccgacagcaaggttaaatgcttatttttttttagtgttcataaataaggtacagttttaaaaatatcataaacatttttatgatcctattctcagggcccggttttttttgtatctttaaaattatagtattttgattctagaaatgaacccttgaaccaatatccgtattttatcatgaataaggtgagagtaacattgataaaatgacttgctatagtttacattgctacttaaggacagtactagaccagaaaccaagtctcctgagtcccatttaagtgctgtttttgtcacaccaagcagttctctaagtatatagtcttttttttttttttgaaacagggtctcgctttgtcacccaggctagaaaacagttgcatgatcatggctcactacagtcttgtttttagagatgaggtctccttatgttgctcaggttggtctcaaactcctgacctcaagcagtcctcctgcctctgctcccaaagtgttatgattacaggcatgatctactgcacccagccagtaacttttttttttttttttgagacggagtctcactctgttgccaggctggagtacagtggcgcgatcttggctcactgcaatctccgcctcccaggttcaagtgattcccctgcctcagcctcctgagtagctgggactacaggtgcctgccaccacgtctggctaatttttatatttttagtagagacagggtttcaccatattggtcaggctggtctcaaactcctgacctcaggtgatccgcctgcctcagcctcccaaagtgctgggattataggcgtgagccaccgcgcctggccgccagtaatttttttttttaaagggattaatatccattgcaagacttggtaacggatcacagagaactcattagttaattaaatcagtttcacagtattgtgttttggttttggaaatcacttcagacctataaccaatattgagtgagttgaaaagaattaattacttccaaatacaaggcactttacattcttctaaggagaggatgcaacacaaagctatttggtcagcttgatacaaaagctcttaggtgtgctcatgaagtaagtcaaatgtatacattttacaaccacatattaaatagaattagttttttctttttccttcccatttctttgaacagtcttattcagaatcttcatcattagcaactttgtcatcattggagcccttttctctagaacacatcagcctctttctatgtatgatattttcgctggaaattttatcctgagctataaatgcctctcatgtaagaaaagttttttttttgttttttttttgagacaagatctaactctgttgcccaggttggagtgcagtggcgtgatcatgactcactgcagccttgaccttgtgggcttaagcaatcctcccatcagcctcctgagtatctgggactaccactgtgcaccaccacacctggctaatttttgtattttttgttgagatggggtcttgccatgttgtccaggctggtcttgagctcctgggctcaagtgatatgtctgccttggcctcccaaagggctgggattacaggtgtgagccaccatgcctggccaagaaaagttttttttaaagtttatttttgtatgtagtcataatacttgtaaggtaaccttttcactgtattgctttttaaactaaggtttaaatagttcattgtaataagagttaccgtttgtgcttataaggctgcatctccaggagtaagtactaaatctgtgttagatttctttgctgcttttttttgtttgtctttttttttttcttttactgatatggtcaggtggtcaggttacttccgtaaggatccaaaactagagttgattgagatcatttcaggcttatacataatctacaaatgattctcaaccaattgagatctgagttcacctcttttgctgaacttttaattgtgatcttactgtaaaattctaggatctcataacttctatgaaatttttatacctggattataaaacttcggaaagatttgcttaaatattttgttgcttaaaagaaaataattggccgagtgtggtagctcacgcctgtagtcccagcattttgggaggctgaggcaggtagatcagttgagctcaggagtttgaaaccagccttggcaacgtggcgaaaccctgtctctactaaaagtataaaaaaaattagctgggcatggtggcactcacctgcagtcccagctactcaggaggctgaggtgagaggattgcttgagcccaggaagttgaggctgcagtgagcaaagattgcacaactgcactccagcctgggcaatagagtgagaacccgtctcaaaaaacaaacaaacaacccccccgcaccccccccccccaaaaaaaaacaaacagaaaataattaacactgtcatcaaggaaggtaactcattataaggatttaaaaaaaaaatttttttttgagacggagtcttgctctgtcacccaggctgaagtgcagtggcacaatcttagctcactgcaagctccacctcccgggttcacgccattctcctgcctcagcttcccaagtagctgggactataggcgcacgccgccacacccggctgatttttctatttttagtagaggcagggtttcactgtgttggtgaggctagtctcgaactcctgacctcgtgatccacccgccttgccctcccaaagtgctgagattacaggcgtaagccaccgcgtctggcctataaggaataattttgtgattaaacatggtcttatattcatgaacgataggtgaatgaaaaatgtgtgttattggtggtaaaatcttaaaatccttaaagaattaatttaaattgctaccttctacttatgaagcactatatggtgccctggacttagcattagaagaaacttagtttatgtatgagttttgccataggctgtagtcttggggtattagttagaattcaatgccactatgatattaagaaatttattacaggaattaaatcttattcaatcatgagaaaaactggggatattaaggtccctaaaatgtgagagaaaaatcgctaaactgccttttgatgtaggttaatgaattgcgtgttctgttaatagggaaactgtgaaggaggttcgtgtgttgtgggctctttgcaactaccacctttatgggcctttagtgaaaaatctggtgataggcttggtcctggtagttgtggacgtaaggtagagtggggatgagtaaggacagattacagttctgcccatacctttgtgtctgtccttcctgcctctaaccaatgactgcctttggaatgtaatggctactgcttcaattgcatcccctaaattttttgcaaatttctcttgtgacatatcttaagctgaaaccatataggagaggaaattaggggaagtgtactccttcttgacatagtttaataccttaactttgtttaatcacttagtcttccaaacttaagttcctccgatatcattttgggtttagattagtgcttttctgtcattgtccattaaacaaatgatttctttcattacctacttctcttttagtctgttcagtgatccctctgggtatagcttctgaatttctagcataaaactcttcaacaataacaaaaaaggataatgatctttcctgtcaatttttagggggaaggataaggtgtttcctagaaactttattcagagcactttagtcaaagtgtagttcattgatccttaactgcaatttacttgacaagatatatttatgggatgaaatttattgagggtaacagaatggagagagaaactgctggtgtgatgaattctctttcttcttggtctacaacaaacagaaatattttgagaatgtagctatggcagattttaatgtaagagttatgccaacactatttccccttaagggttgagtcagaccttttgggaatgatatagacttgggggtcttgagtgaacttttagtatttattagcagccaatctaaccttgaaaactctatgttgatttctttttggaaagtgttgaacaattaaataatacatgttaaagaacaaggaagaagggcattgttttaattattttgtgatctaatttaatccccacagcaactctgtgaagcagatattgtaatcattcccattttacagatgaggaagagacttcgtaacttggtttatataagaaaaggatagaactgtttagatctttttgattgctttccattttgtataagttcagtgacttaggaaccttttttaaaaaacttctttggaggagtgatattgttcattatgaacatacctacttgaaaagtatttaaaggtatttttcatggaaattatattttataagttttagtatggttcactagaaatacgtcacaatttgtaggtaatactgtgttttattttgagttggctaattgttaaggtaaaactttagaggataaagtgagctcatattgatgaatggtaatctgatatttccaacagactaggtctttttttgaagttcatgtattataactttattctttgtgatactagctccctctgtagaacttcaataagattgcaactggactttttcaataatttagaaaagtgatctaaacattatctataacatttccctgtaaaattttactttgtattctaatcagttgcaagtgggtttttaaaagtataaatgtaacatttataaaaatgtttcactttgtacacacaaagttttaataacatatacaaaataaaactttcttcaaacattcctataactttaatgcttttttatttaggaaggctagagagaggtgtgatttctaggtctgtaggtctgtgttgagtaaagcctgatggaagccctaggggaaaaataaattttgacgtttagctggatacttgaaattatcccttttttttttttttttctgaaactttccggtttgacttgggtgggaaaatgttcataagggattttttttttttatcttgtagagaaggggaaagcaaacttctacaacaggtagaaagagcaaagagaaaatcttagcaagatccagaaatttagtggagaattgcaggaaaacattcttgacatttacggtttaaaaaaattttcctttttctttttttcttaagaggtggtctcactctgtcgcctagactggagttgagtggcatgatcatagtgatcgttccacctcagcctcctaagtagctgggactacaggtatgtgccaccacgcctggctcctttttgtatttttagtagagatggggttttgccatgttgcccaggctggtcttgagctcctggactcaagtggtctgcctacctcagcctcccaaagtgttaggattacgggcgtgagccactgcaccctgctcacatatatgagttctatgagtttatgctgttgttggaaaatcctttgttatcaaagtctaccaattttcctgtgtgggagtgagcttacttattttaccaccactttttctcctttctttctgctatggtttgaatgtttgtcccctccaaaactaatgttgaaatttaattgccattgtaacagtaataagaggtggaggcctttaagaggtgattagatcatggggctctaccttcatgagtgcattaatgcaggagtgggttagttatctcttagagggttgttataaagtgagtctggcccctcaagcacttgcttgctgtttgccttctgccatgggataatgcagcaagaagttgctgagcagaagctggcaccatactctaggacttcccagccttcagaactgagaaacatattaatgtttctttcctttataaattacccaatctcaggtttctgttaaaagccgtagcaatcaaactaagacactcccctaaaccattttatattaaattgtaagttgtataattagctcttcaaagatgttttctcagacataatgtaagctcaatgaaggcagaggaaatatgattgacttgcaacatggaatttagaaaaatgagcgaactgatttcaaccataaagctagggactaaaacatacaaatgaggataagaaagaactgaagtacatatgctctttcagtttctaaaaatttaactgtattttcttctaagtagattgaaggatgttcttaggattatgcttgagtaggcttttaaacaattttgtgtggataattatctttgaagcctttgttagtactaaacatctttattctgttataatacagtttattcaaacagacgtacagtgtgtattgtggcacaaagaaattcaagaatgattcttattctttttgtttgttggccttgactaaatttgataccagataattgctttaaaggataggccaattttattggtataacaaatctacccttcattatccataaaccacttatatagtaatctggttttcctatacaggcacaccttggagatattgggggtttggttctagactatcacaataaagtgaatatcacaataaagagaaatacatgaagattatattccccagtgcatataaaagttgtggtgatatcacactgtaatctattgtatacaataacattgtgtataaaaaatgtatatgccttaatttaatgtaatctattgtatacaataacattgtatataaaaatgtatattccttaatccataaaaatactttatggatgaaaatgctaacaatcatctgagcctttagcaagttacaatcattttgctggtggagggtcttgcctcagtgttgatggctactgactgatcaggatgttggttgctgaaggttggagtgtctgtggcaatttcttaaaataagacaataatgaagtttgctgtgtcagagccttcctttcatgaaaaatttctctgtaatatgcaatgctgtctgatagcatgttacccacagtagaatttggaaaattggagtcagtcctctcaaaccatgctgttactttatcaacttaagtttatggaatattcaaaattctttgttgtcatttcagcagtgttcacagcatcttcaccaggagtacattccatcttaggaaaccactttttttgctcatctataagaagcaactccctgtccattcaagttttatcatgagattgcaacatttcagtatccatcttcaggctccacttccaattctagttctcttgctatttctaccacatctgcagtgacttcttccctgaagtcttgaagcgctcaaagtcatccacaagggctggaattcacttcttccaaactcctgttaatgttgatgttttgacctcctcccatgaatcacgaatgttcttaatggcatctagaatgatgaatacgttgcaggaggttttcattttagtttgtctgatccatcagaggaatcacggtctatggcagctatagtcttgcaaaatatatttcttaaataataagacttgaaagtcaaaattacttcttgatttgggggttgcagaatgaatgttgtattagcagccatgaaaacagcattcatctccttatacatctccatcagagcacttgggtgactgggtgcatcatcaatgagcagaaatattttaaaaggggccaggcatggtggctcatgtctgtaattccaggactttgggagactgaggcaggcagatcacctgaggtcgggagttcgagaccagcctgaccaacagggagaaaccccgtctctactaagaatagaaaattaggtgtggcagtgcatgcctgtaatcccagctactcgggaggctgaggtaggagaatcgcttgaacccaggaggcggaggtcatggtgagccaagattgcaccattgcactccagcctgggcaacaagagtgaaactccatctcaaaaaaataaaagcctagcctcccaaagtgccaggattacaggcatgagccaccgcgcctgtctgtccgcccgtcttcttttttaagagcaagaaaaggtttcccagaagtactctggtagattcttatcacacacacattcctaaaccagttactggcaaagaaaatagaattatcatgattaattagcatattctgaagtacatgcttccttataactgaacaaaaattagagctccactggcaacgcggaaatggctgttgacttggcaactaatagtgaattgctcacaatgtttaagtgaaatggcctgtcagatttcctgggaacacaggaaccagggccagacttagaaacggcctcagtaagaggttttctaaaactattttctggtatcgtaattattcctaattaccttgtgcactaaaaaaatttaaaaattttaaatttagaattttaaacacatttcctgacagtaaccaagatataaaaatgtgtaaaattgagtgaatatattttaaagcatggaagatttgtgttaccctcagacttgaaagggaacctgcaaagttatggtctcatgggaaatattgtttctttttgccttgacataattttcaggctctttggttttattctaagcaacccagcagggcacctttaaaaagaaacaaacaaaattactgtctctaaaccaaagaagatagaaaaatacattcaggagaatagtatacattgaaaactgccactttagctagtgcttttttttttttttttttttttttaagacggagtctcgctctgttccaggctggagtgtagtggtgcgatctcagctcactgcaacctccaccttccagtttcaaatgatacttatgcctcagcctcctgagtagctgggattacaggggccagccaccatgcccagctaattttttcatatttttagtagagagtactttttaactgagaagagatgctgtaaagttttaggaaatcacagtggggacagtagtcatacttctactttcttctgaatataatattgtttcttttttctcctgcagttacttattttttttttctttttgctttaaggcttggtagttctgagaattttagattcagttataatcgaatgtaactatcaacacatgttatggagtagtataaattgttacttgatgtttggagttgttttactcagtcactcagcaaaggtaagattagatctccgttagatgaaaagtattatctcttatgcaaagagacattggttagctctggatgaagacaatggctatggggtcagtcaaccttgtagaaagaataggctaggcacagtggctcatgcctgtaatcccaccactttggggtggtcgaagccagtggatcacttgagcccagcagttcgagaccaaactcggcaacatagtgagagccccctctctacaaaaaatttgaaaattagccagggcatggtggtgtgtacctctggtactagctatcaggaggctgaggtgggaggatctcttgacctggggaggttgagtctgcatgcagtgagccatgattgcgccactggactccagcctgggtgagaaagtgagaccttgtctcaaaaaaaaaaaaaaaaaaaaaaaaaagacacaataaaagtaaaattgtataatctctggaaaaaacaaaataggctgtcatgttctaatactcaatatgtaaggatgtttagtatattagtgggtataattattaataaaatattctatttagttatctttgaaccagtttgtaataaccaaaccacaaaaattcaatttgctttgtatgtaaaaatcttttaaaatagaaagtcctgccttaactttcataaatctgaatgtgagcatatatttatgcttttcatttctttgcacagctttttttttttttcctctaagacagagtctcactctgtcactcaggctggagtatagtggcacgatctgagctcactgcaacctctacctcccaggttcaagtgattcttgtccatcagcctcccaagtagctgggattacaggtgtgcaacaccatacctggttaatttttgtatttttagcagagacagggtttcgccatgttgtccaggctggtgcacagcattttgttgttgatgtgtgagacttgtaatataacagtaataatgctgtcatttcttaaagatgatatataatcctatcaaaatattcctgggaagtaggtatttgtcagcctgtcagtgttttccttttattttgtgtgtgtgtgtgtgtgtgtgtgtgtgtctgtgtgtgtgtgtgttttagtacattctcccagatgctgaaattttccctttaaactgttactatgatgtatgtcttatttctttctcttttttggtcctaattatgctctcaggagttaagacagtataaaattatgttttttaaaggaaacttcatcaaatacttggaaattagcaaatattttttagaggtagaaactgtcatttatattcctaagacttgtaggccattgtatttgttgactgactgatttgactgagaacctagtgtgtgataacgtgtcactgtttctgtcaacttatataattgagggtctttttaattgttcttaccttagaccactatatacttgtggtcttataaagtatatttgaaaattatatgcattttcatgttttgtctgggcctgggaaaaatatttattttaaaactgtaacatcttaacctttaaaacccattgtcagttatttggaaaaattagtattatatgatatgaagcacttctttttattgctgatttcaggtttcactatctgggaaactccggtgtggagacataggtctgttaactgtcttctttgttttatctggaatgttttattgatactataaaacaaaacttatcagtaagactgatttggaattcatattgtttgacagcattatcactgtcaataattatccattgtcagtatttgtaaagcagaataaaagaagccattatttaagtttaattcctgagatgattcagcatacggtgtaatatcaatctgtgggaattttattttaaactttttcttagtaaagtttactttttagagctgttttaggttcattcacagcaaaattgagcaaagatacagagatttcccataatcctcctgccctcacacatgaatagcctcccccattttcagcatcccccaccagagtggtacatttgatacaattgatgaaccaatattgacacatccaaataaaactattttttggggaggggagacggagtctctctctgttgcccaggctggagtgcagtggcgagatctcagctcactgcaacctctatctcccgggttcaagcaattctcttgtctcagcctcctgagtagctgggactacaggcacacgctaccatgaccggcaaatttttgtatttttagtagagacggggtttcaccatattggtcaggctggtttcaaactcctgacctcaagtgatccacccgcctcggcctcccaaagtgctgggattacaggcatgagacactgcgcccagccgataaaactcttagaacaagattaattgattgattgagacaaggccttgctctgtctcccaggctggagtgcagtgatgcaatcatagttcacagcagcctgcagctcctggcctcaagtgatcctcctgcctgagcctcttgagtagttgggactatagcttgtgctactgctcccagaagtctcttatttaatctgtctcttctaaagtatagatgtatagttcatacctttagaaatttctgagtttttatggtggttctgcaaataaacctgtttgcttcttatttctgccttcccttccttctgagcctttggtttttgattttctcttatatgctggttcagctatccttgtttctgttgctttaaagccttcaacatattatgaacattttccaccaaacatattgttcttatgagtacatcgtaattttagggcaagaagcagagatgaactttgctttaactcttttgtgttgaagtatgctaatggcaagcatgttttttaaatataaaagttgtacaagttgagatgtttaattcctttactttaagaaaaagcatcataattagaagggagaattgctgttatctggaaggtgttcagacagtttggggagaaaaaaacaaccaaaacagctgcagtgtaatttccataagggaatgggcttatatctttgtttatttgtgtttgttttccattgtacactcagtgcctagcacggggtaacacagtatgtgattaaccaacagttattggaaaaatatattttagtgtgttattttagataattaaaagtacatttaggaaatatgcaacctttttgtttggctttattaatcagctttaaaatgctgatgatagaagcaggaggcagagaaattataggcaaataggggtgggtccctggtgaaaccccacctccaaggtgaaaagcttgaaaccagcagcccaaagtgagaacttctattcctgtttgcctgcactgtcctgattggttctttctgaataatgtctttttaccaattgaatgttgccttttccaaagctacctatggcctgccccacccgcatcctgtgcctgtaaagccccggactcagtaggtagagaggagagattctgccagactttcgggaaaagagatggcttgacttcggggaagagactactgctgtacttcagggaagaccacctactcttcccgtcccctctccagctcccctctccactgagagccatttccaccgctcagtaaaattctccaccttcaccatccttcaagtgtctgcatcacttccttcttcttggatactggacaagaactcagaacccacggagtgcaggtacccaaaaaggctgtcatactggccctttgccctcgctggcggagggcagccaccccacgcaatgtggtaagggaccaactgagctgttaacatgcacacagacagacggcagagctaaaagaccactgtaacactttctctggggttttggggtcgtgggcaccctcacctgggtgctgctgtgggacctgcatggagctttctctcgctggctcctggagcagccggccaggtcctgcactctcttgctaacatgctccctcctgcagggggttgagcgctgtggcgtgagtaaactgtcgcccttgttgcaagtccaatgaagggaccaagaaaaatcctgcatcactgatatgaaatgtaccaaattaagtaacatcatcttatttcttctgattttgttttcagtttgtttatattcctttccataggtattatgtgtctgttttagttcataaaattgtggcctaatttatattttgaccattattcagcacactgttagtactcaggactaatttcagttgcttatttagacacatcgaaataaatcacattttaaggctgggcgcagtggctcctgcctgtaatcccagcactttgggaggttgaggccaggagttcgagaccagcctgggcaatatggtgaaatcccgtctctactaacaatacaaaagttagctgggcatggtggtgcacacttgtggtcccagctacttgggactctgaggcacggaaatcgcttgaacccaggagtcagaggttgcagtgagccatcacgccacactgcattccagcctgagtgagattacgtctcaaaaaaaattttttttaaacataaataaagaccacactatcttttttgaagattatgttcacatttcattctctccattgaactgtatagatgtattacctgtatataaagaatgtaaatttttttgtattaaaaatcgacaccttaaaaaaaaactaataccaccacaaggttaagctctgaggagatttcagctttacaataattacattgttacaataatgtttaacttctcaataattaaaaaccaaagcaatgttgcaaccttggttcaatattcaaatatatttttcttggtaaccaagctacttcactatttatagtactttataaatgatttagaattgttatgcagttttttcaaagaagtattcataaggtaaatttagaaaattattttaaaacgaaagtgatgcccaccagatggtgctatttcgcctgttttatctgcgacaataagtaggaaaaatgaatatagaacttcaaaaaagtgtatggaagatctagaatatttgggcattgtattttgggtgtagatgagctcagtggaaggaagcattcaaatattctaaacttgtgtttagtactgtatgtttatcttgataaaggtaaagatgaattcccagagttaatatgccagataaccttttatttagtctaaatgttaagtagattttttgaaaagttgacctatatgcaaattttattaacttcatagctgtatatgcatgaaaaatgaaattatttattagatatgtgttaccaaaatttgtttcaagatttctttatattgttaagtaaacaatattactatctcatttgagttacattgtgatttacaaattaagggaaacattttgatttttttatgtgtttgtaattattacccagaaacttaggcttgaattcactatttttacaaaggaaagagatgactcttctaaattaatttttgtattaggaagagggcaaactatgtggtacagtgttcacttagatgcagccattgaatgacgatccattagagtcaaaatggttagttagctaatgaaatacacttttcagtaaagctggaaagatttagccagctcttaaaagtgtttctaggattttaatgtagtctttttcccgctgattttattatcactctgtattcttctctggtcatgagattgaaccataaaagtcatgtagatgcttgttataagtatttgccaaagtcatcattgtcagtgattttattggcatgtgtgaaattagagattaaacttgcttttaaatcttgcatttgaatttttcttctggaagggtacatgtataactttcaatttaatgttcaattattggtaacagaatgaagcatctctctataggccagtaaatatatatagtagattttattgtattcctgtactgtttttgaatgaatattttactaattatattaacataatcctcatacatacccttaagattaggacctactataatgctttatttgaacttgtttcatagcatttgtcttttttaactttggattatagttttggaatataaatcagatccctcctacaaaaacataaagttcttcatgctttctctcattccacttatcacaatactttacatgtagtagatgaccctatatattttttatataaatgaatagttttgtcatgccaagtattgatattagtattagtgacaacaagtattcctcattccatagtttttgtttttgttttttttttttttgagacagagtcttactctgtcacccagggtggagtgcagtggcagaatttcagctcactgcaatgtctgcctcccaggttcaagcaattctcctgtgtcagccttcttagtagctgggattacaggcatgcaccatcacgcctggctaatttttgtaattttagtagagatggggtttcaccatattggtcaggctggtcttgaactcctgacctcaggtgatccactcacctcagcctcccaaagtgggattacaggcataagctactgcacctggtctctgttctacagttttttatcttatgcttttctgaaatgactttttatagttgggtttaaaaggatcatctcattggaatctcatatcacagttatgatgcattctgtcatgatgaggataagtgtatattcaggttaaaaaaaatcaaaatattattgtcagcctgcatcagtattagagattgtctggtccaggagttctcagattgtgattcaagggcctcttgtgggaggggggggtcaggggtccttaagaccttgacagaagttctgtgagggcagaactatattcaaagtaatactaagactgtgtttacccttttcattctcattctctcatgagcataggtggagttttctagaggttgcataccatgccatactgattgaatgtacaagttatatgaaactctagcagttctgtcaaaagacaaagttacaacaaatttagtttaaagatctcagtcagctttattgtgattctagaatcaggcaatacttcattccataaagtagagtgtgtgttctaatgagttgagcagatggttggttttatagacagaaagggctgaagaaagcagattggtcatttcaaagtgaattctcttgtaaggtctggatggggagacaggacaatagaaagactggttaatatcaggttacttcagattagggattaaaacagaggaaacttcattatcatgcccattgaatacttcattatcatgtgcattgaatattgaaaattgtcctgtttgggatattaggctgttatctgtctctcctgattttttagaaagtcaagataacaactcagtttgggtttggtgagcatgggtgactccattttgatttttagtctggtcttcttttggagcctagtgtaggagttttgttcaaaacagtggcctataattttggcttcataagccagacattaaagagatttgcaaagattataaaacagtgcttctcttgtcactaagatgttttttagtttggaaatagttattttcataaaatgttacattaacatttaatgaatttattcttaaaataataaatatttaaaaaagttatattttaacttctaatatgataactagggctagatattaaagctccttgaattactcgatactctttttaaagtgtaaagtggtcctgagatgaaagtgtctgagaacttatgatcctaattctttatcctcatttcatagatgagaatactatgagcccagagaggttagtttagttaagtacactcatccagtttttggcttagctgattcttggatcactgacatctggctttttttgatttttttttttttaagttttttttttttttttttttttttgagacagagtcttgctgtgtcagctaggctcgggggctggagtgcagtggtgcagtcatggctcactgcagccttcactgcctgggctcaagtgatcctcccacctcagcctcctgagtacctgggactacaggcacgtgccaccatgcctggctaatttttgtgttttttgtagagaagggtattttttgttgcccaggctggtctcaaactcttgggcttaagtgatcagctagccttgacctcccaaaatgttgggatgagccaccttgcctggcctgatatattttattagcagttttgctgtttagatattcttcaacctaataccaaccatcagctcctttaacagtttcttcatttgatattttaactaactttattaagtacatgagtaaattaggaatattgacctactttttcaacaacaataaaatggtgtttttttaaactcaaaaaatgtctagaaaaagggaattgatatatgaaacagtgtaaccttagcgtcagaaagaataatgttgagggcaaagaaataggttcttgtgttttagagactcttttactgtcttttttcctttttttccccccttcttcaacaacaaaacattggttacaagcttccctgggcatttatggcagcccacctacagaagaacaagtgttctgttttaaaattttaaaaattttatcaagaggataataattacacatatgctgcttttttgatggatatgtattatttctcaggttgagcctcatggtgggggtggtagattctaaccccctccttttaattgttgaatgaatttaaaactatgtcataaagaaactgcgtaattttaattcaaagaaagataattaggatatacataatatccctcttcctttgaggggcttccttcgtgtagaagacatggactgagtgatttttgctcaataaaggaaaactttctagtagtaaagaaatacaaaaatagaatcagcttgtttggaagtagtgagttccctttcttatgaggcattaaagcatagaccagattattgactgttagtaggagtactagcaaatgaatcagtagatggagggttaattgggttacatgacctttcagattgcttttttttttgaggtggagtctcgcttgtcaccaggctagagtgcagtggtgcaatctcagctcactgccacctccgcctcctgggttcaagcgattctcatgcctttgcctcccgagtagctgggattacaggcacgtgccaccacacctaattttttgtatttttagtagagacggggtttcatcatgttggccagggtggtcttgatctactgacctcatgatttgcctgccttggcctcccaaagtgctgggactacaggcatgatccaccgtgcccagccttcaaattcttttattaagtgtttgagtatacttgttcaaaataactttttaaacaagtataaaaaggcagttggtttagcagatgtattctacttttatatcagctgctctgttaacctaaagattttatggatctgtggtctcaccatgatcactgacatcaattctccttgaaggaggatgagttttgtttgttcattttattgcaaaccatttgaagagatgatagattggtagcagaaatttggcagagaaaaggatgataaacattagaaaggaggataaagcccactggaagacataaatgaattgatgatattttggtgtatattttctcattgctttatgattataaatattttctgctgctttttgccactatctatttttcatgtcttccaataaagtattccatggccaaaatttgtgtgaaattctcttcggttgttgctggttttacaagttatagggttctttggaatataattactgaaatgatgactacactaaaacatatttcttcttaatttaacaaagtatttagtgggaggaaggctctagcttttcttattttctttaatgttttttaggcatgctagaggaaaatagtgttcttactattagttttgaacattttttatgactatagagttgaaagcccaaaacactagaagtaaatggatcattgcaaaatatttgttttgttttcatttgtgagtggggcattcgtgtgtcactgtgtctatgcttctatttttctctgtatatagtttatatccttaagactttcagaaagaaattgagatgttatgttgttttattgtatatgcatgtacatgcatacacacacacacacacacacacacacacacagttttatttgttcatcatatatttaaggcctgacataggtcttacaaagttcaattactatagggcttaagtaggaaatgaatggtaaaatgagccaatttgaagcaataaatactgattgatagattatcaccttcttccaaataagatatgtggcatcgtagaatcttgctcttagatacacagatatgtgtgatgtttaaatagttgagaaattcaaccagaaatgaatgaaagggttttcccgttatcctgtcatacgcaaattaccagatcattcagttcttcaatttatcaattcatgtatttattcatttaactaatatttgttagttttatactatgtgtaaagccctattttagacactgaatacagtgccagacagtaattttcctgcactcatagtttatactctaatagagaatgtagaattgagctttaaatttcctattcaataagtatttttagtaatatgtgaagtacaagagcttctgaagacttattgcgccactctctccctattcatccatttaccagttgttactgaatgcttactctatgtactagaaatgcagagatgagtaagatacaacctggccctgaaaaaaattcagtctatttggagttatagacaggcagtaactagctattatatagtgtgatgatggctatgatataattacaaataatattctgcaagaacagtaattttctctagctgtgaggtatgcaagaagctatcatagagaactaatatttgaggatgagtagaaatagtcgggtatagggagatcaaaggagaagttactcctattccccaaatagagggttcttcatgaacacacagaagtaggcaaggtctgtttggagaatggtgagatattgtgtagtttgggtaaaacactgggtatgtcatggagggagaggtaaaagaagaagctacaacgtaggttcaggccgaattgtgaaaagttttatatacaaggttaaagttggctttttattttacagttagttggggacctgtggaagatttttcagcaggcaaacatacttagtctgcagtttacaaagatagttgatagaatacaggatgaagtagtgagaagttgaggctatggaaaggcaggtataccagtttgaaaacttcataatagatatgaatgaaataatgagggtctcttatagggtagtagtagtagtgactttagaacacagggatggattaaaaatcaaattcagaggtatttttgttttgcttcatttttttgagacagggtcttgctctgtcacccatgctggagtgcagtgacatgatcacagctcactgcagctagggctacagatgtgtgccaccatggctggccaattttttatttttatttttatttttggtagagacaaggtctcattatgttgcccaggctggtcttaaaatcctgagctcaagcgattcttccatctcagtctcccaaattgctaggattacaagcatgagccaccatgcctggtccagagttagaactgacaggatttagtgagtgatccatatggagagagggcgttgaaaaagattttgaagttttgtgtttagtgtctgcataattaaatgctggtactattaacttcaaaaggaaaagcaatatggttgagggaagcaatgaatttggttttgtaatattgagggcaggagtaaacctaagggaatgttggaggcatttaaattctaagtggaggagatgcctattcaagagaaaggaggaggagtagggggaagagatagctgttcagtgtgtcattaaacctctcaaatcctcagtttgttatttatcatatattggaggtagaatcaataatttttctggttttgaaataacctgtgttttagttatcacaaattctaaattagtagtacaaaaattataataattatagtttatatgttatagactgatgataatatttattgattacttcctgtgaagtttaggtaaaatgctaagcattttgcattcatcatccatttaattctcctagcaatatgagttaaatattattactatctggattttcagaaaagggaagataacttgaccaagattgttacagcaaataagtggtggatgggtattcaaacccaggacaatctgacattaaaactcaagcttttaaccactatattatttgcctgtcttgtagaacataagagttgtaatgaatctaaaacatcatctagccctttcctgtaatcagatttatgtcatagctaaggtctgtaattaatgtcaaaattagctatccaatttacttaataagaagcttactccacagccattcattactgctgttttccttgtggcagatacttttttttttttttttttttttgtcgactcacctctttaccgtgtgatgtgagtaaattctgtatagtctaggccactcatgattatcccatttttcttgctagtcattaattaagacctgaacataggactgatatctgaccaataactcatttgtggccaatgagacatgaggggaggtttggtggaggggcttcttggaaaggtaacacctcctctcccctcatttttggatgtttctatctagatgggttcttggaattgtgagagctatcttggaattatttggggcctaggtcaggataaaaccaaaacactggatggcacagtgaaaagatggtgagaacttggatccttaatgatcttgttgaacttctaaattacccattcctaaagctattgtgcctcaggactaggtcttacatgaaattagagggaatttattaggctgtgtgaaacaaggactttttaaggctactaacagtttttttcttttaaacgatacttatcactgaaagaaacctaactgggatctgcagtgtttatctttgtctgaagtaaatagaaaggcactgtagggcttgcattactgttgagacacaattaaaacaggaatagaagacaatttttgtgtcactgcacctaatttaattggtgtagaagttggagatgatcatgctctagaaaacagatcttatatatgttaaaggtagcaaagtgtcattgaggaaatgagtctgattattctgacagtttctgtaggtaaaaggaatagaaagtaagtgttcagattaggttaggaaatagaaatggatttagtttgtagacagttaacctacgtttcagggtccttccaagactctggaagaatctcaagcaatgtgttaacataatattttgggtgaggcggggtaagatttgcaaaagttaggtatttaatccattaaaactgctattccttttcacttagactttccctgtatcataccctcatattgggtggcattagagtggcctgagctaagggaaaattgagtagaggatacatttagagatagtatatggttagcagttgtttatgtgtccagttattttgtaggcattacttccaggaatgttattactgtccactgtgtctacttccctggccttgtgatacatagatgtagttttgcagggcaggtgagccccaaagtggggctcagcccgtgagggttcttggctttgcccagaaaagaattcaagggcaagccagaggtagaagaaaatagatttattgaacaggcagtgttacagctctggtggtgttatagctcggtgactgctcctgcagagcagggctaccccgtaggcagagagtagcagttcagggcagttattaatacccttttttaataacatgcagattaaggagtggtttatgcagaaatttctagggaagggatagtaacttttgggtcattgggtcattgccatggaaagtggtggtaactcctgggtgttctcatagcagtgttgacatggcacactggtgggtgtgtctgatggaaagcttcttctgcctaatcatctttcagctagtcctcaatttaattgggtgtctgaacctgtctctagagtcaagtcctgcctcctaactcagtaggggcaagggtcttagagcattataaatatgttctttgtggtagaggtagaggaagagaaacatcgtttaagtgtttagagtgagaaactagtctggaaaatttttctaaatcttggaacttgattgtggttttcgtaaatttgataatattcctaagaatgtatatgacattatcagtaataagttataaagaagttataaagctgatataaactctctacactgcctttttttttttttttttttaagatggagtctcctctgtcacccaggctggagtgcaggggtgtgatctctgctcactgcaacctctgcctcccaggttcaggtgattcttttgcctcagcctcctgagcagctgagactacaggcacgcaccatcatgcctaacaaatttttgtatttttagtagagatggggtttcaccatgttggccgggctggtcacgaactgctgacctcaagtgatccgcccgcctcagcctcccaaagtgctgggattacaggtgtgagacaccgtgcctggcctacactgtcagtactaaaaattgatcaaacacagtagtaaaaagataaaattatctttctattctcttaatgttgcaaaattgttatatgaagaggaaatcaagaaatgcagccagaaatgtaagaaaataagagcattatagagatagattaggcaattaataaagatatgctcttctttttgaaattcatgtttttggcatttgttagccttttaaagttagtgtttagttgtaatttattttctcattccagatatttacttcacacctaattttgtattcctttccttaaatagagtcccacaaattgtaaaaaaggaattagctcaccaaaaacaccaaatgcagtatttttaatatttacctttcaggttcggttgctggatctagatatgcctcttttttttatttcctcattttttcttctaaaaagaaaattatgtattttaatgtcagattgcttttgattaaaatgtttcatattaaaattgtatacctgaaaaatattattcaataacacacttcaaaaagttgacagttaaaaaaaaaagaatagcccttgttacttttcttatctaatcacagagtttgtgtagtgaatgtaaaaagaaaaaaaaattgttacaagtttggagcaaagagctctgtgtttaaaaggaatctccttctttttttgtgtgtttttccttttgtaccaatggggaacctaaatctgttttagttgcacagacacaatggacaaatagtcattttgtatttgccaagtgtgataccttcctttgtttatttgctattaaactgttgagagttttatggctagtggataatcattgttcaaactttttaataactacagtgaattgtgttaatataaaattatgctgtacagtattttcttgttatgttgatggtcaaagtgaacatcagatattaaaaatttagatgagtaaaatattaaacagcctatttttgtcatgtaacaaaagaccatgagatccatggaggaaaaaaggacagctttatttttctatagaaaacaatagtaggttggggatatgcagcctgtggtgtaaaatgaaaatgaggtcctagttgggggttggagagttagaaattataaaggcaaaaattgtaggacaggggaggtggggtcaaggaagtaaggaataaagtcttgattagatgacctttaatccccaaatcaccagtgtgtcttagttggttgtttccaggtggttggtcagttggcaccaggtggtcttttggtgatcatttggggaatttccaaatgatcaccaaaaggaactgttctttgacttggtggcagaaaaacaggttttgcaacacttttaaggacacagggtataattgctcccttaccctgtcattgcctcttggttctgcttttacctttgagccacaaggagtctatcttgtcaattaactgggggcataatttgacagtccaatatgtataatgatgacaacagctccactaacatgaatgccattcttagaatttctcatagatcctggcatttggtacatctgagttgaataaataaaagtctggggaatgaatgaaagaaaaattagttcaatgtcctataactttaagttaatttattagaattgccaccaacaaaattagctctagcatttagatactaaaaggaatttgttaagcaaacttacttttgcagttatctctccatggacagtcagaacaggtattcttcatttctaaaacatactgctgttctttaagaccattctttggcactgtggaactttagtcattttctagacatttgttagccactaaatgtctcataccagggactcatatttgtaaataatagtgtctgcctttgagaagctcataactgggtagtcaacgaacagtcacagtgcagatctggaatcagtgttgagggagtacaaaatcctttgggtgttgtaatcagagtcaagaaaagcttcacagtggcgataggcttaagcttagttgaaggaagaggaagctttcaagtggaggtggcagagaaagcattctgacatgtgaaaaggcaggaaagcctgcgtgcagcatatttattagttttgtctcccttggagcattttgtaaattttattgagtattcagagttgacagaaaggcagtcagggatcatttcatggagcgccatgctgagaagattagaggattttaagcaagtgatgtggtcaaatttgcagttttgaaagagtacttaacattatcctggttatatgtttagcagatttggcaagaactgattgttatgatttgatagtcatttaatacaaaaaggaacctggaatgctcttcgtctttagtgaacattatgtaacctatcttcatggccttcttagtgaggtaaacattttttttttgaaattgtaaagatttaaactttttgaagggtaaactttctcagataattatgcttagttgtgagcagaagtaaaataatgtttttacaggccagagcatttaattaccagtgcaagactgtccagactactctttccatttaccatgataactggtaaaatgtgagatggtgattgctccatcatcttgggtactgagatgaaaagatgtggggtggagtcctcaaatgacttatgatgaacagctagtgtaagcaagaaaatgaccttattgttttaagccactgatattttgcagttcttacctgataaatggtacatgaacctaacgtgtttttattgatgcaaccatatatcaaaacagtatttttgaaggaatcattgtagaagtacagacatttatagaaaattttttacctctctgatttagagaaatttttgaaagcacaataacttaggtaacatagtaacataaaagttctcataatatgtgtaaaccaaaatgagttactgcaactaagagtcattttgaaagagactaaaattgacttatctttaatttgttaaataaaagtgtgatattaaatccattacaaaaatgggtaaaaattgaagacaactgcaattttataggttactgaactttatattttacatgatattacagtcatccttcagtatacatgggcgggtggttccaggacccaagtctacaaatatgttaagtcccacagtgggtgctgtgaaacctacataaaggaaaagttggctctctgtatgcgcaagtttcgtatcctgtgaattctgtattttcaatccacatttggttgaaaaatttcagcctgtaggtggacttgcgcagttcaaacccacttcattcaagggtcaactgtattttatagtcagtatttgcataataaggaaatctaaatggtactttgatattcaaagtttcataataatctatatgtatgttttaaagtgagtgtggtgatattaatacttaaatgaaaaatatgagttaataaagcaatttataattttatatcaattgagcatattgtttttgaaatttaatttagaataatcatctatacataatctatagatactttagtctttctatatgacattcttatggtggtttattgattatcataactatgaataatgagtaaaaattatacaactatacaagccaatatatgcttgaaattattatttattgatagtaaattagattttgacatgaaatgatttctgtttaggcaataaatttaaactatagaaaaaaatgcagtgtaacttgtactgtaaataaacgattagcaatgaacattacagtgagagctgatagtttatgaattattcactgcaaacttattgtctctgtgtcattaacatgtaagataatgagcctaattaccatggctttaaactcaggggagttagcaatttatgtgtaaaagtttctgggctgtagttaccacccacaagggtattgagagaactgcagacactacttctgtgttttgtttcagaaatgttctttttcctcacttgcttccttcttaataaattagtttttatttatttttatagtgagaattatgagcttttcctcttgcttgaatacctttttaaaggagttatgagaaatatttaagtatttttttagtgtagtttagtgttgtaagtagacaaaatattattagatgtattcttttatttgcttacataagttggcatcacttactatagtaaatgaccactaatagtgtaatttcttggaaaatctagcctaaaaggtcaatattaataattggttttctcctctaaaaggatttgtactaagatgatttactttcaaagtactcagtattagcctatagccttttttctaatctttaatattgtatctttgatcttaatttaaagttttgatgaacttgttgcttctattttctctcttatagtataaattatctgtaataagccaccttaattaaagttggtaaatctacaactgcttcaattatacactaatcaattatacactaatttaattctacttagcaggatacggtacatcattaatcagttttagacttaatacaacagatttagaagtaatcaaaattgaagcattttatttagctgggaaaaaaatgaagggtcataatctagtaattcacatatcaattctgataaaaatcaaagattctttgctaaaaatgaaggaatgtagctgttatgtttactgttgagtgccatgggctgaagctgtgattatataatatctttagatgttaatagcataatagttttgtgctctacctttttctttaaattgttattcatgttactaaatgggttgttttctgtaacatgattgtttaacgtatacataatataagaattccttgagtgaatatcttttttgttgttgttgtttgtttttgtgttttttttttttttttttttttgagacggagtctccctgtgtcgcccaggctggagtgcagtggcatgatctcggctcattgcaacctctccatcctgggttcaagcgattctcgtgccttagcctcccaagtagctgggattacaggcatgtggcctagctaatttttgtatttttagtagagaagaggtttcgccatgttggccaggctgatttcgaactcctggcctcaagtgatctgcctgcctcagcctcccaaagtgttgggattacaggtgtgagccactgtgcctggcatatagaatatttactagtagtttgttttgaacatgtaagcatgtgcacaaatgtatttttttcagaattatgttaaataagatgattagatataattaactcaaaaatctttagcaaaatgatctttgttttctgtgattgaggtggtgacaaatttgccttagaattcttggggatgtgttataaactcgatgtaatcatttttcttttccttttttttttttttttttgagacggagtcttgctctgtcacccaggctggagtgcagtggcgcgatctcggctcaccgcaagctccacctcctgggttcatgccattctcctgcctcagcctcccaagtagctgggactacaggcacccgccaccatgcctggctattttttttgtatttttagtagagacggggtttcaccatgttagccaggatggtctcgatctcctgacctcgtgatccgtctgccttcgcctcccaaagtgctaggattacaggcgtgagccaccctgcccggcccatttttctcaattatctgctcattgaattaaatgactcagattgaatttcattactcattctttctatacatgttcatattattggaaacacttcttgtcctgctcagctttctttccaataaattagtaattctttgctcactcgtcttgtattcctttataagaatgttctagatagggatattctaagttttgaagactatgtatgttaagtgcattttacccttttgagagagttttagtaacaagtttcagggaacccctaggactctgacccattatagctttggccatttaaaaaaaaaaaccttcaaaggtaatatgtgtacatggttaacaatcaaatagaacagatggtctgtctaataatgaaaaacaagaaaaatcttgccctatgtttctctgttcccactccccccaaaatcagccacttgtaactgattctgttttcagtgcttattgtggttgtctcaacctgtagtagaattatagattcttttgtttgtttgtttgttttgctttttaaattagagacaagttcttgccctctcaccaggttggagtacattggtgtgatcacagctcactgaagccttgaactcctgggctcaagccatcctcctgcctcagcttcctgtgcagctgggactacaggcatgcaccactccacccagctaattttttaatttttttgtagaaacagggttttgctgtgttgtcccttgaatgcctggcctcaagtgatcctcctgccttggcctgtgattataggcgtgagccactgtgcccagccttagaaattatttctcaatgcttttgctcttctgtgttctgtgattaggtgactctttatctcacaccacttctaccttttctccatccttccaagttgtgatcactgttttcgttcctaaattggttatttttaaacttcaaataattcaggtaaatttatattttatgttttgttaactgtgttccctgcttactgtttcttccattaatttaaatatcatcgaagttgataatgctaagaacttgtttgtgttaaggtaattctcacatgtggataaaaactgattagtgccaaaagtttacaataaaatataacagtctcctatcctaccctgggttctccagaagcggcaacttataatactgttagtttgttctttctgatactagcttattcctaaataatatgtgtattcagcttttctgattaaccaattttagatgttatctattgacctttttattggggcctgggatacagatcatattatatacctgtgcacccagttctgaaaagttatataataattttggttcaatctataagcagtctataatcgttatttatattatagtgactatgtaagtattgagtgctgtaatatagcacattacattcatttgcttaaacaaatatttggtccccctttcccaccacattatttatagccttgtttattcatttgcttggtttcctattggctaatttgctaatctcccccctcagtgtttcagcagatctctccagcacctcccattaatttttctttgtttatcataggttcgaaactcaataattttttttcctggaagtttctctccttcagccctctattctactttaccaaggagttgtcttactcttttcagctctgatcctgggacttccctttgttgctcttttgggggacaatttgctttttgattgtttttagtcttattagtttatgcccttgttttgctcaagcacattctccagagcttcctgagaaaagaatatgtgagaaataaaatttttccatacatgtaggtctaaaatgtctttattctacctttacataggttggtatttcaattaagtctggaaatgcagattgaaaataattattcctcagaaacttgaaggccttgctccattagcaaccagtgtttcctatgtgaagtttgatgccacactgattgctgattctttatatgtgacctatttttttctctttggacattcttagaatctcctctttcctcctggtattctggcatttctcaatgtgatttttcttattatggcttttttttttcattgttctgagcatgtaatgggcccttatagtccagagacttaaatgttcttcctgccattcatgcaggtttttgaaatttcttctctactattttctttagagctatgagttatttttattagccagttttctattaatagacactggatttttcaagttttccaccacaaaaaacactcatgggccgggtgtggtggctcacacctgtaatcccagtgctttgggaggccgaggtgtgtggatcacctgaggtcaggagttcaagaccagcctggccaacatggcgaaaccctgtgtctactaaaagtacaaaaattagctgggtatggtggcaggtgcctgtaaatcccagccacgtgggaggctcaggcaggagaatcgcttgaacctgggaggcagaggttgctgtgatcacgccattgcactccagcctggatgacaagagtgagacttcatctcaaaaaaaaaaaaaaaaacaaaaaaactcctcacatatattatcttttttgcatgtacttttatataattgtgccagttcttctgtaagatatacatggcttttatcttattactttctctgagaggtagagggtggggcagggaaggcaaggagaggaagaagctttgagattctcctacctgaacttcagattctggtgtgatacctcaatattgagttagaatggctttatcaagcatgtttatttctagtttttcatattatttttgtcttagtcatgaagcacaacaaaccaacatagaacccatttcatactgatgaataaacaggtagcttcattcatgtattcatttattcattcagtcatgttgtgatactctttgggaatacaaaggtgatactgtacttgctgtcatgggatttacaattctagggataagtaggagtgtaattgataaaacatgtatttgtgcttttcaatagtaatattgactaactcaagaaaacttttggagacaggctttctttgaatggactgtgatgcttgcttgtttatgttttcatgaatacatttactagcttttgattttttatattaggagagaacagagtgtcttgttgtggcagaaatacctaatatgtaatcctctgaattcttcaattgttgcaaaacataaacatttactaaagagttcagcagagtagattaaatgttatttaaaacatatgttatattgacctcatggctaaatggcctggtttaggaatccatgaattatcccacaggtaatagcaaagttttctccctgcctcgtctcccaccccaaatatttgatttccacatatactgcacaggggaattgaatttgatgtcgaaagccataagaaaaagagaaactttgctttttactgcttttactaggaaatagaaaacatttttagtgacaggctatgcttcatcatgaaaatacggttgggtgttttaggccttcacaaatttgatttcattgtacttagtgatggatgttagtaagctgtgtgagatggagagaaattaaagaataaacaggaacctctcaaacttgctagtgatgttctacagtttgtagcatgaattttcttacttttagtttttccttatgaaatactttatgtagaacaaactagcagtactaaaacaaacacccatgtacccaatctgtcaacacttagatttgttgaagatttgggtgggcagagtcttccacccaaatggtaaaaggggaatacattacaagtacatctggggttctctgtatacctgtcttcagcccattttctgtcttatttcaaagttcactggtgttccagttttgtttttagctgtaatgcttttcttagtgcttaaaatatatgtgtatatattcataagcaatatgaagtattgatttgcgtgttctaaaacatattttacagtgcctctccttcggctcgctttttcgtgtaacattgaatttttagatttttccctgttaatgcacgtaatttatatgtaatttattttcacctgtatagacttgtatgaatacatcacaatttattctttggttgaggaattacaggtttttcagtattagaaacactactgtgtttaaggttcttgtactgatctgtttatgcatatgtgaaagattcttgaggactgtattttaaatatgtggatgtttaaatttcaattaattaaaattaactcagttcctcagttacactagcaacatttaaagtgtttaatagccacatgtaactagtgagtaatgtattggatattgtggatatggaatcattccattatcataaaaagttttataggctagtgctccttggggtttatacctgtgtgtggaattgttgtgtcactgggcttgcacatgttgcacttcagtagatgttgctgagttgttctttccagtggtatctgagcattccctttctcaattgtcttgctaagaattggtataaacagaaattctaatttctgttttgtaggtgtgaactgtatctcattgtggttttaattgaattttgaaaatatatagtgaggctgagccttttttcttatacatgtgtttaccttttacagttctcatcttgtgattgcctcttaatgtcctttactcattttttcttttgagatattttaaattactgatttgcatgagttttttttgtattttatggatacaaattctttgattatatttgccatatatctgtgcctagtatgtgacttgtctttcattttgtggtgtcttttgcctcacacaagttttaaaatgaaatgtaatcacattatcaatttttaaaaatgctttatcttcttatgccttatttaagaaattacttcctactctaaggtcagagtttcccatatgtgctttgcagaggtagatctttcatctggtagtatgtaatttttgtgtatggtgtgaggtagagttggagacttgagtttttttgcatatggataaccaattatctttgtataattttctgaaaacttcattgccttaatagttttttgtttgcatgggggtcaatttctgggttctaattctgttccattggtctatttgtccctataccaatgtttcagttgaattttcctttttgtcaaagtacctatttttttctttattttttgtagagacagggtcttgctttgttgggtagactggtcttgaacatcaaatgattctcctgccttggctttccaaagtgctgggattacagttgtgagcaaccacacctggccaaattttcttaaaatgaaaataacagtgataatttaggtccaagccctcttcccaaaattgatttagctgatgataagctataatattggaatttataatataaaatactacaatttttttttttttttgagacggagtcttgctctgtcaccaggctggagtgcagtggtacaatctcagctcactgcaacctctgcttcctgggttcaagcgattcccctgcttcagcctcctgagtagctaggactacaggtgcgcaccaccacgcccagctaattgtttttattttagtagagacggggtttcaccatgttggccaagatggtctcaatctcctgacctcgtgatccacctgccttggcctccaaaagtgctggctgagattacaggcgtgagccaccgtgcctggcctagaaaatgatattataaccagcagatgtgaacaataacatttttttctgtgatgatatttgagaaaagcgcaacttaattacaaaagagtgaaaaacaatcactttatcaaagtcagaacttctatacactttcaagtggtgaattgagcctcacttaaaatctaattttcacttttaatgccatttgttttcttttgagatataactgattcatttaccaccaatttttataaattggatttgtagtttggccattgtatgaaaatatttttttaaaaaagtatatgggtcatatgggtagtaatcaggcaaattggttttagatttgcagtacctgttcaattatctgagatttaggggatctagggcatgtgagtagaggttctattaggtttataaagtgcttgtgatgataatataggttaaggaccaagtacctgggaaagatcaagggcatactaaatagttgttcctaaagtaatgggacaattgcagagagagggatgagagaaggagacttaaggatgatgtgttgatgtgtatgtatatataaatgagacataaatgacttttggaaggattactaaagaaaaacagcaatagaagaagactagcctatgtccagcagcaaaaggaagtagaagacagtgagtcagatagtgaccagtacaggacgctaggtggtgccattagtcttagactgcttatttgaagtctctggaggctcagtaacctcagaatagaaagatcgaaaggcggccgggcacagtggctcacgcctgtaatctcagcaccttgggaggccgaggtgggtggatcacgaggtcagcaattcaagaccagcccggccaacatgatgaaaccccgtctctactaaaaatacaaaaattagcctggcgtggtggcgggcacctgtaatcccagctactcaggaggctgaggcagagaattgcttgaaccggggaaggagaggttgctgtgatcggagatcgcgccactgcactccagcctgggtgacagagcaggactctgcttcaaaaaaaagaaaaaaagaagaaaaaaaaaggcactgcttgtatagtaaatgagcgaattgtcttattgagtataacccatagtatattatagttcttgatattttcttctccagtgatcattttgaaaaattttctggaatttgcattgtaaagaagtttgtccaccaaataaactgtgttttaaaagtaatagttcatttctttctaattttaaaggttgtatataaaaaggtattttcatttaaaattcatattaaaaaagataattgaaattttcatattgaaattatataatcagaaggaacttggtgttttaataagctttagtggccttttcctaggtcaatgtacaattccactgaatttttttgaaatacatatccatgggttccacattggtggattaaaccgtggaaagaaaatattagggaaaaagaaattgcctgtgtacagagcatgtacacatttttccttgtcaatattccctaaacaatatgacaaaagtttacatacatttccattgtattagatattgttagtaatctagagatgatttaaagtttggggaggatgtatgcaggttatatgcaaatacagttgaccctcaaacagcacaggtttgaactgcatgcacctacttatattagtttttttccagtaaatacagttggccctctatatgggttggtttggcatctacaagcaaaaatggatggaaaatacagtattcaaggaatgtgaaagttgtgtatatggagagaagggccaactttttggatctatgggttcaacagggccaactgtggtactttagtatgtgtgcattttggtatccaagttgggtcctggatccctcaaagatactgaggaatgactgtattgaagatgattccttgattcctgttacatttttttttaagattccagattgggaataattaagtgcattatttgatttctggagatgagttacaccattaaatttttgttgatatgtgtatcgtgcaggtgacagaaaccctaactcatactggcttaagtaaatggaaattattggatcacatatctaaaaagatgttggtatggctgattttaggtgaagcttgatgcagaggttcaaataattttatttggaccctcttcacctcatcttctagaggtagggtactgccatcagctattggcttatatccttatttgtgtgtgtgtgtgtgtgtgtgtgtgtgtgtgtgtgtgtctgtctgtctgttttagtggctctaaaaacaggtgtaggattatgtcatattaggcctctttggcttgtttgggttccatatctactctgcaactggagatagagttaacactgctggaaatttatggattaagagtgttgaagggatgattccccaaagaaaatttggatcttattagggaaataaagaatggttgtaaaattgcacttatttctttaaggaagtcatcttaaagctgtttttctttgccaggtatggtggctcacacctgtaatcccagcactttgggaggctgtggtgggaggttcacttgaagccaggagtttgagaccgctctgggcagcataatgagatcccatttctacaaaatatttaaaagttagccagagatagtggcatgaacctgtagttctagctacccaggagactgaggcaggaggattgcttgagcccaggagttcgaggctgcagctcgattgcgccactgcactccagcctaagcaacagagcaagtcaccatatctttaagaaacagcaacaccccccaacacatgaaaaacttttttttttttttggctaagctgttcttacactattgattttatttcactagaatttgtttttactttaatctcatttgtgctacttattagttgtgtgacttctcagagtccatttcctcactggcaaaattgttgatacaactattgatatagttatggtgatgataaaataagataatgtgtgtgaaatacctagcctagtgcctggcatatattagatattacagaaatgttagtccacttgtaagcatggttattacccagacatgtttggattttatcagtctttgctatatgttttaaattagcctataatctgtaagtatcacagatgttgtagaatgatcaattttcagattatcagtttgatttattgattaccgctttcagtgctgaaaatgacagttggtagatattgtccaattcatgacttgccagtatttttatcctagtacttaatgtgcagatttagcttctgtaagatttttacaattaatctatgtggggaaatataaattatctttaaggagtagcagtaagtgtagtgaaattatgataaatggttttattgtttggggaaataatatcaactgcttcatgtgtttgaagaataaaaggaagttggcagcaagggagaaagatgaatgattaagtatggcttaaacttgttttttaattaaagtgcttcattgttgtacacaatattcaaattatatttaaatgtaacattaatttttctattaacattcatctttattagaaaatattgcttgtatttatcataatttttttccccaccaactataacactcttataatctatttgggttaatgcgtgtgtagtctcaagaaaagagcctccttaattgtttttaaactgtttgaacactagagatttagtaacctacatttccaataactaacaatacatatgaaactcttgatagtgatggaatagaactaatcatttccttataatatagtgatacatcattatttgacttatggcatatttaactctggttagctacaagcagctttatactggtgtcttttattcagatttgagaagtatcagtgtaacatataaagaacttatttttactaattttcaccatattttatagacacaaaccacatgagaccaaaaatagtgtatactgacctggctggtcattttatggttggttattgtgtttattattctgtactatgtttgttgtatttgtgctttagttgctatttatttttaagaatattgtgttatataggtgtaaaagtgataagaatgtgccaggtatggtggctcactgtaatcccagcactttgggaggccaaggcaggcagatcacttgagctcaggagttcaagtatatcttttgtaatcccagcactttgggaggctaaggcaggtggatcacttgagctcaggagttcaagaccagcctggccaacatggggaaaccctgtgtctactaaaaatacaaaaaattagctgggcgtggtggcacgtgccagtagtcccagctactcgggaggctgaggcaggagaatcgcttgaacccaggaggtggaaattgcagtgagccaaggtcatgccactccactccagcctgggcaacacagccagacttcatttcaaaaaaataaataaataaataaaagtgataagaatgtgacatgttaatagggagagatattagtccgatggtaattaaaagcagagaaagttttaaataaactaaatggtgaagaattggtttgttcaacaataggagttattttgaagaataaagcaagtgattaaacatgtgaaaagtaatgtgcctatgccccaaagtgctattgcttagtgggttatatctattgataattacaatattagaaattaaaatggaaacggttgaaaatattcaatacatttaaagataactgtaataaacccagtatttgctagcataaacacatttttctggaaaataatgatattttctaaaccagaaaaaaatagttaaaagaatggtattgctttttgcaaatctctttaatgtctgacttagtagaagacagctggattttcatctgcttctgcctgccatctgttgtaatatattgaactgatccagaactcctggtctcaagccattgttccacctcggcctcccaaagagctaggattacaggtgtgagccactgcacccagcaaagcaaatagttttaaccttgttggttccctgaaaagattttgtgggacccttgtagtccttagactatgctttgagaactgctggccttagcaattgaacgtaagtacagtaggagacattggtagaaatgcttttgaatttacagtagagtctgggcatcaatattagatgtctattgatcttttattaaaagactaagagtttgagaatttaaaggctaaaacattataggtcctgctgatcagacttttcatagccagatagttctgtaggcttaaggccctttaaatccagataatgtccaagtaagtggcaaggcagcaatttggattccatagctgctaaaaagttttttacggcatttgtacatagatcattaagaagagaggaattatttctcacaaccaatttttagtgtagacaaaactggaatattttggagaaaaatgtcttaatagaatgcatatagcggtaatgtagtcttctatttggcaggaatatatatagggatggtcactttagattaaagaacaaataaaacttaacctacttataaacagaggcttctgtattgagaatttttcttagtataacatatattcaccttagtatcaagttgtgggggtttttgatacccccaaattgacagttattcagctgaaacttggagataggacagaccttgattaatatttggcaataattgtcagttctaatgttggaatttttgctctaaccttgttgattaagcatttaacttatttacatttttatgcttagggattaaaagtatgtctactttacatttatattcaggtatatatatatttttgttgttgttgttgttttttcttattattattatactttaagttttagggtacatgtgcacaatgtgcgggttagttacacatgtatacatgtgccatgctggtgtgctgcacccattaactcatcatttagcattagtatatctcctaatgactatccctcccccctccccccaccccacaacagtccccagagtgtgatgttccccttcctgtgtccatgtgttctcattgttcaattcccatctatgagtgagaacatgcggtgtttggttttttgtccttgtgatagtttactgagaatgatgatttccaatttcatccatgtccctataaaggacatgaactcatcattttttatggctgcatagtatatattcaggtatattttaaggcagtttttaagtatatcttttttctttaatagtacttacaaaaatgtaattatttgatatgacaaagctgcttcatattttcatattagcttgaactttccattgatatgtcaagcaaataaatacttagtttttttctgagtagaaaccaactgtactgcaaaccccattgatagtaaattaattgcagggatttaacatgtagggaaaccttaattattctgaatatacttatgttatgatgtgtagatgatttgtttactgtctttaatgtgactgagtcaaaatatgtgtagttatttgcataaaagggaagtgttgctaatatattttgcattacttaatgttatatataaaattaattttccttgtaagggatgtgagaaatttttttactcctcatttctgtttattctcatctatttctttgaaaatgtagatttaatttatttaaatactgtgtgatgaaaacattacagatatgttcttgctctctttttttttttgagacagggtctcactctgtcatctaggctgagtgcagtggcataatcatggctccctgcatgtcaacctcctgggctcaggcagtcctcccacctcagcttcctgagtgtttgggactacaggcgcgcactaccatgccgggttaacttttgactttttgtagagatggggtctcactatgttgcccaggctggtctcaaactcctggatgcaagcaatcctcctgcctcagcctcccaaagttctgggattacaggcatgagccaccacagccaatatgcttcattttctacctctgattataaattaaaggatagtattataaatgcttaattttataacctccaaatagtgatattgtattgctccttattgtgatggataaattataagacatatgtgtttaactggtttggtggcaagtctgtttacagaaatttgctgttaatttctcagttgttcacatgaacttatctgatttatagctttggccagcaatttacaaagaaagttcagtctgtagggcttcctgttgctctgagtgggggctccttctacccctgttcaacttcagtcagcccatggtctatagtatacctctcacaaggtccttatactgcagatcctctctgctgcagatgcttgggcttttgccttaagcacactggtgtaattagaagaagtagaaaagaagagaaagggtgaataataagagatgagaggatttaaaaatggttgaaacaggagttgtgaagtttgagtgtggtggatatggagatgtgcagccctgatcctccttcaaggaagaattgtggcccagttgtggggaggtcagtcatcagaaaaccttcagctgtctggcctacagaggacagccagaaaaaaaaaaaaaattgccttaagctgtcagctccttcaggctctacctcagttgcggagagcctccttgcttaaggtcacatcctttccagggcagcacttatcctgcaatcaagcaagacatgtttaaaggcccagccattttgttcaggcctgagacaactctgacaggtgatataccaccagagatctgccaggttgcttgaggctttgttgggcctgaattgcaatttgatttttccctctgcccaattcggctttcttccccaaatctcttcttcttctttttttttttctttgagatgaagtcttgctcttgttccccaggctggagtgtgatggcatgatcttggctcactgcaacctctgcctcccaagttcaagcaattctcctgccttggtcccctgagtagctgggattacaggtgggtgctaccacccctggctaatttttgtatttttagtagagatgaggtttcaccatgttggccaggctggtctcgaactcctgacctcaggtgatccacccgcctcggcctcccaaagtgctgggattacaggcgtgagccactgcgcccggcctctccccgaatttctttcacagggattgactgctaataaacatcatatacccaaaactacttcagtgtccattttcagagaatccagcttgcaacaggcaggcgtatcggcttcatgttgtcctaaaccttacgtaaagttctatgcaattttttttgtgaatttgcatttttcttaggaggtctgtggcttccattatcttctttaagatagacttgaaaattaaaggtttttctcatcaaggacttaagaaggaaaggcttaaacattttttttttgactcaagatcaaactaaatacacttggccattgaacaatatgggggttagtagtgctgaccctttgcacagttgaaaattgacatacgactttttactctcccaaaacttaactattaataatctactgtgtaccagaagtcctaccagtaacatagtctataaacacatattttgtatatgtattaaacactgtattcttacaataaagctagagaaaacaaagtgttattaagaaaatcatggccgggcgtggtagctcacacctgtaatcccagcactttgggaggccgaggtgggtggatcacctgaggtcaggagtttgaggccagcctggccaacatggtaaaaccctgtctctactaaaaatacaaaaattagctcgtggtggtggcaggcgcctgtaattccagctactcaggaggctgaggcgggagaatcgcttgaacctgggaggcagaggttgcagtgagcctgaaattgcgccattgcagctccagcctgggcgacaagagcaagactctgtcttaaaaaaaaagtcataagagaaaacctgtttattattcattgagtggaagtggatcatcataaagatctttatccttgtcatcttcatattgagtaggctaaggaggaggaggggttgctttttaagagggggcagaggtgattagtaggagaaaaattttaatgtgtgtatatatatatatatacacacacacattatatatatataattttttgtagagacagggtcttactttgttgcccaggctggtcttgaactcctgggctcaagtgatcagcctgcctcctaaagtgctgggattaccagcatgagacaccgtacctgactggaggaactacgtttttgatatggtactcagagaactgagtgcagtacagaagcttatacacccccttttttttatagggaagtggggaaatggagaatgtagacagttcttttgagggccagtaaatcatttaggtgggaggcagacattgtgggaaggtgagaggtgaagctgcaggttgtcttaccatgcagatgaaggccccctgggtaatctgttggagctgccctgggaagaatagatgaagtctttctgggcagtaatgatcatgacttccagcttcttctcatgtagtcgacctttcctgatcatttgatgagatccctaggaagggagtttaagacaattgcatttcttttggaaagaagcttttttgggctgataaggaaataccagagagagcccctctctgcgctggggtgggggacacgacaagttagagggatcttgattgtgaggcagcttctaaggcctttaagcatgtctaagtgccagtctttgggggtgtggtttgagagaccaaaatagatgcccctttattaactaggacagatcttaaggttaaggaaacaaagttacctatcggtagaaagttcagggccctgctggtgtggcaaatttctaaattcctatggctacaagaaaaatcactcttattaaactctctaacaataggagctttcagacaaattatcacaattctgatttacagcccagactactacaactctggacagaattcccaacttagaaacattcttttcttttcttttttttcttctttgagacagagtctcactctgtcacccaggctggagtgcagtggcacaatcttggcttactacaacctccacctcccatgttcaagaaattctccagcctcagcctccagtgcggaccactatgcctgggtaatttttgtatttttagtggagatggggtttcgctatgttggccaggctgttctttaactcctgacctcaggtgatctgcctgcctcagccttccaaagtactgggattacaggcatgaaccactgtacccagcccttagaaacattcttttctgataagctttatagaccttgagtttcaaccagctttagaggctgggcacaaattgtctttgcatcgtatagtttttatcttttgatgtaaagagccaaattccaccttattttaatgctaaagccccaccccaaagtgagcataggatgtatattacacatatgtttacccattgcacgtgcgctcagctcttctcgtaaatatgaatagctttcccctaaatctgctgaatatatatgattctgttgtgtaatatgggccctgtgaggcataaaacccaacctatccttcccctgtttgaagacagagcacctttggtttgcactggagactttttcttcgctggttgcaaacccatattcccagtaaagctctcctttctactacgtagcttctggttatcttttggatgacaggggtattgctttctgggccccaacactgggaagcagcacttaaccattgtaagcaaggagaagggtgtattaattttctgtttttcagataacaaattgacacaaatttagcagctttaaaacaatacccttttattatcttatagttctataggccagaaatctgatacagtgtgtctcactcagctggttctcagctccaggttttacaaggcagaaatcaagatgctgggaggatagtgtatgttcctttctggaggctctaggggtgaatgtttccaagctctttctggttgttagctgaattcagttacttgcagttgtaggactgaggttcccatttacttgctggctttttgggaagtggtgtttacctgtttaatctcagtggtgtttacctgtttaatctcagtggtatgtgtagttatatgggattgtgtgttttaaattgatctcttttgtacctttcctttctattcctttgatttttgttctttttcatctccttttactttctttgggtttatctattgttccttttcaaatatctttttttttttgagacggagtctcagtctgttgcacagactgcagtacagtggaacgatctcagctcactgcaaactccacttccccagttcaagcgattctcctgcctcagcctccggagtagctgggattacaggcgcctgccaccacacccagctaattttcctgtttttagttagagacagggtttcaccatttggccaggctgatctcgaactcttgacctcgggtgatccgccctcctcagcctcccaaaatgctgggattacaggcatgagccactacacccagcctttaaatatcttaataagaatacttagctcattcatttacagccttttttcatttctaagatgagcacttaagtctatacatttttctcagaataccttttttgtgtgacctggactgtgtgagatagttttttactttttcattttgaagtgttttaaatttcttttgttttgttttgttttgttttgtttttttgagatggagttctcactctgtcgcccaggctggagtgcagtggtgtgatctcggctcactgcaagctccccctcccgggttcacgccattctcctgcctcagcctcccaagtagctgggactacaggcacccgccaccatgcctgggtaatatttttttgtatttttagtagtgacggggtttcaccatgttagcccggatggtctcgatctcctgacctcgtgatccacctgcctcggcctcccaaagtgctgggattacaggtgtgagccaccgcgcccagctaaatttcttttatggtttctttttgacctgttgattgtttgggaattgtttagaaatacgggtttttaaaaagctattttttctttgattgtacattgtggtcagagaataagttccatgtgatatctatgcttagaaattttttagatttatattttgccagtacatgactacttttgtaatgttttatgtatatttgataaaaatatagattatctaattattggatgcagaaattcatatattccatatatcattatatgatccatacatattcaagcttgttaattattatttcctgaatataatctttgtttatttatatgcttgactggtcagtaatagaaaaatgttgtgtcaaaatctactgggaggggtggcgacgtagctcacccctgtaatcccagcactttgggaggctgaggtgggtggtctgcttgagctcaggagtttgagaccagcctgggcaatatggcaaaaccccatctctactaaaaatacaaaaattagccaggcttagtggcaggcacctgtaaacccagctactcgggaggctgagacaggagaactgcgtgatcctgagaggtggaagttgcagtgagctgagattgcaccactgcactccagtctgggtgacagagtgagaccccatctcaaaaaaaaaaattaaaaaaaaaaaaaaaaaaaacaaccctaaaacaaatctactgtgatgttaggtttgtccatttttttccagatttttttggcttgatatattttgagactattttattagatgcacatacttttaaaattactttgtcttactggtaatgtgaacttaaataattttgttatgatcctttctttcctagttgatcatcttttagtttaaagtttatctgataacaattacatgtagttaaacttctttcttttggtcaacatttgaccaatatgtcctttttccttctttcactttttttatttttatttttagagttggggtctggatatattgcccaggcagaagtacagtgactgtttataggcatgatgatagcacactacatcctctaacttgtggcctcaagcgatcttcccgtcttagcctcctgagtagctgggactacagatgttagccatcacactcagcttctttcacatttatacattaggagtccttttgctttttatatgtcttttataatagccattagttggattctttaatcttataatctttattttttaacataatgatttttgatttttgttcatccctcttgttcttggcttcataaaaaaaattgaggccagctgggcgcggtggctcacgcctgtaatcccagcactttgggaggctgaggcaggtggatcacgagatcaggaattcaagaccagcatggccaagatggtgaaacctcatctctcctaaaaatacaaaaattagccgggcgtagtggtgggcgcctgtaatcccagctactcgggaggctgaggcagggagatttgcttgaatctgggaggcggaggttgcagtgatccgagattgcgccactgcattccagcatgggtgacagagcgagactccatcttaaaaaaataaacaaaaaataaaaattgaggccaggtgcagtggctcacgcctgtaatcccagcactttgggaggctgaggtgggtggatcatggtcaggagtttgagaccagtctggccaatatagtgaaaccccgtctctactaaaaatacaaaaattagctgggcatggtggctcatgcctgtagtcccagctacttgggaggctaaggccagagaatcacttgaacccggaggttgcagtgagccgagatcgtaccactgcactccagcttgggtgacagagtgagacttcatctcaaaaaaaaaaaaaaaaattgagtgccttttacccagagcctcaccaacagaattgccaaacttttgattttttctttttttgccagtttgatcactaaatagtgatgtttcatcttacctcgaatttttttttttcatgagtgaagttgagcatcttgtttaaaaacatttgtggccaagtgaagtgctcaggtctgtaatcccagcaagttgggaggctgaggcagaggattgcttgaaaccaggaatttgagatcagcccaggcaatgtagggagaccccgtctctaaaaaagaaaaattaaactggtgtggtattatgtacttgtagtcccagctattcagaaggctcagggaggaggatcacttgagcccaggagtttaaggctgcaatgagttattattgcaccactgcacccaacctgggtgacagagttagactagatctcttaaaacaaacaaaaagtttacttttctcttttctgtaaaatgtctgttcatatcgtctctaccacacttatttttttggtgggattgtgtctttttagtgatatctgtgtttttttgttttttgttttttgttttggagccagggtcttgctcactgcaacctccaccttcctcaagcgattctcctgcctcagcctcccaagtagctgggactacaggcatgtgccaccatgcccggctaattttttgtatttttagtagagatggggtttcactgtgttagccaggatggtatggatctcctgaccttgtgatctacccgccttggcctcccaaagtgctgggattacaggtgtgagccaccgcgcccggccttaaacaagtttaaacacacacacacacacacacacacacacacacgttttttagagttggggcttgccttgtagcccaggctggtgtctaacttctggcctcaagtatttctcccaccttggccttccagatagtttggattatgggtgtttacccctatgcccagctctaaataagttttaatgccaaccatcacttctatttgtagagattcctaatgccacccagtgtaatgcttttggggctatggcagtgtaaatttggttttctcactgctgtttataattcagctttcttgggtctattgagttgatcactgcacctcactctgctttccactgtccaaaattttgtcaccattatttttttgtttttcttgtctttcagagttttagtgaggtttcaggaggaatcagaagttcatgcatgtattaagtcctttggttttactgaaagtttgacacatattttgaattgtagttattttgtctttcctaatttagatgcaaaattaagttgtctagtgagatactcagttaatcaagttgagatattaagggttacaaaaaggtttaccacactggtttatatacaggttaagtatccataatttgaaaatttgaaattcataatgctccaaaatctgaaacattttgtgagccgacaagagactcaaaagaaattttgaataaggtatactcaacttggataatattcatttgaagcatgtaaaggaaataatggctgttatgtgttatacacaaatgtgaagatagtgttgatttgatgctttacttttgataatgttgatctgatgccctggttttgatcacttaacagatacccatgtgctttatgggaagttgagttcttcttatgctcatgggctgagcccgaattaatccaaatcagtaatggtaattttatgccctctcccattgatttgatagtgagtggccttgagagccagttcattgggggaagttccccacttttttggtaaagaaacataagcaaggggaaggcagtctctcttatgatcctagacattaaattgttacttgcaactagtgtagctactttgaaaccgttaggggacaaaaagtcatcacactaaagatgacacaggaaaaacaaggaaagaacttaggtccatgatcttgatgaggcatcataaattacctatccctggagctgctgtagctctggactttttgttatatgagataataattcctcagattgacttagaataccaatcaaaataactattattttagctagctaagaaaaaaaatctgagtaaataccataaggttcagattacataaatatgaagatcaaaactgcaagttttctgagaagttagttattattgttttttactaatatgagctgcattggaaatttattttctttttaaaaaattattgctgtctttgtccataacttttatggacctgacattttagttgtttggaaaaattggtaattttaatcttttgttttggtatgattcaggttgacctgacattttaatacatctggctcctaggactgattaaagagacattttatttgttgaaatatgcacattttcttcatgaaattggttttcttttttatgtgtgacttttcttgcaaaagcttacaaggcacatgcttttgatagcagtgttacatttttaattaatattttagatgtaaaaggtgacagtttaaaagattgttttattagtgggttatccttaaaagcaagtggcatttggttttattttacaatagagtttaatcttacatgttttttgttaaagtaatgttaccaaaaaatctcttattgaactatttgtggtgaactttttaaggatgtttaagatttcacatgcagtttaactgatcacagatgaagttgtaaattaatacctcatgagcgtatttgactgcagggcattgttgtgaatcaaaaccgctttgttcctgtaaactgtgaaaggggtttaagcatatggattaaaattgcatggtgataccgaagtacttatgaaaagacactgtagttggatcatttaaaatgtactaaaatattacgaatagccataaaatataataattccctgaagcttttaagagtggtaagatttagttttatttctttgttggatttaactactttaataagaaattgttttgttgcttttggaactatgcatagtaatgagaataaccatgatgatgagaacactggaagcttcccagaaaacatgtatttcttcagaaatgttcttggttgtgacaaatatatatatgaagcttttccttgttcccatctgagtcattcccttaccagaacctttagaatgaaaggtttaatgatatcttctagtataagattatgaaatgagcattgtttagtgtaaaatcatatttttcttttgctgttaattttgtcttatagtatatgaaaatcacctggtgtagaatgtatttttcctgccataagaaactgtcaagaatctattgaaaaaataccatgagagtagttgttctggatgacaatggtaggttctgatttactgacgtagaagcaagcttcagttagccactttagtcataggtaaacactagattagcctaaggaaaaattgttgggaagcttttggagttctcatctgtgtcactgttttagatctcttcaagttctttgaaaattttggtacctccctgtttaacaaatattctgttttctgctatctaattagttctcatgtagatgacgtttctaatactaattaccacactttcttggactcctcttttataacgacctttatctccattccatttgatcaactgttttttaggactatgttctgaacctacttcctacccaggactgctttaaaaaaagtaatctatgttagcttcctgtttggcttcttcctagtttgactttactctctatatacagcctgagtggcatgctcggttatttcagctacatcttaccattactcagttctctctcccttttgaccttgctggtttctaaatctgggtcaatttgtgtgccttgcttcttgacttgatattacaattaacttattttgtcatactagatgttttcagccatctttgatccccaggttgctcaccaactcttattatcctttgaaatgactctcaaatcttacccctctttttgacttttatgtttgttgccctcatcttcatcttttttttttttttaatgagacggagtttcgctcttgttttctttctttcttttttttttttttttgagacagagtctcgctcttgcccaggctggagtgcagtggcgccatctctgctcactgcaagatccgcctcctgagttcacgccattctcctgcctcagcctcctgagtagctgggactacaggtgcccgccaccacgcctggctaattttttgtatttttagtagagatggggtttcaccgtgttagcctggatagtcttgatctcctgaccttgtgatccgcctgcctaggcctcccaaagtgctgggattacaggcatgagccactgcgcccagctcgctcttgttttcttgttgcccaggctggagtgcaatggtttgatcttggctcactgcaacctccgcctcctgcgttcaagagattctcctgcttcagccttctgagtagttggcattacaggcgtgtgccaccatgcccggctaattttttgtatttttagtagagacagggtttctccatgttggccaggctggtctcgaactcccgaactcaggtgatccgccagtcttggcctcccaaagtgctaggattacaggcatgagccaccacgcctggcaaattctattttttttttttttttttgagacggaattttgctcttgctgcctaggctgtgcaatggcacgatctcggctcaccgtggcctctccctcccaggttcaagtgagtctcctgcctcagcctcccaagtagctgggattacagacgtgtgtcaccatgcccggctaattttgtatttttagtagagacggggtttctccacgttggtcaggctggcctggaactcccaacctcagatgatctgtctgcttcggcctcgccaagtgctgggattacaggcgtgagccactgctcccagcccttcatctcttacattaggtgccatagcactcacctctgtggctctgtttcttctatcccaacagcacatgagggattgggtccccttccatctctccaactccctactcctactaccacataaattaacagaaactccctttagtagtaattctcaaatgaggtgccaaatcttggtctgtatggaatgtgtatttggttttaaaaaaattctaaaagtgattctcttctgaggtcctaaagggtcttttgcaggacttcctcaaattcgtcttttacaatgctataggagtcatctttgtcaaacatagatttactcattttacaactgtgtaacaacttattttttgccaagtattgggatagctactggagttagtaaagtgaatattagggtgcttacttttgagaaaaatgctaataatatagtatagccatcatttactggaacttttttaagtgctaggcacttcatgtatttatccttataatagtccttcagtgtagatattattagccactgtacagatgagcagccattctcagaattctgaggactcacatagtaattcattaggcaagtgataagctttatgataaatacttgaaagggacctctaagagcatagaggagggatatctagtttagagttggaagattaacagaataggcttcacagagaagatgatgtattaagctgagtatttaaagacaagtaggaacttagacaaaatgatagattggaaaatgagtgtgtggcatggttatatttgtgaatagtctttgtacagagatataagagaagcattttatgagaacacctggtgctcacttaggcaacacatatactaaagttggagaacagctcaatatgactgaagcatagtatgtgagatggggaatttagagtggtttagatataaagacattaaactaggttgtattttatatatttatacatctatatctatatatctatatctatatgcatctgtggtcccagctactaaggaggctgaggtgggaggatcgcctgagcctgggagatcaaggctccactgagccgagattgcaccattgcactccagcctgggtgacagagtgagaccctgtctcaaacaaaacaaaacaaaacaaaaacccagttagactgctggaatagtccaaataagaaatcaggaggccttgaaacgtgtcagtgggattaaagaggagagaggtggaattgaaggttatctggtaggtgcaatcaacagacttagtggtttaaaaagtgagtgagaggttatagtcaggttgggactatgtattaatcctttatttttttaatttactgtactgtactatgtattattgttaatatcctttatttcagattgacatatacccttaaatattcttaagatcatatccttaaggtcttaatagtctctgaataaatattggtataagctgcttcctaaatgatttcccatttatttactggtgtttttatatatctatttagagactgaatctcactatgttgcccaggctagagtgcaggagcatgatcatagcttactgtaacctcacactcttgggttcaagtgattctcctgcctcagcttcccaagcagctaggactacaagtgtgtgccaccacacctggctcattttttaatttttgcagaaacagactcttgctatgttgctcagactggtctcaaactcctggcctaaagcgatccttcagtccctgcctcccaaagcagtgggactgcaggtgcgagtcaccatggctggcttgaggagtgttttttaaaacatcctggccaactgtgagcattgagacatcaatttatcaaggctttactgagtgctcaagggcccaggcacattctaagtcctggaagagggagcacagtggaagttctaggacttagctatctagttaaatatcttcagtttaaacagatttactcattttacaactgtgtaacaatttattttttggcagtttctgaacttccagttttcacgttctctagtattgacaacaagctgataatcttgctagacacaacagactcttgaggaaggaattattcattgtggtttatagacaatgatatttgaagttaacttgccccagggcaggagtatggttcttatataatgtaggaaaaggccagtcaacaccagacctcagagctaccatttaatgcattgtggcaaatgattcgcatgtattatcacacttaatgctcacaagaatactaccatgaaatagttaatatttaaaacaaatttttttattttttaaggagactgggtctcactatgttgcccaggcttgtctcgaacccctgggctcaagtgatcctcccacctcagcctcttaaagttctgggattacaagcatgagccaccgcgagtggtctttatcattattatcgctgttttacagatgagaaaactgaggcacagagacctgcttatggtgacacaagtaggaattgaaaagatgagatttgaatctagctggtctaatttatcctgaagttcaagatagcaatacaagaattatgaacatataaatggagtgagtggatatgatcgctcaagataaatctcttggccgggcgcagtggctcacacctgtaatcccagcactttgggagactgaggcgggcagatcacgtggtcaggagatcaagaccatcctggctaacatggtgaaaccccctgtctactaaaaatacaaaaaattagtggggcgtggtggtgcacgcctgtaatcccagctactcaggaggctgaggcacgagaatcacttgaacccaggaggcggaggttgcagtgagccaagattgcgccactgcactccagcctgggtgatagagtgagactccgtctcaaaaaaaaaaaaaaatctcttggatgagaaaactagacttaggatttaaggaaatctacgttaatggactggccagaaaaacaagtcataaaggaaaattaggaagtaatcatgagagagggggatgttatgtcctattacctgaagcagaaatataaatggaaaacatatcagtgttattaactgaagggaaaagaaaatataaaaatatatctgttataaaatatattctgtataaaactcgaataccagattgttgtttgcattgacgttgcctgtaatcccagcattttgggagggtgaggtgggagagctcaggagttcaagaccagcctgggcaacatgatgaaactccatctctacaaaaaattagctgggcatggtggtacatgcttgtaatcccagctactcaggaagctatagtgggaggatcacttgagcccgggaggttgaggctgcagtgagccataatggtgccactacactcctgcctggggcgatgtactgagaccctgtctcaaaaaaaaaaaaaaaaaaagagaaaaaaaaatttttaagtacttttttacttagaacctttcaaatgccatgttatgtgtctttatatacagaaaccctgggcaaagacagtatggctctttttttaagaattaggagacatgagtgtaaagcatatttgtaaataacgggcaataaaattaatgcggaaggtttggcttacattatttggggagggaacatataaaattcaatattcaaattgttacatcaacttgaagtacagtgaatcatgactcagaaaatgtatgaagatgagacaaggtagttgcctattggaatcttaaatgatacttttagtagagatcatgtaaatctgtgttgatgttaaagaaaagtgaacataggctgagcgcagtggctcatgcctgtaatcccagcacttcgggaggctgaggcaggcggatcagctgagatcaggagttcgagaccagcctggccaacatagcgaaaccccatctctaccaaaaatacaaaaattagccaggcgtggtggcgggcacctataatcccagctactctggaggctgaggcaggagaatagcttgaacccgggaggtggagattgtagtgagccgagatcacaccactgcactccagcctgggtgacaagagcgagactccatctcaaaaagaaaagtgaacataaacttttaaaacttcattacagagtaaaaagtcttattacgtttttctggccaaaatttataaacttttaaaatatttcagtgaagttgagctatattagaggtatctctttatgtacctctggaatggaactttgataactgtttattacagtagaaaataggatctaaaatgggtaagttcattatttcactttgctttcttaatattcatggaaggtattttgccgaaattatttttggagagtatatgaaaagtaagtaatattttataaaactgtattgcagctgatttggagaatgagtggctactttgaaaattgtcagtagataggaaataaaaataacagaatgaagcagctcacacacttcagagtttattctcaatattgttgaattgggccataatgaagcataatgcctggttaaactttattgcaattcaaacatcccaccagaaagaaatttttaaaaactatatcaacaaataaattcactgaagtctgtctatagcttcttctaggaactacaatttatttatttgtttattttaatattgttttttgtagagacaaggtctcactttgttgcccaggctggtcttgaactcctgggctcaagtgatcagcccgcctctgaaagtgctgggattacaggcatgagccaccgtacctggctgaaggaactacatttttgatatggtactctgctttaaacgcagtaggtactctgctgaattgggctaaataaacatttcacctctcaaaactatgtgaatatttggcttaagcaaagatagcctgggaccatgaagaaagctaaaacacttaaaaaaaatgtacccttatttaaaaagtagcatgtttctttctgatttggagtgttatgtttttgttgaaaaattggaaattacataaaaccaaaatgaaaaatatagagatgatcagtaatttcaccatgaatataatactcctcttatcattttgtattcccttccaactaatttttctcttaaaagtggcactatgtttttgaaaaagctgactactttaagaaaatttctctcagtttactttcttaatcgtgtgcttttctgaagagttggctctgacgttgactactatagtaaatccaattttgatgagtttttcttttttagtgggccaaaaaaaaaaaaaggaaagaaaattctcctttgtagaaaaaggagggaggatggaatgtatattgtagtacacctgaaaatccataccttttcttagccatatacacaattagtttactctttctcaagataatatttttatagtaaattaggattctttgttacaagtgatgggaaaccaaactagtgctatgctaggttaaaaaaaggaatttagggactcaagtcactaaactactcacgcgcacacacacacacacacacacactcacacacactcacataggggttcaattgggccttaggaatggctaaatctaaggtctcaaaagctgtcagtttttttccttcggttcgttctttgtctctgagagttagcttcactttgtcagcctgcttctttatactcttcctgtttttcactctgacttactgtgtttataattatcttgggttagtttttcttattgctcatttggaaaaactatcagtacttctgattagtaatttcagatgtttttatattttaattttgtatgcaaaataagtatccgtgatattttaaaaatatttactaagtatttccctagtctttctctaaagggtaatctcaaatgaaacaactggaactggattctcatttgtttaatgactgaagaagtcttccaattactctacaaaccattgataacttttgttatttgtgaccagtattcatctagtaagatgttaaatgcttttatgaaagagacaagtgttttacctaaagaatgagaaaaaaaaaaccctaattttttgtgaagttttctccttttttgctgagtgcttaaagaaaaaaagtttatgttgttttaggtttttcttcttgcttatcaccctaggaactaattgtgttactttttaaatgtttaaatttaatttttcctgtcccttccccatgcttgctaattatgttttttaaaggtgaccctttaagatggctcttatagaataaagagagacactgaattttctaatcttgtggaagaggttatatttagccattggtattttaagttggagcacttcattctactgtgcctttagtttatgagtcatctggagaaaatgggctgcttcttgcttttaggaagagtctgtagcaaataataataataagtgctatgggagattttttgccaaataatttaaaatggaaaatgttttgtaatatattttattgcccatatgtaaaatacgtactaaagaatataggagtttttggctcattattatctttagctcataaaaataaacaaaagaggctgggtgcggtggctcacgcctgtaatccagcactttgggaggctgaggtgggcggatcacgaggtcaggaaatcaagaccatcctggctaacacggtgaaaccctgtctctaataaaaaatacaaaaaattagccgggtgtggtggcaggcacctgtagtcccagctactcgggaggctgaggcaggagaatggcgtgaacccaggaggtggagcttgcagtgagctgagaccgcaccattgcactccagcctgggtgacagagtgagactccgtctcaaaaacaacaacaacaacaacaacaataacaacaaaaccctaatgtcacatataacaaaaagaaagcattttctaccaaaacattatatagattgttatgagttataggtaagtggaaagcaagcataaaccatatgaaattattttatatgcaggatgtacagcagtggtcaaatcttaatgataattgtcagtaactggggagaatattgtgattattgaagtattgattttttttcaaatatttttatattacatgtggtaactttttataatcttgttttatatctactttagtatgatagctttaccatactagatattctatgaggggtagacagttggcaaaggatgtgatattgattctaattttggctacctttgtattatgtgtatcataatgatttcacgcttcagttttctcatctgtacagtattttgttcttcgtgacttttcttgcaggaatgaaaggaggtagcatggaacaaagaaaaaagtgtatcatattgtaaaacaggaaattttaaagtcctagagttcagattttaaatccaagatgtcatttttgaggtaaatttgtcaggtctccctgggacacagaatgactgcatcactagaatcatgagcccgtgggattgtttttttctttttctcaaatgtatttatttaacatctctctccctctctacttacctacctgcctacctacctacttacctctgttgtgaaacttttgggagctcagtattgtctactataccaagaataccagtcctttactcatttttttgcattacaaagatcatatggaatatactggaggggaatttaggtcttttggttctgtgttagaagagcccattttgtttttccctgcatgtggtagtcggtgtataggcctgtttctgtgatgggaagatgacaccttttgtcaaatctctatcctttttgtatgtcaaggaatcatttctttgcagtgaagtagagtgtgccctgtagtatagcactctgtgtccttagtcatagcaatattggaggattggagagttaatcatgtttgagaagttaggggacttgttctttcagcatctatttaatgaatctgcttgtatttttgatatcctaatgtgtcccaacactgaactcctaatctttcctctaaaacctgttccacctgcagccctctctatttcacttgatggcagttttatccttctcgttattcaggataaaaacctgagactcattcttgtttttcctctttctcttatatcccacatctaatccttaaggaaattatactggcaccacttgtgaaatatatcctgaaatctgatcacttataccatctaaatcgctaaagtcatctgtacccccacctctcttttgtgccaccatcatcctttgcctagatttttgcagtagcttcttagttactttctttccacctttgctgccttcaatatcttgtcagcacaacagattggcggacattttaaaaacgtaagtcagataatgacactctaataaaaatgagaaaggtttaaaaatagtaaagataggaagcctggacaacatggtgaaacaccatctctacaaaactagctgagtgtggtggtgcatgcttgtggtcagctactcaggaggctgaggcaggaagattgattgaacctggaaggttgaggctgcagtgagctgtgattgtatcacttcactccagcccccgtgactgattgaaaccctgtctcaaaaaaaaaaaaaaaaaaaaaaaaaaaaggaaatattatttgcaggtgaaatggttgtatttagaaacaagaacatttaagtggcaggtagttacagaattgatacacacaaatatattttttatacttttgtatgtttaaaaaagccacaaattacaaattatgttaacagcaatataaaaagaatgaaacatgagtggggtttattctaagctgagttgttcaaaattagggtatctattaacataatttacgatgcttctcagagggtttctgttgttcactcagtgactgcagacccactagtactaatgaactactctcttaacttgttattgaactacaccttctccaatgagtctgagtctttaacattgcatactcttttaatctgccttggggtactatatagagctttcttatatcttatagttactcttttattagagttaaaatacttctttatgttaaacttctgtttaccttactctgtgatttatatcttttgattagaaaagactaatgtaccatattagtaggtttttggataaatttttatattattttcatagatgctagaagagcatttgccaaaattcatcattgattcttttattaactttttgtgaattaaagtataacatacatagaaaggtataaaaatcataagtgtacagctgaaagaattactgcaaagtaaacatacttgcttaactaccatttagttctagaaatagaacttggccagcagcccagaagcacccctcacccccaccttcttccccaaaggtatcttctgtcctgacttctaacattggagattacctttgctgttttaaactttaaatatatggaatcatatagtgtgtactttttgtctctggcttctttggctcatcattataagctttatccacattgttgaacatagcagtgcttttgttcattttcttttccatgtcctattccatcatatgaatttatctcagtttatttttatattctactgttgatgatgaatatttgggttgttactagtttggccatattacaaataatgttggtatgtgaacattcttgggtgtgtcttttggtgctcatatgcacatatttcttttctttctttttttttttttttgagatgaagtcttgctcttgttgcccaggctggagtgcaatggcacagtctcggctcattgcaacctccacctcccgggttcaagtgattctcctatctcagcctcccaagtagctgggattacaggcacacgccaccatgcccagataatttttgtatttctggtagaaatggggtttcaccgtgttggccaggctagtcttgaactcctgacctcaggtgatctgcctgccttggcctcccaaagtactggaattataggtgtgagccaccacccctggcccaaagtgttatctttagaacagcagaaatgggagttccagtttttccactgttattttctatcttcagacaaacaactgtttagttatactggtaaactggcagtggtatatcattgtagttttaattgtatttccttgaccatgaccactaataaagttaagcttttaaaaatttatttatatgttgatcaattagatatacttctttgtgaattacttaagttttttacccagttttctattgggtgtttaagaatattttatatttatttatgtatttatttttgagacagggtcttgctccgttgctcaggctggagtgcagtgatgtgatctcggctcactgcagcctccgcctcctgggttcaagtgattctcccacctcagcctcctcagcagctaggactacaggcgtatgccatcatgcctggctgatttttgtattttttgatagagctggggtttcaccctgttggccatgctggtctcgaactcctgaactcaggtgatctgcgtgcctcagcctcccaaagttctggtattcatctgcaagccaccacgtccggcctgtttaagaatttttaatgaatttggctggatgtggtggctcacacccgtaatcccagcactttgggaggccaaagcgggcagatcacctgaggtcaggagttcgagaccagcctggccaacatggtgaaaccccgtttctactaaaaatacaaaaattagccgggcatggtggcacgtgcttgtaatcccagctgcttgggaggctgaggtgggagaatcacttgaacctgagaggcggaggtggcagtgagccaagatcactttattgcactccagactgggcgacaagagcaagactctgtctcaaaaaaaaaaaaaatttttttaaatgaaaaatctctgtactcagggctatgacactttttggttggcatatgtctttttggacttgttctttcattctttaaatggtgtctttgatgaaccgatgttcttcattttaatatggaccctctttttggtgttcctccctttttttagttttcagaagatattgtctatgattggttttacttctattggttttatttcttaaatgtttggtggaattcactggtgatacccttgaagcctggagttttctttgtaggaatgttccattaaaaaaaaaatacttaaagggctttttagattttttttcacttcttaaatcaactttggtaaaatttctttttctaagtatttgtacattttgtcttaagtgttaaaatgcgttagcataaccttttccctacagtatctttctgtgatttttaaatatgcatatgacctatcatttctgctaatgattatttgtgccttctttgtaagagttcatcaattttattagcgtttcaaagaactaactttggctttgttggttctctgtagatcatgatgtatgttttctatttccacgtatttagctccttttttttttttttttactttctttgggtttcatttgcagtttttttccttaccctaaccctacagttgtttttaaaaaaagattcttgagatggatacaggaccatataaaaaattttttttatgcatggcaagaagtttgcataaagtcagaagacaaattacaaacttgtaaaaaaattatttaataccaattacatcaaagtccaaggcctacttctttaatatgtagtgagtttctaaaagtcaataagaaggaaataattatgtattaaaaatgagcaatgtttgtgaagagttgatgtgtagaaaagttaatattaatggcagtaaaacatatgaaaggatgttcatcgtctcatgaggaattcaaaataaaccttctattattaaattggcaagtattttaaaaatcagtaataagtagtatgggcaaagttatagagaataggcgctttcataagctatcataaggatataaattgctacaacctctttgaaggagaagtttacattatttatcaaaattttaagtattcttttttttttttttctttttttttgagatggagtcttgctctgtcacccaggctggagtgcagtggcgccatcttggctcactgcaagccccgcctcccaggttcacaccattcgcctgcctcagcctccggagtagctgggactagaggctcccgtcaccacgctgggctaatttttttttgtatttttagtagagacggggtttctccgtgttagccaggatggtcttgatctcctgacctcattaaccgcccctctcggcctcccaaagtgctgggattacaggcgtgagtcatcgcgcccggcccttaagtattctttaattcacgaactatgtgtataaagatgtttatttccatattacctataaaagccaaaaaactagacataacctaaatgtttattctagagactaggttgtagctacccaatggaaaactatgtagccactaaaaggcaatagactgttggtactggttgttacagaacaagctccaggaaagtttttttgcagaaatacacattttattaaacgagtttgtgggtgaagtgtttgtattttgtgtgtgcatagtaagtttctgaagtgcataactttgtgtatctcactaggtaaatttgagtgttgtatttatggagttggatttacaacatctggtatttactattcagtatcactttaggttatgtttcgttttctcacttatattgtaagctcatagaaaatggaagatatggactgtgttttatgcttcataattttctccacattgcctagcatagtatattgagtgtgaaacagacttggtttttaaaaaacaatttaagaacaaatttaacactaaatatttgttttccagtttcagaacctgttcacattatctttggtgagctgtattgtagctctctgtagtagataggtataatactcattaatttattcatatgttaccatagggcgaactgagcccaagtgaataagtgagttatttaaagtaggggttggcaaactatgagctgtgggctaaatttgtcccacctcttgttctttatggcctagaagttaagaaaggtttttatatgttttaatgtttgggagaagaaagcatattttatgacacatgaatgttatatgaaatttaaattttagtgttcataattaaagtttattagaagacactgatgcatattcctttatgtattgtctatggctgccttcccaccactatggcagaattgagtcgttgcaacacagattggagttggcattttcattgcttcacactgctgcttggcatactacacatctcagtaatgcagttataattcaacagtgtttcaagtgccatatgtattgctgtgctataacactgtattttttttttattactagggcatacctatatgtcaaaacaagaaaaggagaaaatctcatggttttaaagcacagtggactggggattattttatccaattagatggtaaagcattaggtttattatgcccttctaaagaaatagaatatatattgccattaccaggctaagcacttacagtgttccaaattcataggaacataattctcataaaaattcaaaaatttgaaatgtaatatgttacaacagcagaatttttcatgcactcactttttctctcactcactctcacactgaaaaggaggctggacttaatataagattttgaatgacccatttgttagcaaagcaaggagagctatttactaatggtaagttagtaaattttcattgtagcagctaaagaatattttcagaaaaaaattacatttttaaaaatatcattagccatttggtgaccatagttgctttaagaattgaggacattaggctcgttgcagtggctcacacctgtaaccccagcattttgggagtctgaagcaagaggatcacatgagcccaggcgttcaagaccagcctgcgcaacatagtgagaccctatcttttcaaaaataaaaataaaaagagtattgaggattttaggccaggtgtggtggctcatgcctgtaatctcagcactttgagaggtgaaggtgggagaatccacttgagccctggagtttaaattcagcctggacaaatggcaagaccctatctctaccaaaaaaaccccccaaaaaaacaaaaacaaaaacaaaccagaattgaggacattagccaggcatggtggtgtgcacttgtagtcttagcttcttgggaggctgagatgggaggatccgtttgatcccaggagtttgagttcagcctggggagcatagcaagaccccatctctaaaataaaaacaaaaaagtgaattgaggacattgggtgtaacatcggtagtcagttaaagaagatagtggttttacttggctctgatgaaccaacagatgttactgacactgatcagttattcaaagagccaatgctgagtttgaagtgactgaaaaattagctttcatgaaaagtcgatgaaacatctgcagacgtgaatattttcaaaaaatttgagaaaacactaattcagcataatctgaagtagaatctgttaagatgtgttgctactgatagtagtaaaaatatatgtggaggccgggcacagtggctcaagcctgtaatcccagcactttgggaggctgaggtgggcagatcacttgaggtcaggagttcgagaccagcctggccaacatggtgaaaccccatctctacttaaaaaaaaaaaaaaaaattagcagcgtgtggtggcatatgcctgtaattccagctactttaggaggctgaggcaggagaactgctcgaacctgggaggtggaggatacagtgagctgagatgatgccattgcactccagcctgggtgacacagcaagactctgtctcaaaaaaaaaaaaagaaatatatatatatatataaaatatattaaaatacatatttatatcataaactttgtagatttctccacttaacctttttgctccatatatattttaaatatacattatacatatatatggatcagaaaaaagggttaattggagaaatctacaaagtttgtgaaactataaggttgtaaagcctatggctattcattgtattatttattagcagctattttgtagacaacatttgaatctatgatttattatttgaatatcatttattattgaaccagtattatcaacagtgaacttcatttgctgtatgaagagatagttctgtaagtttttatcagaaatttaagctgtatatttgacttgcctgaccacccatcagtttgattactgcagttgtttgagcttatggtcaagattcaaatttttctaaacaaggagaagctccttcaactactgttattgcatatgaaatggctttgaaaattagcttttactgaagactttatattgtttcttttctttcttcttcttcgtcttcttttttttttttttagaaacaggatcttgctatgttctccaggttggtcttgaactcctggactcatgtgatcctcctgcctcaagctcccaaagtgttgggattataggtgtgagccatcatgtccctggctaatacattatttcttaatgatactgatattgttgttgtttgtttctttctttctctctctctctctctccttgtttccttccttccttccttccttccttccttccttccttccttccttccttctttccttccttccttccttccttccttccttccttccttccttccttcctttctttctttcttctttgtctcttttctcttttctcaacagggtttcactctgtcacgcaggctggagtgcggtggtgctgtcttggctcactgcaacttccacctccctggttcaagcaattctcctacctcagcctcccaagtagctgggactacagcctcatgccaccatgcccagctaagctttttgtatttttagtagagacaggatttcaccatgttgaccagcctggtctcaaactcctaatgtcaagctatccactcactttggcttcccatagtgctgggattacaggtgtgagccactgtggcagcctttatatggtttcttaattttgaggcataccagtgcttatatgtaaaacttatactatggtaaagttatttgacagcagctaatgtagtttgaatcacaagtaatgtcaagctgctttatatacaatgtcccattctgtcaaaagttaaaacaagaagtgatacttctatttccacacacatttgtagcagatgtttgtgggctcaaactatagttttagcaatattgatgccagagcagagataacttctttatttcaaaatccatctaacactgcaatcacggagcttctaccttatgttacattagaagtgattaatctgcaatctacatgctaaaggggaaatatcaagaaaaagctctgatagaattctataaatgctttctaagtgataaatatgcttaatttaaatcatatgctattggatttatatcagtatttgggagtatctatttgtatatagagacattcaaagttgaaatatgtgaaattattatagatcaatgttaacagatgaatatttgcgatcaattttgattgataacagtaactttggccaggcacagtggctcacacctgtaatctcagcactttgggaggccgaggcaggtggatcatgaggtcaggagttcaagaccagtctggccaatatggttaatccccatctctactaaaaatacaaaaaattagctgggcgtggtggcgtgcgcctgtagtctcagcttctcgggaggctaagacaggagaaacgcttgaacccgggaggcggaggttgcggtgagcccagattgcaccactgcactccagcctgggtgacagaatgagactctgtctcaaaaaaaaaaaaaaaaaaaaagtaactttaaacaccaattaaatgaaatgttatttcccctaaaagaattacattcttctcattactaaacctgataaacaaaaaattttattgttattaatattcctaaatttgtcagtaaaagttttttgttttataagtacctagataatgtccttggtttttttctcattacccatagagcccaaactatttactacctggccttttacaaagaaagctttctgaccctcatcttcttctaaaagaataatagatgtctaattagaaaccagttatgcattgggttgagtatcctttattagcattttaaagttcttgcatttcgaaaatactaaaaatactcaaatttagaaaagttagttgtcttcataatgtaatttaaatgtttgaagtgttacaaaagagattcacctgcaattaaatatcagcagagtgtgtcctgtacccttatcctgcaacacttttctcctatagtaactgaatgactttggaattcagggctttgtatttttacctttttttaaagcttatttttgctttcttttcttttctgttttttttttgtttgtttgtttttttttttttttttttttttttttttttttttttgagatggagtcttgctctgtcgaccaggctggggtgcagtggcgtgatcttggctcgctgcaacccctacctcccgggttcaagcgattcttccacctcagcctcctgagtagttacaggtgggaccaccatgcctggctaattttttgtattttagtagagatggggtttcaccatgttccctgggctagtttcaaactcctgagctcaggcaatcagcccacctcagcctcccaaagtgctaggattataggcatgagccactgcccccagcctgtttttgctttcaaatggactgttgatggttttctcagagtgctttacttttgaagtccagtttgtactggaaagaatttatattccaggctgggcacagtggctcatgcctataatctcagcactttgggaggccaaggcagatggctcacttgagtccaggagttcaaaaccagccggagcaacttggcaaaacctcgtctcttaacaaaaatattttaaaatgagctggttatagtgctgcatgcctatggtcccagctacttgtggcactgaggtaggaggttggcttgagcctgggaggcggaagttgcagtgaacccaaatcgtgccactgcactccagcctccattacagagggagagcctgtctcaaaaaaaggaaacgaatttatattccacattttactgagtctagtgtgagtttttgtttaaaaaaaaacaacccaggaataatttcttcaaattcataagcatggcaggcagttttattttaaattctgtgggaaatatgaatttaaggatctcatgtaccatgccttgataatcatttctctgtaatgtatattttggcaaatgatattgttatgaaacatacttttgcattaatattaactttatgcataataaagatgcatcttcagttttttgtttgtcctatgagagtttacagctggggacatcttttacaaaagtatatttataacctgttcagaagatatgaaacacaataatgagataatcacctatgtatttttcagttagcagttacaaaaggattattgacacttatagttgttaatatctcagtaaaaacatactcttgtgcttattttaaaattgaacgctagtctatatttttaaagtttccttttatggaatattttgtcttttggcactttgcatctggattatagttcccccatttaagaaagaaacctgtttctattcaataggattaaaaacacactttcagttttagagcagatttatcatctacccttcaggctattctttaatatggagctcttaaaaatgagtatattaagatattccccagatgttttaaacttcagcaaacttgtggttttctttatttgtagtatttggaagatgaaagaaagtatctccagtatctaaacacttttcatattggttttaatgttgttttttttttttttttttttttttttgctagaaaggcatgcacaagataaagcttctacactgataaattttcaaagtccttgcttttaaaatatcaagctgggtgcagtggctaacgcctgtaatcccagcactttgggaggctgaggcgggtggatcacctgaagtcaggagttcgagaccagcctggccaacatagtgaaaacccgtctctactaaaaatataaaaaattagctgggtgtggtggctggtgcctgtaatctcagctattagggaggctgaggcaggagaatcgcttgaacccgggaggtggaggttgcagtgagctgagatcgcaccattgcactccagcctgggcaacaagagtgaaactcttgtctcaaaaaaaaaaaaaggtattgtcaaaatgagagttgtattagcagtaatgtaaaagtaatattgtatgtctgtatacttttgaatttacattgttatgtgattcatatttgttttgtatagctgtaacatttggttaattgtttagtgggttattgaatagattattttcttcattacttagtacagtggggattgagaatgctttgtatcaagtgtcttacaagtattgggaagttcgaattaaaaatattaaagatgtcagtcatttacttctttttttttttaaggtggtagcccaattgaaaattttctgcaaaatcagtaactaagttatttttccacaattataaacttagttgatggcatttattgagtgcttactacgttcaaggtaaatgaaatgaaagagtggaatagtgcattatacacgcacacactcaagggaagcaagtataaacaccttatttcatctcacttgtttagaaatttgattttgttttttcttgctgggtaacatatctgtgttaatcgaaaatttatgacttagagtggaatttctctaaaaagcagtaggtgacagggatacaagataaataatttcatcagagaatagaaattcttttttacaatggataaaattgtgcttgtaacagggatacaagcacaaaccaaatcaatgtttaattattttaaaaatattcaagggaaatctagttttgttaaaatttgtataggttggtagtgtgcatgttcttaaaaatccaagaacaatagcagcagcaattcttatttaatctttctttagtgtgtccattcaaccattcattcatcaatttttttttctgtgtacccattattcatcaggcactatgcttaaatatcgtggaacacaaaaagaaatagtctttaatgctgtgttttacaaatgaggaaacctaatctcggagaacttaaattacagttgtcctttggtattcatgggggattggttccgggaacttcctcagataccaaaatccaaggattctcaagtccctgatataaaattctgtggtatttgtatataacatatgcatatcctcccatgtactttaatttctagattacttataatacctaatataatgtaaatgctgtgtaagtagttgttatactctcttgtttagggaataatgtcaaggaaaaacactctttacatgttcagtacatatttttccaaatattttcaatctgtggttggttgaatccatggatgtggaacatacggatatggagggccagccgtacttgccccatgtcatataattagatgaatatagaattaaagccaggtccgtctgacagagcgtttgcttctaaccattgaggaatgttgcctaccctgatgactctactataggaaatcatatattgatatcaaattgatcttatatgtctgtagtgaggaacttggccatgttggacctatccccttccctccttgctcctctcctttcttcctcccttacccccacagcttcacccctcccttagctcttttttctgacaggtggctgtttccatccctgtttgctggcaccttctccacttaaattttggtatatcccttggttccactctctgtgttcttctcttgtgtatgagtgtggattttgtgtttgcttatcctgtgtggagtttctgagcttgaatctgttaagagtatgtcattaatcaaatttggaaatttttaagccatttttttttctttctttcctttccttttccttttttagaagcaggttcttgctttgtggttcaggctgcagtgcagtggcacaatctcagttcactacagcatcaaactcttggactgaagtgatcgtcctgcctcaacctcctgagtagctgggactacaggcatgcatcactatgcctggctatttttatttttttgtagaagtagggtctcactatgttgcccaggctggtttcaaactcgtgggttcaagcagtcctcctgctttggcctcccaaaatgctgagattatagttgtgagccaccatgcctggtcaagccattattttttcaatttttttttttctgcaccgcacttcttttcttctgttactcatgcacaaatttagatcttttagtattgtcctataggtctgagtcttttttcattttttaaaaaaatcctttttctgtcctgcagattggaaaatttttattgatttatttttaagtatactgattaacagtcttcttcattttactattaagcccatctagttagttttaaatttctagttattgaatttttaaattctaatatttttattttatcttctttatcttctgtttctttgctgagtcttttcactttttctagctgtctgaagagtcctagtagtttgtggttccctggagctctccgccttggtaatccagccagagaactggggctttattttctcagctctgcacatacttcctgtgactgtaaccatgtctgggtctaagtagtaggcagatactcttctcttgcttttttctttcttgtgttttagtcaaattattttacctcttattataactttgtttattattatttaccaacactttatatgcaaattgtagattattcagattgtatcttctaccagagtgttcactcttttctgtatgaggctgatacggagtgaggggagagcttattaccttaataaaaattaagggttaagctaggtcaaagttgatttttcagtgttgacagttcagttgagcctgtttgcttctgttcctagagcctgaacctctaggacttttaattgataccagtggtctccgctctgaaacagtccaccagaatgagggtaccaaactgacctcagaggtttccaggttaatgcagaggtttctagcttaatttctttctgccttcaaaatttggcaattatgtcaaaggggaaaatgatcttttgttttaggttttcagtttccaatgttactacttcagccttatgtaattgctaaaatccctactgttttccccctattgcccccttccttatcattatcttctgctaagcacaaagtgtgaattttcaggttccacatgtaaccagtataagtatatccttccccccaaaccccagtggaaatgtgccacggatccttatttttattctccactccttctagggctttcatttcttgcctattatgtttttagttgctcttttcttgttctgtctttgtaagcacagctagagtcagagaactttctgcttttggaactattttggttaacctctttaacttagcattcagtttcagaattcagcaaatgtgttttggggcaaactagctgtgtgttttaggtttgggaaatgtcaaattttgtttctctgtcttcatgcttctggctgcaaatgttggcaggtggaacaaaaagctgccagttctggcctgcccctgtgaacaggtctcacctctccggaaatttatccactttgtccttgttgcttcagagctctttggtaccattaacaatgtgacttatgatttatatggccttcctaggtgtcatcagtaggaatgttggctgtgatgcagtatatgctacccagaatcggaagttccatatattatgttttgataagagattttaggtgtttgagtatttctgatgagtgacattttttgaagtttgctagagagaaataattagctagttattgcttaactactctctctccatatctattacatatgtttctggaatatttctatggtcagagaaactcaggcccattataaaccatggactctggtagaaatagaagctgaaagcaaaccagtaagggaggtggagtgtataatttgtgttttggaagtacctgccggtggacttgggggtgatgctctaggtttaccatgagattactcatctaattttgagaaccactgtcctgcagtatttttcttttgcttacatatgactttttctttttatgatttaaaactaaatgtcaaccagttactatttaatgaaaatcataaattggtttagtgaaattttgttgtgttcttacaatgggtagaaacctaatgcacttatcatgcatctaaatttaggaataattcattttattttaatcatctatacttatatacaaaatgcttttcagcagtatatttgattatcttaggtacaatgatcttcatgttcagagttataaatgggaataattaaacctttaaacatattagagttgaataagggcttatctaagcaatacatgcttaaaattgctttcttatcaaaaaaataaaattggaggttcaagaagtgtctttaaattacaatccttatgaactaatagcttaaccttagttttgaataactgttactttttccgtcttttaaaaagatgcttaaaaataaacgcatgtcgaaaatgttattttggcttttagcaaactgacatttgagttttttaaaacctcactaaacatttgtggtaaaagatttcaaagctttgaattttacaatttgcctgtcgattccccccctgtgttattctattaacatttgatcttaataagtataacctgtttagaatgacttatgtttttaattatttgtttagatgagaagtttaaggaataacttcatcagaaattctacttggcagttatgaatgctttcttaaggaagttaaatttttggaatttcactgtaaagattttaatcacatgtcctattcttcatacatcaatctataaatgttcaaaaattgttaatgttgtttttatgctgtgctgatgttaacacaacgtgaggtcttctttcttctcctgataatatgctgagcgcacacacactctcatatgctcactcgctctctctctctctccttccctcccacccctgagtttgaaataagttagtggctttagtttctttgaaaatggaaagcaattgcccttaggtagaactggaaattgtaaagtgttggttttgtggacattttcctgttcataattcttgttatatcttatttataagtacttttattcatataggaataaatgattctatgttgaagggtataatcatgaagtcttttttattttttcgtgttagataaggagaaaaatgacacattaaaaattacagtgctatttgtgttttaaaatttcttctgtcgcttttgtattccttattgttctcttcactttttctattgtttttctagcttttcaggatacattttctaaatgcatcctaaatataacttacaatagttgccttttatttaaaagtaatacatttagtttccaaccacaaagtgtttaattctacatatttctatttttattttacatgatcttaatatatccttgattactgtgttgatcttctagtttttaggctgccacttataccatcaaaagccatttaaactggacttagaggataatgaatctaaattttcttatcttcctcaaaacaacagatacaattaaagtcacaaataagctgtaccttcagaattgctaggagacagaacatagtaagaattcaaatctcttataagcagagttataaacatcatattccaatattgattctgctgctttgtctgtacatttggagagcagaggtagcagggaggtttaagagactgaaaaaagggagaggggtgtatgaagtgtagatcagtaacaaacaccatcactcttgaaaagaaaaagtccaacagaggtcctagacctgtgttttagacaggtgggaggacagtaaattaatttttaaagacaaaataattatattgaatgaatttattgatcattttgttgaacagttagtataaggacatcccgtattatatttcagctttcataaactataagtgtttatgtcttatattttgtgttctttcaactttatcttaatttgcttctgttatttttaatgccatttttgtacatttgtttaatattactatattcatctttgttgtaattttttcctgtaataatgtaacataaataattataatattacaaagtttattaaatttcttccaatgataattaatatagtaggcttgtggtggaaaaatggatcaggtactgtccttccaattctgtcaggcttttgattgaggtgtttatatggccaccccgttcagacaaagaatgtcaaccaaaaggagaaagtaagaaggaatctataaattactaaaattcccatactttatttcctatggaaaaagtcatgtaaggaaaatatatagaagtttcccgtaaaatgtaataatatcataaactctttcatccttaaacacctgttagtcttgccacagcacaatcagttccctaaagataaatatttcttggtttgttagttggctacttaggagttccttttccttcttatgagttttcttctctcctgtatttcttttctaacaccatccaactggttatccaaactagcaacctcagaattttcatccctcttccacatcttacatttctttatcacatcctgtgtcttcaacttcggaatgattccttactttggtctcgtctctctatcctgtctttcgtatgagctattctaaaggcaggtggtctgcttctctttactctgtccagtgttatcatcatttttaaaaagtctgcttttcacactgttgctaaatagagtttaataatttctagtagccttcagaataatgtctacacttattagcctgatagttaccttttctttgtcagtttttactactttgattttgacctgcattttagtctgtgtttaactggtttttctgaatacgtcatgtttattgttttagcctcaaccctgaattttttttttctcccttaagtgtcaaatttcaattcagatgttaaactttccctgcctttttcattcagaatcacttctttctttgctcttgttttttattcagctttgttctatatatggttctttaaaaataattgtatggaaaattgctatgttcttttattataaaatgaagttgatttttcattacaaaacagtttatatgcttattgcacaatctaaacagatgtataaaagagccataattgttcctaatttggcgataactactgttaataccttggttgtattcttccaggttcttttcagtagacatgtatattgggtaattttgtttacacaaaaagattacattgtgcatcagttttcataaattagcacttctcatttgaaataacatggaaaatacctatcaatagatgtaaatctattttaaatctgtaacatttaaaaatgtttaacacttaagtagaagcaacacatacacatagtaaaactacatcaaggtggaaaattaaacgcttatttgaagacttctaattttgggaaattgactaattctgctattcttcaggatttctcaggccaaaattcagaacaaggctaaatttgcccatttccacctactattatttattctttctttatattatgctagagcttgtaggctctgtactaacacaagaaaggggaagaaaaaaattgtccttattcacaaatgataattatgtttaatttattaaaaacacataaatcattggagttaattaaatattagaaacttggctggaaaaaattgatataaagaatgtttctaaatatcagccacaaataaagattaaacaatatcataatagtattaaaacataggaagtatgaagtagtgatcagaataaaagatgtggaggctttgtggcaaacattatgaaactttgagagatactgtaatcatggattagatgatttaatattggaaatatatcacttttcccagcatagatatagataagtagtgcaatcactgttaaaatcctaacaagttgggctgggcatggtggctcacacctgtaataccagcactttgggagtccgaggcaggcagatcacgaggtcaagagatggagaccatcctggccaacatggtgaaaccccatctctactaaaaatagaaaaattagctgggcatggtgggatgcgcctgtagtcccagctacttgggaggctgaggcaggagaatcacttgaaccagggagtcagaggctgcagtgagccgagatcgcgccagtgcactccagcctggcaacagagcgagattctgtctcaaaaaaagaatcctaacaagttggtttttggagtttgacaactagttgtaaatttatatggagtgcaaaaaaccaagaacggccaaagcactcatgaagaacaacagggtaaggacacttgtagatagagtgtgtgtgtgtgtatgtatatatatgtgtgtatatatattatatatgagagatagttataagatactggggtttctaagtcagtccagtgtgttttttcttaacctgggtagtggttacacagacattcactttttttttttttttagaacagaaagtttctaagaatttatagcaccaagacattcattttttaaaaattgcacatttattttacttatcctagagaaatttataaaaaacaaaagtaaactataaacaccagttaaaaaaatccttttatattaactccatagagatgcaaatactgttaacagttaatgttttcaggggcctggctccatggcttgcacctgtaatcctagcactttgggaggctgaggtgggaggatcgcctgagctcaggagttcgagatctgctgggcaacatggtgaagcctgtctctaaaaaaaaaaaaaatacaaaaaaaattagccaagtgtggtggtgcatgcctgtattcccagctatttaggagactgaggcgggaggatcccttgagcccaggaggtggaggctgcattgagctatgtttgcaccactgcactccagcctggatgaaaaaggaagattctgtctccaaaaaaaaaaaaaaaaaaaaaaaaaagttaatgtttttagcttaccattataagtctaaataatgaatttgtgcttatttttaattaacaaacttatacaatgtctgtaaactctatactggaagatgaagaatgtagtgcacttacactgttttgcctttttattcttccttatatttgctttagtttgattttttattgattgactttatgacttcaacaatatatttaaaacctttttaaaaacttgatttttaacatttgagatatttatggagtcttctccatgaaagggagaattttgcatgcaatagtgtatgatgggcacttttaacttttttatggctttctttttcaaagtcatacaccactttacttttcttttaacctaattccatctttcttctgttttttttgggggggagaggttggaacatctccttagtaattttttccacataggaaaaaggattattaaatattactttgccttattaacctgataatttgagtacatattgaaaatttctagtttcaaaaatttcctcccttctcagcatagaatacattactccattatatttttagcatccggtattctttgagaagttaagtattagtctgatttttattccttttaaggtaattattatttttcacattatatgctttaaaggttttatcttaatatgagagattaaacaagatgtgtccaagtatggggtcctagtccctaatcccttgtaaaactgcttgatgtttggaaaaatctgaccatatttatgtttcaccttttttttttccaacatttctctcttactcttcataatctctattttccctttctgtatttcctgttaaacagatctcagaccacctaataaattctctacaccttttaatttttatttcatatttttaatttcttatattttctatctacttttttggtctttttaaaaatttcaacttttctatttttatcttagtttttacccatgcatattttgattgctcaggtaatccatccaactattgatttttcaaaaatttttcaataattgttagtgtacagaaactgtgtcattctctagctgcatcttttcatataattagataggtctgtttgtggcatctttctttccttgctttacaggcagtactgttatacttttgtttatttttatacataaaacatattttttgacgtttagtaagatgtggaagaggaaatgaacatatacttcatctcttttgaagtgtaaggtcttataattttcatacttcttgaactgattccaagggtaacattaagtgaaattttgtttagtttctatagaaaactctgttagttgtctggaatgaggagaaatacatgctgatttctgtatgtttgtagtaacaagtgattctgagactgggattctgattttgacttaaccagtttgccacgtgacctccatttggcaatctattaattattacttttactttctgtttagtttaatggccaattatggacagtctgttttaaattcttaaattcttatagttgtacacttatggaaaacatttcttaaatgtggaaatttagtatttttgttataagatatttcaattcatttattcaacatacttaaacaataaaaacattttactatttgtgttttaatactcttctgctcagaaaagtttactttgttgcaactcacagaaggtaacttacttttttctactgtgatttccttataggtttgatgaacttgtgaaaaaattcaaagtcgaatatcatgctggtggctctacccagaattcaattaaagtggctcaggttggttaattattttaaaagttaaaaggattcaaaatgattctagacccatgtctattttgcataattgtttccttttatattgtgttgctgtagaatagttttgttcatttgaattgggattttagtagtcattgcacatctaatcaaaagttattttaattggtatttctttggttattggtaagcttgaacttttaatgtttattgttcatttgtgtttcttcttaaattgtttcctttcactatcattttataatttttcatgttacagatttgtagaaacttcatattttatagatagtattcctttttattttataagttgaaagtatttattttttgttatgtgtacattaactcttacagtgtcttttactgtgccttagttcttaatgtaactttcaaagtttttaacgtaattaaactttatggcttcttcatttcctgcatgtcccccttacgaaggacgtttctgccacaagatagtagaaattgctctgtattatatatagatatctatatacataaatgtacattcatatattcatacctaaatatctatgtatagacatatatgttggtagatatgtatatgcatctatatatctataccggtgtatatcttttataaatctatatatctgtctctattcccatatcttccaatgagtaattgaataaacccattaggcatatactctttgagttaccagcttaacctaatcttgattgagagagttagtgatctgtttaatcttccagctttgaaagatatgaacaagttttacatacctctggttcttacctctgcagtttgaagttaactcaaaattctgctcattgcaatcatgtgtcagttctgcctacactagatttctttttcttttttattgattaatgctttccccttgaattctgattaacttcaagaactggggaagtggaaaattgacaaataaaatccagaatgatttcttttcaagtaactcttagttgattgagacatatagtatgattattccacatacttccaagctcagatttaatcatagttttcaaatattttgtaaaaatgaatctttaaggcggtcattaatatgaagtggcctgagtctttgtattggtcaattgatttgtattgtttttggtaaaacatcctggtggtcactttatgaacttccagagtaatagaaaaaggatgatttacggccaggcacggtggctcacgcctgtaatcccagcactttgggaagccgaggtggacggatcacttgaggtcaggagatccagatcagcctggccaacatggtgaaaccccgtctctcctaaaaaaatacaaaaattagccaggtgtggtggcatatgtctctaatcccagctacttgggaggctgaggccagagaatcggttgaacctgggcggtataggttgcagtgagctgagatcatgccactgcactccagcctgggcaacagagtgagactccatctcaaaaaaaaaaaagagagaaaaaaaggatgatttacttaagccttaatttatcaaggcacgttttgcattttgcagttttcagtcttttctcctgctagaactgggggtgatatggttaggctttgtgtccccacccaaatctaatcttgaattgtaatctgtataatccccacatgccaaggaagagaccaggtggaggtaattgagtcatgggtgcagtttccttcatgctattctcctgatagtgagtgagttctcacaagatctgatggctttataaggggctcttacccctttgctcggcatttcccattcttgctgccttgtaaagaagatgcctttcttctcctttgccttctgccatgattataagttttcagaggcctttccagacatgctgaactgtgagtcaactaaaacttttttctttataaattacccagtctcaggcagttctttacagtagtgtgaaaatgaactaataccgggaggctattagctgttcactaataaattgtctcctttcttggggatcttcatcagtttctgccttctaaaagtttattaattatataattaagttctccctcagctttctccctgatattagtctcataataaaacagtcattgcctacttttattcttttgcacttttttttttacaatatttcacattcattctaacaacgtattctagtagtggtttatttgttcctgtctttagcaaggtaataaaaggaatttgaagctttgggtaacttattctgtcagatcttactagtaatcatactttcatgtatcaagtgatatggcaaattatgtcaacaagaaaatgtccccaaagctcttaggtattttgatatgtcaaatcatgtttttgaagattttaatgaaaccataggcaacaaaaacaagtatggttgatatcttgtccaaacacaattctagatttatttgatacacagcacaaatgtaaattttggtaaatttcatttggtctgaacttcttcctaatgaaagtgaaaagttcttatctgctcaatatcctgcacagcatgtatataacactgctaaaaaggggtataacttgcttaagtttgataattgatgctttcttaatgaacacttttggttactttgtcagtttttaaaaaatttgtagaagcacttaatgtgagttttgacttgaaagaaatggaaaaacgttggcattgtgactcatgcctgtaatcccagcattttgagaggctaagttaggagaatcgcttgagtccagtagtttgagaccagcctggacaacatagtgagaccctgtctctaggaaaaaaaaaaaaaaaaagaaatggaagaaaatgacttccttggatatgtgcctaaaagatggctattattgttgctggacatagatgccctgcagtacaatattaacaaaatatgggaccaaaggaatgcccatctctgatttggcagtacattgagaatgagaatggaaaaagaagattatagtaaaacaaatatttttatgctgtttctggtttttttgtttgtttgtttgtttcaagacggagtctcactctgttgccaggctggagtgcagtggcgcgatctctgctcactgcaacctctgcctcccgggttcaagtgattcttttgcctcagcctcccaagtagctgggactataggtgtatgccacaaagcccagctaatttttgtatttttagtagagatggggtttcaccatgttggccaggatggtcttgatctcttgaccttgtgatccacccgcctcggcttcccaaagtgctgggattacaggcatgagccaccgtgcctggcctgtttctgtttttgaagaggccacaagtgggctagaaaaaacacataccaaaaaaatactcaaataattttatttgttcattatttattaatttttttgagacagaatctcttgctctgttgcctagactggaatgtagtggtgtgatcatagctcactccagccttgaactgctgcgctcacagggtcctccttcctccatctccacctccatctcctaggactacaggcacaccctaccatacctggctaatttatttgttgtagagacagggtctctgtgtgttgctcagattggtcttgaacttttggcctcaagtgattctcctgtgttggcctcccaaagtgcgaggattacaggtgcgaaccattttacctggctcaaatggctcatttttatatattaagagtgcttcagaactcaagtaaaaaagtcacagaaaagagcaatgaggttaaataaaactttttttcagtttctttactaaaactgtaacttacttggaatccagttttgacatcagaaattcaaattcaggtgttttaaaaccatttctgcaagaaagaaatttaagttaggatgatagccaatgtctttcagagtgttttaaagtgatggacattttgaacattgataagcctatataatgaatctgtaaacacaagggatatgattcataaagagctggaatgccaaaacctgcatttagctaaaagatagatggatatttttatagaactataaactaattcctatatctaaacacctattattgatagtaattaaaatcctaagtattctatgtttacatgcttttgttgagaggatatttagcttaatgtcattgcactggactgacatcaagaatgtgggcttgatgcatcagaggtataagtcacagtgaattttacctttgactgtattacgttttaccacacatacaagaaggattgacctaatggctctagtcaagtatagaaaggaaacataaaagtaaaaatattttattatttcttaggcaaaaagaagcatgcctttattctttttaattaaatattggtaaaatgtttaatccaactgtggttacgttatttttttaaaaagtgtgatagaaataaacaacagaataatatatgattttgaataagttcaatattagtttgctagggcagtcttagcaatttcagagactaggtggcttaaacaacaaagatttattttctcacagtgttggagtcccagatcaaagtgttgacaccttgattccttcagaggcctcgcttcttagcctgcagatggctaccctctttctgcctctttgcgtggtggtttctgtgtacatatgtacctctggagtgtctctgtgtgtcctaatgtcttcttataaggacaccagtcagattggattaaggcctaccttactgccctcattaatttaattaccttgttaaagaccctatcttcaaatgtagtcacattgtgagatactggggtttagggcttcaacatatgcatagtggcaggagggtctgtggaggggtgtttataattcagccgataacaactatgtgtttttaaatttttgtgtctaagtaataaaacatgaataagttaatttttggtagtgttcttttttgataccttcttccttttctttcctgtatatgttttagttacttttattatttaccatttgaattacaatgaacattctaaactcataacaacctaatttgaataataccaatgtagtttcaataatatacaaacactctgctcctttacatctccatcctcttcttatatattattacgctcattgattacgtctttatatattgcatgcccattaacatagatttgtaactattcttttattcatttgtcttttaaatcatataaaaataaaaggaattacaaaccaaaagttcagtgatagtggcatttatatttactatgtagctacttttaccagagttctttacttcttcatatggcttctggttactatcaaatgtcctttcatttcagcctgaaggactctctttagcattttgtgtagggcaggtctattgttaacaaactgtcttagcttgtgtttatctgggaatgtcttaaatagcccctttattataggatagttttgttggatatagaattcttggttaacggtgcttttcttttagtatgttaaatatgtcaactcactgctttttggcctacatggtttctgatgagaattagttcttattcttactgagaatcctgacttgtgaccagttgcttttctctcactgatttcaaaattctttccttgtctttgtctttcagcagtttgactataatgtgtcttggtgtgaatctttttgtgtttatcatgtttagagcttattaaattcatgcttcaagttcatgcttggatgtgtagattcattcattttatgaaagtcaggaagttttggaccattatatcttcaaaaatttttttcttttattttctctttgttttccttctggcattctcataattaatatgttggtctgtggtgattgtttagtgataaggattctgattaaataagatagaaaaaaacaccatggtgagtaagcaaagcagaaatagaaccccactgttttaactagtaacctcagcttgctttttttaccggagatttttctctcatcctgagaaaacttcaatttttacttctctaaatgttagagattttgagtagtgtttcacatgctttcttcacttcttactgtcttcttcaatttgggagtaattgtaggttgtcagagagagtgtcgaatatgcatcactttaaatacagttatcagtaaatggactctttcattcatgcttcccagagatgacagttttccttggtgcctagatacctttttgttccttggagattcatagtattatgtgactcattgaatttttcagaagcctgatggtgagcttcgtgaggtatttctatttaagttgtaagttcgcttgtttttaagcttcctgcaatttaacttacctatagtatttttaaatttattttaaaaatgccatcttggggtatattctaggcatctcaaaaattttaaataccatcttatcctttgttaactggaatataagcaggtaatcatttgaatcattttttttcctgtaattattataacattgaggctatatggatttttttttctttttttaatttgaggcagagtcttgctctgtcacccaggctggagtgcagtggtgcgatcacagctcactgcatccttgacctcctgggctcaaggaattctcctgcctcagcctcctgagtagttgggactataggtgcacaccaccacacccaccttatttttaacttttttgtagagattgggttttgccatattaaccgggctggtcttgaactcctgggctcaaatgatcctcaagacattagcttggtctcttctcaaattagcagatccttatttctgtcttataatttctaatctgcttttataattattgacttacattcaatcttccagtttttcatgtctcttccaattagataagcctccatatttgtatttaacttccagtaaaattttaaccatgttgtttcatttttaattaaaatttaagaggactgcctaaatgccagtgtgtttatgttgtatacatctcggggcatgcttttaagtgttttcttgatgtaaaacatcacataataaactagtgttcataattgtattttaaagctttccaaaattctatgtaaaatgagtttctaaaaacactaaacaaaagaagttttaggaattatgtttgaatgaaatagaaacattgaactcaaaattgtaaagctgatatttcaagaactaccaattagtgtaacattactaattgagttacagtatttagaagttaaaactgatgtaaatcaaaggactcatgttgtttatctattttgaatccttttttgaaaaaagttaatctttaaagtttttctgtattaaaaaaatctgattatctcttgtgacctattttacctagaaaagctagttagaggttaaaaggttttttatgagacatacttctgtgcatcggaacagtccagatgtaaatttaaaaagaagaaatgacaatgaagtgatcaaagagaattctgtgttcaaatgctttcacctggagcagttgtagaaatgtcagtagcacaactgtatttataattatagcaggatgtggcagatggtgatgcaacaccgtctcgtcaattctttgtgtcattgaagaaagtagtaagtattaattctgccaattttatgattaatgaataattttaagtaacacaggccctacgaataaggttgactgttcaaattgtgatacctcattatagtttttaaagtttaaatatgaattaatactcctctttgcctttctgttctctttccttttcaaattaggttgttaagttttcatagctaaaataagatgaaggaagcagtggcttgctgtcctcaattatatttttgatgtgtttgtgaaattattataacttagatcagattctttaaagaaaaatcagtatttcattttttcctttcctcccttttctccctctctcctttccttgtctctctcctttcctttctctctcttcttccctttacccctcctctccccttcccttctttctcctcctcctcccttcctcacatctctttcccttctcctcctacccttcctcttccctcccctcttcttcctttcttcctactttgttttatgcattatgttaagaaattgttttactgctattagtgataacatgcttttagttctgtcttagcagttatggttgtgctctccaggataaatctacacatatcacagttatccacttcataaaagaatgacatatctctactcttgtgggccttaatgtcatgcagtgtttctgggtatgacattaaacatgggtacaatttgaaattgtatttttctgtctaaaagcaaaacaaagcttcatcaagaaatactacaagcagtgggacctaatttcatcaaggggataaaactctattcctttttattctattttggaattggaattcagaaacatttttttttggtcctatggatggtatattcacttatttgaaatgaaaattgaactcagacttttctgaaagagtctcatttgttaattggttgacaaggatggtctttgccatttaaatgatacagtggtactgtcagctgtcattgttcttgaaagcaaagaaaatatttaattgtattgattttctgacttacgttcgaattaatacacatttccttcttctttaagcaactttattggaatatagttcacgtacaattcacctgtttaaaatgtataatcttgtggcttttagtgtgttcacagatctagctagctgtgcaaccatcaccacagtcagtttcacaatattttcttttcttttcttttttttttttttgagatggagtctcgcactgtcgtccaggctggagtgcagtggcgcgatcttggctcactgtaatctccacctcccggggtcacaccattctcctgcctcagcctcccgagtagctgggactacaggcacccgccactgcacccggctaattttttgcatttttagtagagacgaggtttcaccgtgttagccaggatggtctctatctcctgaccttgtgatccgcccgccttggcctcccaaagtgctgggattacaggtgtgagccaccgctcccggccccacaatattttcattatcaaatgaagaaactctataaccattagtagtcattccccatttctctctcaccccctcatcttctgtccattcaaccccttggccccagacagtcacttatccagttttgtttctataggtttgcctattctagacaattatttttatttttggagatggcatcttgctctgtcttcgaggctggagtgcagtggcacaatcatggctcactgcagcttccaactcctaggcacaagtgatcctcccacctctgcctcccgagtagctgggtctataggtatgtgccaccatgctcagctaatttttaacttttaaattttctgtggaaatggaatcttgctttgttgcacaggctgatgttgaattcctgacctcaagcaaccctcctgcctctgcctcccaaagtgctgggattacagttgtgagccactgtgcacagcctttcaccaattgtcaaaaacttattcatgtatgtgattgtagattctttgaccaacatctctccatccttctacccctctaattacccaagcctctgataaacaccattttactttctccttctatgagatcagctttgttatagttcacatatgagttgagattatgtagcatttgtctttttgtacctggattatttctgttaacaagttattctccaggttcctccatgttatcacaaatgagaagattttgttccttttttttgtggatgaatagtattccattgtgtatatatatcgcattttatttattcattcattcattgcctgataaactcttaggttgattacatatcttggctgttgtgaataatgaagcagtaaatatggacgtgcagatatatcttaatcatttccactgaatatgtacccagaagtgggattgctggatcacatgttgtaccgttaatttcttaaggaacctccatacctgttttccataatggctgtgctagtttacattcccatcagcagtgtacagggttcccttaatatttcgggtactatagccttttgtaatatattttgaagtcagatagcatgatgtgtctttgtcatttttgctcaagattgcttttgctatttgggatcttttgtggttctatatgaattttagaattttttttctatttctatgaagattatcattgtcatttgagagggtttactttgaatctgtagatcactttggatagtatgggcattttaatgatattctttaattacatgaatgcaggctgtcttttatttgtgtcttctttaatttctttcatcagcgttttatacttttcatcttagagatcttttatctccttggttgaatttatcactaggtattttagctatttttatagctattttaagaggaattgtttacttgatttttgtttttttcagatagtttgtggttgatatatagaaatgcttttgtatgtttattttgtgtcctacaactttactgaatgtgattattagttctgacagtattttggtacattctttagggttttctgtgtatgagatcttgttgtcttcaaacaagaacaatttaatttctacctttccaatttgtatgccttttatttctttctcttgcctaattgttctggctgggtcttctagactatgatgaatagaaatggtgaaagtatacatccttgtcttgttccagatttcagaggaaaagctttcaatttttccccattcagaataatagctttggatttttcatatatggcctttattgtgctgagctgcattccttctatacccaatttgttgataatttctaacatgaaagaatgttgaattttgtcaaatgcattttctgcatctattgaaatatggttttttcctgcatttaatgtgatatatcacagttattgatttgtgtatgttgaaccattcatatatccatgggatgaatccacttgatcctggtgaattatcttgttaatgtgctggcttttttttttcttttttaagacagagtctctctctgtcacccaggctgaggtgcagaggtgctctacctcctggattcaagtgattcttccgcctcagcctccctagtagctgggattacaggcaccaaccaccatgcctggctaatttttgtatttttagtagagaggggtttcaccatgttggccagggtggtcttgaactcctgacttcaagttatttacttggcctcccaaaattaatgtgctattgaatttggtttgctggtattttgttcaggatttttcttctatgttcatcggagacattggcctatagttttcttatttttgttgtgtccttgttaggttttggtatcagggtaatgctgattttgtagaatgagtttagaagaattctttcctctttattttttaaaaataatttgagaagaattcgtattagtttcgctttgaatatttggtagggtgtgttggcttacgccagtaccccagcactttgggaggctgaggcagaacttcaagaggccaggaatttgaggtcaacctggacaacatagtgagaccttgtttctacaaaaaaaaaaaaaaaaaattagcttggtgtggtggtacacacctgtagtctgagctacttgggaggcctcttgggaggctgaggcaggaggattgcttgagcttaggaggtggaggctgcagtgaactatgatcatgccactgtactccagcctgggcaacagagcaagaccctgtctctttaaaaaaacagaacaaaaattttggtaaaatacagcagtgaagccatcaggtcctaggcattttttcttttttctttgatgggagactttttatcactgatttaatctctttacttattggtctgttctaattttctatatcttcgtaattaaattttggtagattatatatattcagaaacttatttcttctaggttttctagtttgttggtgtataattgttaatgagagtctcttataattctttatatttctctgggatcaattgtagtgtctccttttttgtttctcactttattatttgtgtcttctcctttttttcttagtctagctaaaggtttgttgcttttggctatcttttcaaaaacctaattctttgttgtatttatcttttgtatgttttttaggtctctatttcatttatttcttctctttattatttatttttttctgctaatttggagtttggcttgttcttgtttttctagtcccttgaggcgcaacattaggtttatatctttcctctttggggatttatgtgttaattactataaacatcacttttagacctgcttttgctgtatctgataggttatgctttttttccattggcattgtttcaaaaaatctttttgtttctctttaattttttcattgaccatgttgtttaatttccatgtatttgtagagtttttgattttcctcttattattgacttctagtttatgccattgtgatcggaaaatataatctatgattttgaactgaaacttgttaagacttatgttgtggcttaatatgtactctatcctgaagcatgtttcatgttcaattgagaagaatgtgtaatcttcagccgctggatagaatgttctgtaaatgtctgttaggcctatttggtcaagagtgcagtttaaacctaatgtttcttttttggttttctgtctggataatgtttctgttgcttaagtggggtgctgaagtttcctactaggtagaggatcagaaaaaataaatattacatactcagcttagtatctgggtgatgaaataatctgtacaacaaacccccatgacacaacctgtacatgtaacaaacctgcacatgtaccgctgaacctaaaataaaagttaaaaaaaaaagttgtctactatgattgttttgtactctatctttccctttagatttattgatatttgcttatatcaggttattttaatctagtaacaacttaactttgattgctaaaaatgtttaataaacactgtgtactttaactcctctttttctctcacattttgaatttttttctgagatacagtctcactctgtcacccaggctggagtgcagtggtatgatctcagctcactgcaacctccacctcccgggttcaagcgattctcatgcctcagccacccaagtagctgggattacaggtgtgcaccaccttgctcaggcaatttttgtatttttagtagagacggggtttcaccatgttgcccaggctggtcttgaactcctgacctcaagtgatctgcctgcctcggcctcccgaagtgctgggattataagcatgagccaacttgtccagccacatattttgaatttttgatgttacaacttacaacttttaaaactgcatatcccactatcaattgttgtagttataattatttttaatagttttatctttaatcttcatattaaagatataagaggtttacatactatgcttacaataggccgaatagccacttcccactcattttttccaccatagaaaacttgcatccaggggacttctgcatatgtgggcttaggggaagggtgttgcagtcaaagcaccatttcccttactgtctgatatggtttggctctgtgtccccacccaaacctcatctctagttgtaatccccataatccccacatgttgagggagggatctggtgggaggtgattggatcatgggggtggtttcccccatgctgttctcatgatagtgagtaagttcttacaaatctgatggttttataagtgtttggcagttcctccttcactctctgtctttttctcctgccaccatgtgaagaaggtctttacttcccctttgcgttccagcgtgattgtaagttttccaaggcctccccagtcatacagaactgtgagtcagttaaacctcttttctttataaattactcagtcttggatatttctttatagcagcgtgaaaatggactaatacactgttctcagatttttctcagctctgtggtacaatgagacaccatcctgagttccaagagatccagggtagtcgtcttgccactgagaagatactaattgtgacaagttaatgggtgcagcacaccagcatggcacatgtatacatatgtaactaacctgcacattgtgtacatgtaccctagaacttaaagtataataataataaaataaaataaaaataaaataaaatctaatcttctgtgcaggcaaaaaaaaaaaaaaaaaaaaaaaagaaattctatagggtgtggagaaccagacaacaattcctacccttccattttgcaagcatcactctgccatattttttaaagaataatgtttttagagtatttgtgttctttggtacttttgctgctgagattcttgggataacaaagtaaaaaaccaaatagtctagattgtaacataccacagtgatttggggcaagaaggatgtgcagtagaattaagccaagctgggcaagtatgaacttgggactgtcaccaaactctgtctcattcttttctccttatttaattctttccatatcaagcatttacaacccactatgtagaggtccatacaccttggcttatagacttcacttggtagttactgttgcccacctatctattaaccagaattttcatttaaaaatctctacataaaaattagcagttatgcagtggagttttcaaataaggaagaagattggttggatggatggatgttaggtgaccactgggaaactatggttttagaacgagtagctggtaggttgcaggtggcatgtattttaatacatgtagcagaaaactgaaaatttatgagcattttagaaattagagctctgtcaaaataagagaaaaacttagatttaattttataaaagcagtactaatgactttatgaagatggcatatgatttatgtatgtatgaacaattatatgtatcattaaatagatcagataaattttttgttcttttaagaataataggccagatgtgatggctcacgcttataatcccagcactttgagaagccaaggccagaggatcagttgagctcaggagttcaagaccagcctgggcaacatgacaaaaccctgtctctacaaataataaaaaaaaaaaaattagccaggcacggtggtacatgcctgtcatcccagctagtcaggaagctgaggtgcaagaattgcttgagcctgggaggttgaagctgtagtgagccatgattctgccactgcattccagcctaggcaacagagctagaccctgtctcaaaaccaaataataattttttaaatatttattatctaatgtgggtttttgctttatgttacagttgtcacctactccaatatgaaaaatgagaagaaagccaggtgtggtggtgcatacctgtagtccctgctactcaggaggttgagatgggaagatcacttgaggccaggagtttgaggttgcagtatgctatgattgctcctgtgaatagccattttactctatcctgggaaacacagtggcatcctgtctcttaaaaaaaatttttttttaaagcatgttcacaagttctttaatacttctccattgaaaaggtagaacctaatttcccttctcttgaatatggcccagacttagcgacttgtttctaataagtagaatgtatgtaatgatggtgtgctatttctgaggctagatcattaaaggcatcattacttccatattattttttcttgggacacccataatggggaattcaactgctatgttcttgaggatacgcagtcagcctttgaagacacccacatgggcaggaacataagccttccagcggcaaccagcaccaatatgttggccttgtgagtgcagccagctccagtcaaatcaccagattactggagccctgccttacttaaccgactacaacctgatgagacaccccaagagagaactgttccactaagctgctcccaaattcctgacccaccaaaactatgtgagatagtatttcttatttatagccaccatgttttgaagcaacaatgactattaaaataataaaataactttcagacattgtttttaatccctcttttctgtagtccctgtactttcccaccccaatttatatttcctgtttctatttgaacttttttcttttttgttttcatttcttttatacataatcgttttgagctataagaataatttatgccaaaaattatgcagctaatattttacacccgtattgtaaccagtatactggtataaaactagataataaactactatggctgtgttttgcttcttacagatggaaggaaatgcctaaaatttaattttatataccacaatgtgttttgaaagttttgaataattttctggttttgaaaacctgttttgatttttttttctcacaaacacgatattcttaagtaaaatagagtgatttatgattaatagaaataatgaagattatgcaagttattttacttcaattgaaatagcaaggccagaataatttaatcatgttttccagaagaataataaaatagaatcagtggcaatactagtaaacattagtctacatttctatttatttatttatttttttagacggagttttgcctttttacccaggctggagtgcagtggcacgatctcagctcactgcaacttccgcctcctgggttcaagtgattctcctgcttcaggcctcccaagtagctggtattacaggcgcctgccaccacacccagctaattctttgtatttttaatagagacgggatttcatcatgttggcaaggttggtctcaaactcctgacttcaggtgatccacctgccttggcctcccaaagtgcagggattataggcgtgagccactgcacccagccaacatttatatttctttaacttcatatcatttgctgtagttagctggatcatatttcttaaattttactttatttatttatttttgagacaaagtcacgctttgtcacccaggctgaagctcagtgtttgcgatcttggctcactgcaaactctgccttctgggttcaaggaatcctcctgcttcagtctcctgagtagctgggattacaggcttctgccaccatgcccaacaaatttttttttgtattttttgtagagacagaatttcaccctgttgaccaggctggtattaaactcctgacctcaagtgatccacccacctaggcctcccaaagtgctgggattatggccatgggccactgtgcccagacaaattttactttcatagtaacattttgcaaatgtaaaaattttataatttgattagtaatgtcagactctatcaaggtgatgctctcttaaaagttgttgatgataatattagatgagagatgtatgtagttatgaaagaccctgaaatgattgtatttttttatttctgtacaaagtttactcacatttctatgtctagccatagctattctaagccatagcacaaagaactgtattgtgatggtgagactataaaaaggtaaatttagagaaagcttccagatctgctctagaatttattaccatctggtctctttggagactagtataattattcatgggaatgttttcaacacagaaaagcatggtttgtgtattggcagaaagtaaaaagtaccagtggtttaaaccatatgtagcttttttagagttaggcaagggaaatgaactgaagacctaattgagagtcatcagtagtgatgcaatttgtgtcaattttgtcagaatctgttcataatgaacaaaatattgcacaacaagaaaaactgaaggtattagaaatataactccatttgaagagtattactttatcttaatttaaccaatgaaatgtaagatggtgtcagctaagtatttgtgtaaatctctgaaataacataaggaatatatgtcaaattttgatgacttttaaaaatgaaaacactcatgttaaaataattttaagcttgaacactggaagaatgtcttattaaggttatttttcttaaattgaatatgaatgtattattttagatcattttagatgtggcatggacttactactgttcctcttaagaagcagaaatattttacagtctttcttaagcttaaattgattttatagaaaaaggaaaaaaaaactaaatatcttttcactttccattctaacagttacttggagtctataaaaaatgagatgacaaatcaaaaaattgaaatcgtctattttttcagctattttaaaagaaaaatgcctagtgggctgggaatacacaagaaatttaaatttgtgattgagaataagaaatgcatttgtggttttaaaaaagaaataccagcatgtcacattaaaaatatggcatctacagtattgtacaaaggaaaatgtattacattaggagggggtatgttgtactttatttagagaactagtgcagggatacgaatgagaagtataacgccatagaaggcatgagcattagtaatccagtcagagaggaagaattttgctgcctcccatgtaacataaaacagatgttccattctattagaaccttactaaaatgagagtttagatcattggtcaataggagaaacatgaacaatggcaatttaataattttgagggtttatcttatttgtgagttaatatccatggtggggagtatgaagggatgcctgccaaatgttattttatttttgatatcttgattgagagagctgaaaggcaacagtaagctatactaatttttaatttattgttttgcaaatttaatctatttttttctcaaaaactgttgtaagaaaaaaagatttcaaaattataagtcctgatttaatgcttgaataggtattgaagcatatctgaaagtataattaattaacctcaaatgaatactgtaaacattaagtagttggcaactgaaagtagacgtatgcagaaagggacaccagggatggtaccacagggtcctgggtatatttttgtttttttaagggaagatttacttttttctagaaaagaaattcttttcaaataaatttatttttcaaaaaatactttttttcaaaagtattttttccattttaaaattaagttataatttatatacaaaaaagtgatctttgtagtgtatgtttctgcaagttatgacacatgcacagtctagcaaccagtatcagaaataagatagagaatagtttcatcacctcaaaactttccctgtgtcccctttgtagtcttcctttcccctacttcagcccttggcaatccctgctctgtttttgttgacagagacagttctcctcacttgtttgtgaagactgtaaggttctgactgccctttttcctgggacatttctcagggttatatatgcagctgataaacttgagacatgagataacatctgttcccagacaaaaagcaagcttatttactgcttgctataaaattggtggattccctgagttcagtgcttctcatttgctgatgcaaactcactacaagcatagcatccatctgagcatccccaaaggacttgggatgaagggaactgatgcaaatgtgctgatgttcttctgttttgtcataagtaatgaagtgttttttctttgactgaggagtcttgtgtcttctgcctgcatccatgaattagttaagaggcttttgtgttagcttttattaaatagggtaaaatcaaatcccagtctccataattttctgtttgtatagttttgccttttccggtgacttgtattgagggttcctgcttctggccaacaacctatgagtgattttttaggtctgatcataaggcatttacagaggttttcctggcaggcttcatagggggagggctggtctccagagcagacttggtgcaaagcttttatagtctctgaggggaattgcagtcaaggacccagccatcctcttatacatatctgcgttcctagcctaggtgccttcattcagaggcctctttatgtggggcttttggggaggctttccttaagtgtctctgtcaagactttattggggaaaagaggggaagacacttaccaactctttctctactatgacttgtacttttctgtttctaacccttccctctctagccttcactcgactcctgggtctgtaaaactgccagaatcttttgttgggggttccctttggcaatgatgcaaccctcacatttgtgctggtctacctgccctgtgaccaatgtgccatgccacaggggaaaatggaatggggggtagctggcactttctccaatttagcctcttatactgtcacagtgattacagacctattctttattttattttattttatttatttatttttttggcttgttgccattggctgtgccaaaacgtggcagcccagctttctccagctctcctgaggtactgatacacacaaatggaatcatgttgtgcatagcctttgaatctgactttcttcagttgacgtaagttcatcttagattcatccatttgctttgtcaatagtttttaaattttaatggctgagtagttttctatcatcgtgatgtactgcaccttgtgtctctatccactctagagggatatttgaattgtttctggtgattatgaataaagctgctaaaaatatttatacgtttttgtgttaacataaattttcattttactagatgtattgccaaactcctttccaaagtggctgtgccatttcacattcccactagtaatatatgagaggtctagtggtttcacatcctttcagcacttgatattgtcagcttttattactacatcaattgtaagggggagaggagcatctcattgtttgtttctacttccctaattatgtgaagcacatttttatatgcttatttgctatctgtatatgttctttgaagaagtatctcttcaaactctttgccttttttttaaaaaaaattgtgtttatttttgttacagagttttgagaattctttatctgttctgcagacaagacttatcagatgtgtgatttgcaaatattttctcctagtgagtggcttgtgttttcattttcctaacaatgtctttcagtgagcagaagttcttacaaatttatgtacttttaaaatggattatgcttttgtgtcatataagaactctttgcctaatccagggtgagaaagatttactcctatattttctactagaaatttcatagttttactttttacatgtagatctgtgatccattttgagttaagttttgtgtatattgggtgaggtctgtaacagagtttttgattattgttttttgctattgttttttgctttggcatatggatatccaattgatccattactcttccctgaagtctatttaaatctctttaattgccattgtacttttttgaaaatcaattatgtggttgtatatctatgttccatattctgtttcattgatctatatgtctcttctttctccaatatcatacttctctgattactgtagcttaatgtgtttgttttttttgctgtctaatcatggaagttgaatttattgcattttacaggtcaatattttttgtagttgtagacgtctgtaattttgcactgttaattttaatgtaatggacatattagaaattaggttttcaatatgcaggggaaatgctgttaatttacaattgaagagagttatgaaataataataaatagaaaaagtaaatagagaaaggaaagtacagtcatcccttagtgcccataagggattggttctaggaccctctgtggataccaaatccatggatactcaagtcccttaaatggcataatatttgcacataacctatgcatatcctcccatatactttaaataatccccagattgcttataatacctaatacactataaatgctaagtaaatacttgttatactgtgttatttagggaataatgacaagaaaaaagtctgtacctgttcagtacagactcaacaactatccatttcccccacttccaagtatttttgatctgctgttggttggttggtctgcagatgcagatcccatggatatggtgggcctatatatatgtcttatttattgtcactaccttttgcttccaagtattttttatttttaatgagagttattttgttgtggtgggtggtttaacatacataagttttcccagcagcagaaccctgaagcaaggattttagaacaaagtctactttggagacgtatgtaacaggcaagaattgatgcaaggaaagcaaggcagctaatgaagacttactaactaaactaacacaataggttgctggagctttatcttgtgggataattctgggaaagtcagtgtcaaatttagtttcgggactaactcacctgaagtgtgagagagtgagtatatttcctgttactggttgtggactgccatacagaagacattgcacctgcctggtgctgtggtgggcagagtagcattcagccattcagaggaaagccctgagggatacagaggaagatactggctattggaagtaatttggaatggtgggaaagggttaggtccaaaggatactgtacagacactgacattatctgactcatgccttgtgaattttaagtgcctttcctgggttatcaaagtgaatagctttaatcaaatcatctctataaagacatttctaagtaaattttctatacttacactcctctactttttattactacagctggcttcattagctttttgtatattaatctgtgttgtcctactattagctagaagagcttactaactgtgagcttgaagatattgtatattccctcttcggatgatttttttttttttttttttgagtcagagtcttgctcttgtagcccaggctggagtgcagtgatgcaatctcggctcaccgcagcctccgcctcccgggttcaagtgattgtcatgcctcagcctcccgagtaactgggattacaggcacctgccaccacgctgggctacaaatgtatttaagaatcttaaatgagctgtgattgcaccactacactccagtctgggtgacagagcgagaccctggcttcaagcagtcctcctgcctcagcttcctaaagtgctgggattacaggcatgagccactacccctggcctaaattccttttctagcctctatacagaatttctaggataacaacaacaacaacaacaacaaaaacttaaatgataaaaatgaatatataaaatagcaagtaagccatgtaaaatattttcaatattcttagccattagagaagtgcaaattaaaactataagatactgctgcatacatatgtggatagcgaaagtaaaaactggtgagaatacagaatgaatggatttctcatctgttgctgataggaaaatgacacagccactctggaaaacagtttggcatttttaataaaattaaagataaatattccatatgactcagcaatcatattcctgagtatttaacatagaaaaatggaaatttatgtatatgtaaaaacttgctacacaaatatttacatcagcttaatttgtaattgcctcaaactggaaagaatccagataactttcaacaggtgaatagataaacaaactgtgatatatctatcgaatggaataccaagctttgtaaaagaataaattactggtacagtcaacagtttccgtagatcttaagttcatcacacgaagtaaaaaaaaagctaaactcaaagtgttacatactgtatgattccaattatatagtattacttaaatgaaaaaaaattagtgttggaaaattaacctgtcattccaggagttagagataatgtgggagaaggggataggtatgactataagggagttgcaggagagggcttctttgtggtgatggaatagttctgtgtcttaattgtgctggtgagtacatgaatctttacagctgataagattttatagaatagtacacacacactaagaacaatgcatgtaatgtctactttggggagctttttttaaaaaaatttcttttaagagacagtgtcttgttccatttcccaggctggagtgcagtggcacaatcatagctcactgtagcctcaaacacctgggctcaagggattctcctgcttccagcctcccaggtagctaggactataggtgcatgccaccatggctcgctaatttttttatttttattttttgtagagatgggggtctcaccatgttgcccaggctggtctcagtctcctggcttcaagcagtccttctgccttggccttctaaagtgctgggattacaggggtgagccactgccctggcctaaattccttttttagcctcttcacagaatttctaggataaccaatataagtaaagtagatgttatttttaaaatgatccactttatacactaaattaaaagacagtcttgatttcttcaaaattctttgctgtgaagtgaaacgtttggtaatcatatatcttgttgacataaacatacagattcctctgcatgtaacattcttttccttcactttaccaatttgtgcccatttcacgtatctcagcctatatccctttttcatgatcatcttacctctgacataactctttcacccaccaaatctgtgtttggtgtcatttctatgatggtcccatacaaagctggactcattttacagatgcaaaaagtgatgaaataatgaacaagttaatggcccaactgaaactgtggtgttggacataaactttagaataaatcctaaatcttaagtgtgcaaataaattattcaaaacatgagattacctaacctattctagtgatatttaacagagatatgtttgtaactggtggaagaagaatcactccctaggtacaagatcaattactgttcattttattcacctgaagataaatcactttcacagattttgcagactacttcttttcctgaaaaaatgatttattaaagtggaggtttctttactatatcaacactggcttactcttttctttataatacttctatactgaaagaagccagaggccaaaagtagtcttgtttgtgctgctctttatttcattgttatttttaaaccagatgatgaaattcccttccattttgaagggccatttttcatgtacataggagggaatttaaactgtttgagttaatattaacatattctattactataaattggttttagtttgattttaaaatagcatattaatttacatttaattttagtattcaactctgatcagaaaaatagtattttggatgtaggggtaaggaaaaggtgtgaaattccagttaaaaatctaaagtactgtgtttattgtttcattgtgtgtctgcatttagtattgtttgtatgagaaaaagtcagttgtttccttatattcccatataatttttgagtagtatgacaatcttcatttatatacctgatgacttttaatttttaaaatgttgtctaaaccaggtttcaggtgatatatcttgcttcctaatttgacaactctgaatattactattgaaacttgtaagcaagtagaaattaaaatgaagccatacatagcatttgctttgattaaaaagaatagaaacctagactgttttggaaaattcagtgtatatttcagtgtatatatattatgtgtttatatattgacagatctgggcatcagaatagagtcaagaaataacataaatagaaattcagtaagaacacatatgaaactggaaaccagtggaggaaaactgaggaattgctgtttgtgagagacttatttttcactcagtatacttttttttactgttttaattgtctatatagcatgctgcatattaccaattttaaatacttaattttgaaagattaaaatggctggcaaatttattgcccatttgcaaagtacatttatatcaggcatagtacaatatgtagaatgttattggaacattggaacattgtgtctgaaatacttttttaaaaacctcataaaatatgaaaatacttcttaatgatttcaatattaactctattcattagacatctatcattatcctttatgtcagaaacttagagtgaaatcttattagcttgattgaagaacacttgttctcatttcattgtgctatagttaacattcaaagttaaagttatttttcttctccttgatagtatactataataagtatattcaaagtgatgctctagatttgtttccttcacatttagacttgcatttttacaatgtttatactaaggtttcttacacttgccatagtatatctgtgcggtggcttactcctgttaatcccagcaattagggaggcccaggcaggtggattatgaggtcaggagtttgagaccagcctggccaacatggtgaaaccctgtctctactaaaaatacaaaaaaaaaaaattagctgggtgtgttggcgggtgcctgtaatcctagctactcgggaggctgaggcaggagaatcacttgaacctgggaaggtggaggttgcagtgagccgagatcctgccactgcactgcagcctggacaacaagagcgagactccgtctcaaaaaaaaaaaaaaaaaaggatttttgcaatcattaacttacttcttgctgtctgtttttattgtctttggctgtccttcttaacttcttcaaagatttctagtatatttacactccttaatcctaaatccagtgtatgttggctctcatggtagttttccatttcatgtacttgcttgtataatataaatccctgttcttggtgttttgtgtatttatttatttggctgccattgtattgaaaattgtcttgacaattcatttatgaacatcattagtacagcaatatgtaattcaaaaccagcatgctcaaatttgtactattctggttagttattgctatgtgtgtattttcaaatttttaaagacttagagaatagtaaaacatatacttagcacaaatgatatcacttcttggtacctttctgtgagtccttcttcccataaggaaattaaattgttctttgttttcatgctaagtagcatgaaaaaaaagctttattgagataaatcaaatttagagcatttttatcacctcaaaaagagcccatatacattagctctcacccactcaattatccctccttggctattttgggtccattgcaattccaagtgaattttagagtcagtttgtcaatttacacaatgagtatagcttggattctgatagggattgtgttgaatctctacatccataatgggtaatattgccaatcttaataaaattttccatgaatgtgggatgtttttccatttatttggatcatctttaatttgttgcaacaatgttttgtagttttcagagtataaattttacactgtaaagaaaacttattcccaaatattattttctttttgatgctattgtaagtggaattcttttcttaattttatgttcagattattcattgcagatggcttagagatacaattgtgtgtggtttttgttgttttgtttttgagacaggctcatgctctgttgcccaggctgaagtgcagtggcacaaacatggctcactgcagccacaatctcctaggcccacctgattctcctccctcagcctcccaagtagctgagaccactagacatgcaccaccatgcctggctaatttttaattttttttgtagagacagagtcttgccatgttgcccaggctggtctcgaactcttgggctcaagcaatcctctggccttagcctcccaaagttttgggattataggcatgagccgctgtgcctagctcagtttgtgtgtgtgtgtgtgtgtgtgtgtgtgtgtgtgtgttttaatattgatcttgtatcctacagcctttctgaacttacttagctctaatattttttagtgggttctttatgattttctataaacaaaaccatgtcatctgtgactatagttgtgtttccttctttctttctaatttggaagcctttaactattttcccccttccttaattgctgtgactagtagttgtaatgtaacagtgaacagaagtggcaagaagagatgtccctagtcttgtttctcatatagggggaaaatatctaatcattcaccattaagtttgatgtttctctgcagttttcttagatgccctttatcagattgaggaagttactttctatttctgtttttttttagcgtttttatcttgaaacagtacagttgacccttgcacaacatggcgattgtgggtgctgacccactgcatagtctaaaatccatgtataacttttgattctcccaaaacttgtcaattaatagcctactgttaaccagaagccttaccagtaacataaagtcaattaccacatattttatatatgtatcatataaagaatatattattaagaaaatcatgagagaaaatgtatgtactatttattaagtggaaatgtttcgtgagaaaagtcatcattgtcttcatgttgggttggctgaggaggcagaggaggaactggttttgctgtcttaagggtggcagaggtggaagaaaatactggtgtaagtggatttgtgaagttcaaaccagtgttgttctggagtcaattgtagtggattttgccaaatgctttttgtttgtttgttttttgagacggagtttcgctcttgttgcccaggttagcgtgcaatggcatgatcttggctcactgcaacttctgcctcccaggttcaagcaattctcctgcctcagcctcctgagtagctgggatttcaggtgcccagcaccacgcctaacttatttttgtatttttagtagagatggggtttcaccatgttggccaggctggtctctaattcctgacctcttgtgatccacccgccttggcctcccaaaatgcgagattacaggcgtgagcaaccatgcctggctgccagatgctttttctatgtgtgttgagatgatcatgtaattttgttttctattctattgatatgatgcattgaattaattgatttttggatcttaaaccaaccttgcattcctgagacaaactccacttggttatgttatatataatttttaaatgttgctggatttgttttgctagtattttgttgaggatttttgcatcattctcatatgagtatcagtctgtagttttattttcttgtgactttgtctgattttagagtatcatagtaatactggcctcataacatgaattgggagatgtcttccctcttctaatttttagaagagtttgtggagaattggtattaatttttttaaaagaagcagcaattgcttatttttctaatcaggtgtctatgctgctgaatcttaaggcctcaacaaatgttgcaccttattatttcattgaacaataagaccttctattctgattattcccggtaaataggaataatcactggtttctccagtggtttccacttgccaaaaactcatgacagatgacttaacaaggtggcacctgctttcaggggattgtatcagatgcatactcatttccagtgcagcagctgttggcaatctaggacttctctatcatggttggccaagtagtcctgctttggctgccagagcttcattctgctgaatattacattcctgaagtctcatggatattctttttgtcatttaaaaatatttccataaagtgttctgaacaggctggtctcttcaggttttacatctgttgtgcagtcttaacacagtccaaaaagcagatttctgcaagtttattgtcagtcccaagaaattccttcaactgtttaatctgatcagattctggtatttgtgcacccatattcttttggtacatttattagtcatcttctctgatgcatgagtttcctttctgttcttgtaaagtagtgttccaacctttgtttgaatgtcttcagtgagacgtgatttcttacctaagcacaggctctcacatctgacgtcagtacaaggctggaggcctacactgccagtcgagtctgaggatggaggatcaggatcagggcaagcattgcagccgctttatctaattcttctttaaacgttcattagaattcaatagtgaagccattcagggctaggcttttctttgtgggtagtttcttgattactaatttaatctcttgttatataggtctgttcaagttacctattttttcttgaaatttttttagtcatttgtgcctttctaagtatttgtccatttcatctaataaataatctaatttgtttaatggctattctttctgacattaatatagccactttgtctttcttgtgggtgttgtttgcatcacgtatcttttttttttttcccagacagggtcttgctttgttgcccaggctggagtgcactggcaagcagaggttgccactcactggaacctctgattcccaggtttaagtgatcctcccacctcagtctcctgagtagctgggattacaggtgcataccatcatgcttggctaatttttaaattttttgcagagacgaggtctcactgtattgtccaggctggtcttgaactcctggctcaaagtgaaacccctgccttggcatctcaaagtgctgggtttacagatgtgagccaccacatccagcctgcatgatatatttttccacccgtactttcaatctgttagtaactttctatctacagtgtgtctcctgttgacccacataactgtcttttatgtatagttattagaactattgataagaaaatgtgaaagtatagtcccattatcttatttgagtggaatcagtagactatttcataaaatgtattctagtttatagtttagaatagtttgtttttcatggcttttgagaaaaacatttgaatgagcttacattttgttgcatttaaaatttctgggtttttgttgttgttgttgttgttgttttgagatgcagtctctctctgttgcccaggctgaagtgcagtggtgtgatcttggctcactgcaacctctacctcccaggttcaaatgattcttgtgcctcagccccctgagtaactgggactgcaggtacatgccacgacctggctaattttgtatttttagtagagatggggtttcgccctgttgggcaagctggtctcaaactcctgacctcaggtgatctacctgactcagcctcccaaagtgctggaagtacaagtatgagccactgcgcctggccaaaatttctgttttttaatgaatccaaagttcatgtttttttttcttcccaatgccatggtacatatcatcaccaaaaaaagtagtgattttgcttcagtgaacactgaattttaatattattgatagaatggctatatcgatcagggttttacacttatagtacagtatacttgcaatgtaggtaggcctcatcctttgtaattaattaattagcttgtaattatgtaagctaatctaaattttcatattttcagttttaacatttgggcttttgagttacatttcttatattttgatttttttctataaattttaaaaccagaaagacaacactagaatcaattaaatgcaagattgaaagggtttcataatgtaaaagagcaatcttgtttttgaaatgttcagtttacagtaaggatcgagtagctctgcagctaccgatttgggaaatacctgaggttttttttccccttgcacttacaggctgttttagccctgaaggtggctagtaaggacacagactttagagtgccacgacagttccataacaggaatgaattgaagaagagaagcagtggagtcaggagcctcacaaattaaagacaactggtgaagagaaaaaccatttattttcgatacttaagatggctgagcctgtaattccagcagtgctttgggaggctgaggcaggtggatcacgaggtcaggagattgagaccatcctggctaacacggtgaaaccctgtctctactaaaaatacaaaaaattagccgggcatggtgggcacctgtagtcccagctactcaggaggctgaggcaggagaatggtgtgaacccgggaggtggagcttgcaatgagcagagatcgcaccactgcactccagcctgggcgacagagcgacactctgtctcaaaaaaaaaaaaaaaaaaaaaaaaaaaaaaaaaaaagatggccgaataggaagagctccagtctgcagctcccagcaagaccaacacagaaggtgggtgatttctgcatttccaactaaggtacccagttcatctcattgggactaattaggcagtggttgcagcccacagagggtgagcagaagcagggtggggtatcacctcacctgggaggtgcaaggagctgggggacctccttcccccagccaagggaagccatgagggactgtgctatctggcccagataccatgattttcctatggtttttgcaatccgcagatcaggagattccgtcgtgtgcctacaccaccagggccttgggtttcaaacacaaaactgggcggctgtttaggcagacacttagctagttgcaggagttttttttcgtaccccagtggcacccggaaccccagcgagacagaactgttaactcccctggaaagggggctgaagccagggagccacgtggtcttgcttagagggtcccactcccacggagcccagtaagctaagaaccactggcttaacattctcactgccagcacaacagtctgaaattgaccttggaccattgggcttggtagggggaggggcatctgcaattactgaggcttgagtaggtggtttttccctgacagtactaaggtggcggggaggtttgaaccaggtggaattcaccacagtgcagcaaagcagctgtggccagactccctgtctagattcctcctcactggacagggtatttgtgaaagaaaggtagcagacctagtcaggggcttatggataaaactcccatctccctgggacagagcacctgagggaaggggcggctgtgggcgcagcttcagaggacataaactttcctgcctggtggctctgaagagaacagctgatactgacaaggaggattctcccagaacagtgcttgagctctgcttagggacagactgcctcctcaagtgagttgaggagactccgtgccttctcactgggagagaactgccaacaggggccaacagacacctcaaacaggagagctctggctggcatcaggctggtgcccctctgggacgaagcttctagaggaaggaccaggcaacaatctttgctgttctgcagcctccattggtgatactcaggcaaacagggtctggagtggacttaaagcaaactgcagcagacctgcagaagaggtgcctgactgttaggagaaaaactagcaaacagaaagcaacaaactcaacatcaacaaaaaggacccccacacaaaaaccccatccaaaggtcatcagcctcaaagatcaaaggtagataaatccatgatgatgaggaaaaaccagcgcaaaaacggtgaaaattccaaaaaccagaatgcctctttgcctccaaataattgcagctcctctccagcaagggcacaaaactggacggagcaaccccaagacacctaatagtcagattctcctctgagctgaaggaccatgttctaacccagtgcaaggaagctaagaaccttgataaaaggttataggaactgctaactagaataaccagtttagagaggaacataaatgacctgatggggctgaaaaacacagcacgagcacttcatgaagcatacacaagtatcaatagccaaatcgatcaagcagaagaaaggctatcacagattgaatatcaacttattgaaataaagtgtgaagacaagattagagaaaaaaaaaataaaatggaatgaacaaaacctccaagacatatgagactatgtgaaaagaccaaacctatgattgattggtgtacctgaaagtgacagggagaatggaaccaagttggaaaacacacttcaggatattatccaggagaacttccccaacctagcaagacaggccaacactcaaatttgggaaatatggagaacactgcaaagatactccttgagaagagcaaccccaagacacctaatcatcagattctccaaggttgaaatgaaggaaaaaatgttaagggcagccatagagaaaggtcaggttacctacaaaaggaagcccatcagaccaatagcagatctctctgcagaaaccctacaagccagaagagagtgggggccattattcaacattcttaaagaaaagaattttcaacccagaatttcatatccagccaaactaagcttcataagctaaggagaaataaaatccttttcagagaaggaaatgctgagggattttgtcaccaccaggcctgccttacaagagctcctgaaggaagcactaaatgtggaaaggaaaaagtggtactagccactgcacaaacacaccaaaatataaagaccaatgacactatgaagaaactgcttcaattagtgtgtaaaataacctgctaacatcatgatgacaggatcaaattcatgtataataatattaaccttagctgtacatggcctaaatgccccaattaaaagacacggactggcaaattggatgaagagtcaagatccatcggtgtgctgtattcaggagacccatctcacttgcaaagacacacataggctcaaaataaagggatggaggaatgtttaccaagcaaatggaaagcaaaaaaaaaagcaggggttgcacttctagtctctgataaaacaggctttaaactaacaaagatcaaaaaagacaaagaagggcattacataatggtaaagggatcaatgcaacaagaagagctatcgtaaatatatatgcacccactacaggagcacccagattcataaaacaagttctcagagacctacaaagatacttagacttccacacaataatagtgggagactttaacaccccactgtcaatatgagatcaatgagacagaaaattaacaaggttattcaggacttgaactaagctctggaccaagcggacctaatagacatggggttgctacagaactgtctaccccaaatcaacagaatatacattcttctcagcagcacatggcacttattctcaaatcaaccacataattcaaagtaaaacactcctcagcaaatgcaaaagaatggaaatcataacaaacagtctctcagaccacagtgcaatcaaattagaactgaggattaagaaactcactcaaaaccacccaactacatggaaattcaacaacctgctcctgaatgaatattgggtaaataatgaaattaaggcagaaataaagaagttatttgaaaccaatgagaacaaagagaaaacgtaccaaaatctaggacacaccaaaagcagtgttaagagggatatttatagcactaagtgcccacttcagacagctggaaagatctgaaatcaacaccccaacatcacaattaaaagaactagagaagcaacagcaaacaaattcaaaagctagcagaagacaagaaataactaagatcacagcagaactgaaggaggtacagacatgaaaaacccttgaaaaaaatcagtgaatccaggaggtggttttttgaaaagattaaccaaatagatagactactagctagactattaaagaagaaaagagagaagaatcaaatggacacaataaaaaattataaagtggatatcaccactattctcagagaaatacaaactaccaacagagaatactataaacacctctatgcaaataaaccagaaaatctagaagaaatggatacattcctggatacattcctggacacatacaccctcccaagactaatccagggagaagttgaatccctgaatagaccaataacaagttctgaaattgaggcagtaattaatagtctaccaaccaaaaaaagcccaggaccatacagattcacatccgaattctaccagaggttcaaagaggagctggtaccattccttctgaaactattccaaacaattgaaaaagagggagtcctccctaactcattttatgaagccagcatcatcctgattccaaaacttgacagagacacaacaaaaaaagaaaatttcaggccaatatccctgatgaacatccatgtgaaaatcctcaataaaatgctggcaaacgaatccagcgacatgtcaaaaagcttatccaccacaatcaagtcggcttgacatgtaaggctggttcaacatacgcaaatcaataaacgtaatctatcacataaacagaaccaatgacaaaaaccatatgattatctcaatagatgcagagaagtcctttgataaaattaaacatccttcatgctaaaaactctcaaaaaactaggtattgatggaacatatctcaaaatataagggctatttatgacaaatccatagccaatatcatactgaacaggcaaaagctggaagcattccctttgaaaaccagcacagacaaggatgccctctctcaccactcctattcaacatagttttggaagttctgactagagcaatctggcaagagaaagaaataaagcgtatttaaataggaatagaggaagtcagattgtctctgtttgcagatgacatgattgtatatttagaaaaccccatcgtctcagcccaaaacctccttaagctgataagcagcttcagcagtctcaggatacaaaatcaatatgcagaaatcacaagcatttctatacatcaataatagacaagcagagagccaaatcatgagtgaactcccattcacaattgctacaagagaataaaatacctaggaatacaacttataagggatgtgaaggacctcttcaaggagaaccagaaaccactgcccaagaaaataagagaggatgcaaacaaatggaaaaaaaattcagtgttcatggataggaagaatcaatattgtgaaaatggccatattgcccaaaataatgtatagatccaatgctattcccatcaagcttccattgactttcttcgcagagttaaaaaaaaaaaagaaacaaaccttaaatttcatatggaaccaaaaaggagcctgtgtagctaagacaatcctaagcaaaaataacaaagctggaggcatcatgctacctgacttcaaactgtactacaaggcaacaataaccaaacagcatggtactggtaccaaaacagatatatagaccaatgaaacagaacagaggcctcagaaataataccacacatctacaaccatctgatctttgacaaatctgacaaaaacaagcaatggggaaaggattccctgtttaataaatggtgttgggaaaactggctagccatatgcagaaaattgaacctggatcactgccttacacattatacaaaaagtaaccaagatggattaaggacttaaatgtaaaaccgaaaaccataaaaaccctagaagaaaacctaggcaataccattcaggacataggcatgggcaaagacttcatgactaaaacacccaatgcaattgcagcaaaagccaaaattgacaaatgggatctaattaaactaaagagcttctacacagcgaaagaaactatcatcagagtgaacaggcagcatacagaatgggagaaaatttttgcaatctatccatctgacaaaggtctaatatccagaatctacaggaacttaaacaaatttgcaagaaaataacaaccctatcaaaaattgggcaaaggatatgaatggacacttctcaaaagaagacgtgcaaccaacaaacatgaaaaattgctcatcatcattggtcattagagaaatgcaaatcaaaaccacaatgagataccatctcatgccagttagaatggcgatcattaaaaagtcaggaaacaacagttgctgttgaggttgtggagcaataggaatgcttttacactgttggtgggagtgtaaattagttcaaccgctgtagaagacagtgtagcaattcctcaaggatctagaaccagacataccatttgaccgagcaatcccattactgggtatgtacccaagggattataaatcattctcctataaagacacatgcacacatgtgtttattgtagcgctatttacaatagcaaaggcttagaaccaacctgatgcccgtcaatgatagatagagaaaatgttgcacagagacaccatggaatactatgcagccataaaaaaggatgagttcatgtcctttgcagggacatgatgaagctggaaaccatcatttttagcaaagtaacacagaaacagaaaaccaaacaccacatgttctcattaataagtgggagttgaacaatgagaacacatggacacagggaatggagcataacatacctgggccagctggtgggtaggggtcaaggggagggagaggattaggacaaatacctattgcatgcagagcttaaaacttagatgatgggttgataggtgcaccaaaccaccatggcacatgtataccaacgtaacaaacctgcacgttctgcacatatatcccagaacttaaagttaaaaaaaaaaaaaaaaagccaggcgcagtggctcacgcctgtaatcccagcactttgggaggctgaggcaggtggatcacaaggtcaggagatcgagaccatcctggctaaaatggtgaaaccctgtttctactaaaaatacaaaaaattagccaggcgtggtggcgggcatctgtagtcccagctacttgggaggctgaggcaggagaatggcatgaacacaggaggtggagcttgcagtgagctgagattgcgccactgcactccagctctggcgacagagcgagactctgtttcaaagaaaaaaaaacttcagtttacttgattttgcttatagagttctttgagaatttaaatcatcctttctgaattacagaaagtcatagattagaagtgtagctttaaaatgctctagatcactctgaattaagaaaaagggtttcctttgtccagaataagcatcaatttaaaacagcatttaaaaacaagtattcaacaaattggtatacgaattataacacaagcaactaaatcactgactttgattagtctctctactgattactactgttgaacagaagttgtgtgtaagaataggagaaggtgaactcattgtcttgagcatgtggaattagttcttgtctgaggccagatagcaatttttatcttattttcagtatagcagatcctatgctgccctgataagaatcacctgcacagcctcattgactctcacggaagtattccagtaactctttgaattttttcctagaaaaattggcatctgttacccctacacaattccttcataaacagtagaaatttcccccatgaaacctttcctttaaccttaacattcttcgataattatttatgaagtccttaaataattattacaacaagtattggttttgaatacgtaccagctttggaatactgcttaaggaaaccatgataaactccaactcctttatgattatttagaggaatatatctatttgttatagtcttaaggaaaaccttgtcaacatattagatgatagaaacagtcataaccagcgaccaccaggtttggtgggaactcatgatgtgaagggtctactccatgttctgccaaccaagtaactaagtcattttgggcaaatgattcagctgacttgatctgttacatgattcctaaggtctgttatagctccaatatttcatggcatcactccactttaatgtattatctatcttaaaaaagttaaacagaaagatcaattagcacttatattaaatttgagttgctgaatattttattttttctcacttccactcactgcttccactatttgggtaatgattgttggagctgtatgcatttataatgcattaagtacagtgtggtatatcagtaaaacttcattacaaatattcattccatacatttgtctgtactggggtcagtttttttccccttcttcttctttttaaagacagggtcttgctctgtctcctcctgtcttggtctcccaatgtgctagaactacgggcatgagacactgcacctgctcttttctagttttatttgtctatctgaagagtttattatttggctaagctcacatggcaaggtaggtatcatgaagtgttaaaacccagcttttctgctaatgttcttgtgagataaaccaactattagtaaagatacttgcttcctaatcaagattacttggaattgttaagagagtatgtatgtatgtataagttaactttttaaaaacttctctgctgcctggaggaataatgaaatgacccaaagggatagaagcaaaatatttcagatagtacataacgtatatacttagccttgtgcaatcaagaattaatgatataatgtgtatggagtaatatttaactttatttcgttataagcccttttgggatagtggttgttccacataacttttatcttctttaatgcttagtatctgctagaaatgtagtctgtgggatcataagagttggggaagatttacagatagcattttcagagactgaacagaaaagcatattgtcatttggaaaaattttaaaagtgtctaacttttattcaggaccatttgcttttattttcctgttgttatttatttctattatcttgtttacagttgaaatttggacaattggtctgtatcttttctaattttcattatatataaagacttaggtttcctctttccttatgtgtttgttggtaaacattaggtgctatttttaagttttcaattctcaggcatagtgctacttatccatgttatttatataagcaaatgagcatatttgccaatcaatccacggtaagaaacacaatttaagttcctaccaaggatacctctgtgtgtgtgtatgtgtgtgtatgtatctgaaatatttcactaaataattcatttttttttttttttttttttttttttgagacggagtctcgctctgtcgcccaggccggactgcggactgcagtggcgcaatctcggctcactgcaagctccccttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccaataattcatattgttaatacctcaaccatatcttgatattctgttagctttttaaatgatggttgtgaccaactacagttcacatttttcactagtggatcacactctgcagcattaaaatcaccgtgaaatagattaattagaataaatgaagtgttcttttttcattctgtttgtacagtagatattattggattattttataaaatacccattttataaattggatggtatgttataaatggatagtaggatttttcctttcttcattttgtaccaagagaataaaaaacactcctgttcagtacatctctagcaagcctatttcaacatccaatgtctcaaataattaatttttctatactttagtcacccttacacctaaacgttacagtgcttcagtataacttctatgtaaacattattaatcccatttacagatgggaaccagagtgttgggagacaggtcatggatttctcatgttcctgcacagtctaagtgttctaaggagaggcatttacagtgccaattgtataaggagaaatttcaggacagtaaaactactgacatgtccctccctggagacgtccaaggataataaaaataaaagaccttctcttccccttcccagaggagatttgcttatatttgagtgtaatgagcaatctttctgggcagagcagggtggcaaaccaatagaagatcagagttccttcatttgggggttactctcctgtgatgctctctactgtatgcactagtaacatccatcccttactgcattgcctcatggagattggagctcagggaactggtctaaatatattgttctaggtgctgcttttgctacgagtaataaattgtctttgtttctgatccacagttcttgtgtccttatgtcattgtgtgtgtgtgcatatgtgtatgcaggagaacgaatgcggcagattgaagagcagttgaatatcagacctttgtagtgtggtggtggtgattatggtgttgagacagaattttgctgtgttacccagtctggtgtgcagtggcgcaaggctcatttcagccttcgaactttcaaactccatgggctcaggtgaccctcccagctggtactgaaggcacaccccaccatacccagtgattttttttttttttttttttttaagagacagggttttgtcatgttgccgaggctggtctcaaactcttgggctcaagcaatccacccacctcagcctcccaaagtgctggggttacgggcataagccaccatgcctagccctttgtgatttttttaacttaactctggctcacacaatttaactgtaggtctgtttgtaaacctgaagcgctttctatgctttcttccttacatagaccgataaaataagtagaaaatatggtgctaatgactagtatttggtataagtagataaatgttttgtatcacatttgcatgcttataatctgtgatcaatgagcagtctgaatatttttccctccatcctcataagttaaactaaaaaaaagttatagattgaggctgggatatctggtggcgaaattatatttatttgaacagagtttgtgtatatacatacatatttcagaatatattgaaaaataaaagtgtaatgaccttgataaaaatgaaatattcacttaaaaactccatttaataatgcccacaggaaagaaatgcttctagaattttttaactaatcatttttctcagtacttttgattgtcatgcaaactaaagaaatggacttaatgaacaatttagttacaataataaagtttcaaaaattctaaatttacctcataattgcaacagatgcaaaattatttcatatctttatactcgttatgaaattacctcatatccaaaaatatttatgtcaagtgacaggctttttgcagcatttttgatattattacccttgtaatatataattaactttgtaagttaaccttgtggaacttttaagggaaatgcattaacttagcattaatatagacttctaaaatttactgtgatgtagaacatttgatttaatgttgtctgtgtctaatacaaaataactgtggtccacttacttatttcaaattttattctcaaaggtacctactagattatgtgtgaagaagtttgtgaccaaagtaatataactgattctgttttgaaaatctagaataaagtttatgcaaaagcatatggattatttctttatgaatgcagttttatactaaaaactcctccatacccacgtaagtagatatattctcatagtgatgtagaaaactgacaaaacttttcatcctcagagctaggaattcttgtgtttggccacaagggaaagacaaaggtattagaattttaaataagctatcatcaacaaatactacatctctccagctccattcataaatatagcaacattttggaagtgcagatgaatcgaacatagttaagtgagaaaaatttttagtaacatacataatttgtaaatattgaatcgttttttaaatgatactctgagtcataattatttcaaattgtacataatgctagaagaaactaggataatagcagaataagttacagtgactaaaatcataggtttttttaagagattggggagtctctgtggtgcccagtctggagtgcattggtgcaatcatagctcactgtaaccttgactcctggcttcaagcaatcctcctgtctctgccttccttttgtagtttcaggtcttaacatttaagtctttcatccattttgagttgatttttatacatggtataagatgaggatctagtttgattcttctccatatggatatctttggtctatatatttatttatatgacagtaccatgctgttttggttactgtagcttggtaatataatttgaatttgtgtagtgtgatgccgcagctttctctttttgctcaggattattttagctatttggggtcttctgtggttccatatgaattttaggatttgttttttctatttctgtgaagaatgcctttggtattttcatagagattgcatttaatctgtagctcactttggttagtaaagatattttaacaaggccgagcatggtggctcatgcctgtaatctagctctttgggaggctgaagtgggaggattgcttgaggccagggattcaagaccagcctaggcaacatggcgtgaccgtccctacaaaaaaatatttttttaattagctaggcatggtagcatacacttgtagtcctgtctacttgggaggctgaagcaggaggatcctttgggcccaggtggtcaaggctgcagtgagctataatcatgccactgcactctagcctgagcaacagagagagatcttatctctgtgtaaaagaaaaagaagtgtaattaaaggaaaaaaacattttaacaacagtctttcaattccaaaacatgggatgtctttttttccttttctcttcagtttctttcatcagtgttttataattttccttgtatagatctttcatctgcttggttaaatttatttcctggttattttatttttttgtagctattgtaaatggtttgctttcttgatttctttttcaggttggttgctcttagtgtatagaaattctactgacttttgtatgtcgattttgtatctgacaacttaataaattcacttaccagttctaatataatatggtctaattaatatattagactagaagtataagatctctcctggagaatgttccatgtaccgatgagaagaatgtgtattctgtggcagttggatgaaatgttctgtaaaggtctgttaggtttatttggtctagagtatagtttagcttcactgtttgaagttaaacactgatgttcttacatttcttataagaacattttatgtttcttatgtataagaacactgatgtttttatatttctagtctaataatgtattattaaactaaaaatataagatttgtcctggagaatgttccatgtcctgatgaaaagaatgtgtattctgtagcagttggatgaaatgttctgtaaatgtcttaggtttatttggtctagagtatagttttttacttcagtgtttgttgattttctgttgggatgatctgtccattgccgaaagtaggaaattgaaatcccctactattattgtatttatctcttgctcttgctcttatgtattcacacttgctctctctcatgctctctctctctctctttccctttgtatctaataatatttgctttatatatttgggtacaccaatgttgggtgcatatatatttactattgttatatccttttgctgaattgacccctttatcattatattatgatctcctttgtccctttttacagtttttgacttaaagtctattttgcctaatgtaattataggtattcctgcccttttctggtttttatttgaatagaatatctttctgcatcccttcactttcagcatctatgtgtctttataggtgaaatgagtttcttgtaggcagcatgtatctgggtcttgtttttaaaatccattcacccaccctgtgtctttatttgggttttatttgagatggagcctcactctgtcccccatgctggagtgcagtggtgtgatctcggctcactgcaacctccaactccctggttcaagcgattcttctgcctcagcctcccaagtagctgggactacaggcgtgcaccaccatgcctggctaatttttgtatttttagtagagacggtttcactatgttggccaggctggtctcaaactccggacctcatgatccacccgcctcggcctcccaaagtgttgggattacaggcgtgagccactgcgcccggcctatcctgtgtcttaattggagcatttagttcatttatattcagtattattgatagataaggttttactactcttattttgttacttgttttctagttgtttttaacttttcttctgcttcttttcttactgtctttctttgtggttaggtgattttctcttaagagtacattttaatttattgctttttatccatttttgctctgtggttaccaagaggcttataaataaacatcctgtagttatagcaagtatttaaaactgataatcaacttaactttgattggaaaaaaaacacacaaaagtgaacattaacttccttctcccccttcattttgaatttctgatgtcacagttcacatttttatattgcctatcttgtaacaaattgttgtagttattatttttaatagttttgtcttttagtcgtcttactacagatattagtgttttaaacactgcaaatacaatattaatataacactcattttagtgtttcttccagtttgaagaagtttttaaagcatttcttattggacaagtctgattatggtaaattccctcagcttttgtttgtctaagaaagtctttatttctccttcagttttgaaggataattgtgctgagcacagtaatcttggttgacagtttcttctccaccagcattccaaatatattcttccacattttcctggcttataaggtttctgctgataagtctgctaccaggcatattggatcttccttgcatgttatttacttctttcctttcagtgatttcagaagtttttctttgtgcctttgacctttgtgagtttgattataatgtgtcctagagtagtcttctttgtgtttaatctaattagtgatctttgaccttagtctacctgaatatttatatcttttttcaggtatggaaagttttctgttatcatttccttgtataagttttctacccctttgtctttctcagtccttctttgacttcagtaacctgaatatttgcccttttgatgttgtcccatagattttgtaagcttgcttgcttccttttctttttttttctcttctcaccatatttttaatcatttttctttgaactcactgattcttttatttggttaattctgcttctgttgctctctattgagattttcgcttcattaattttttttttttagttgcaggatttctggttttttaaaaaagttatttgagtctcttatatttctttcataattttctgaattgattcttcatgttttctttaagttctttgagctgtcttcaaacaggtattttgaatttttggagagatcacatatctcggtcactttcaggttagtctgtggtaccttattttgttcttttggtgtgatgtatttccctaaatgttctcaatgctttagaagtgtgatgatgtctgagcattgagggatttgtaatttattttagtcttcccagcctggctttgtttgtgcctgtccttcttcaagaggccttccagggattctaaagctgacttactattgcattctctgagcctctgaccaattacagccatctcagcactagagtatgctttaagcccaggttttctgagtcctgcaagggcaccaaggttgacacagctttctggcccagatggacctcgggaagacccaagggaggtagttgggctgcctgggaatgctgtccagacacctgaagccagaagactctcctagtggtcctgataggtatgcctcccaacaaatctctgcacagatgggataggtccctgactacaaagagagtggctggagttgagactgtgcgtctttggaatctactgtggaaaggaggctgattggctcacctcattggctcagattagcatgcatcacccaacaggtcccagtatctgggcagtttcttgactgcagcaagagggcttggagccaagactgggccccttcagtatctactatggatatgcctgtcacatggatccagttgggcgtgtgtctcccagcaagtccctccatagatggaatgattccctgactacagcaggagaggctggaggtgtgactgtgcccccttgggatttgctgtgggacagaggattgagagcctggtcttggctcagaggggtgtgcatcgccctgaatgttcctgcacatacaggatatttccccaactgcagtgagacgagccaaagctgaaactgcaccaccctgggatctgctgttggatggaggttgatgtgcttgtcatgttggctcagatgggcgtatgtctcccagcaggtctctgcatagacaggagggttccctaacagcaggaggagggtctggatctgagactggaccctctcaggatctgctgtgggatggtggctggagaacctggtctgagcatgcatctcaccagtagaccctgtagacaagatagtttcctggttgcagcaggaaaggctggagctgagactgggctccctcaggatctcctgtgttgcagaatctggagagcctgtcttgtttgcccggacagatacccctcttccagcagatctctgcacagaattattttcagaccacagcaagaagggtcagagctgagaatggaccacctgaggatctgctgtgggatggaggttggcgtgcctgtctcattagctcaaatgggcacccatctcccagcaggttcctgtttctgcacagataggatgcatcccctactgcagcaggaggagctgaggctgagtctggggcctcccttgggatctgtggcatggagtctggagccccttgtctcattgactcagagacacacccacaggagataacttttcaacttctagtaagcaatcatttgaatcattaagtatttttggtgtattatacataaccacacttaattacaattcatacctgtaccttcttattgctacccatatttgaggaataggtctttcccttctttccttctatatttaaaaccttttatctatattttcttctcatgccttgagtctaatctcaaaccttgttctcttcttgatctttgctaactttgttgtaaatgtgctcctatcccactattgaaacaaacaggcaaactctccaacattcgccttatctatcctcatttcagctgaatttcttgacagtgtagttcacacttctttatctctgatgcattcagctgctctcaccacgtttttaaaatccagtgggcacgagtcacccatgaccttttagttgccaaatccagtgaacacttttcagttcttgtctgacttatctctggcatttatcagtgttgaccttaccataactctgaaacttttcctgtcttgcttagcttatgtgataccttttccctcaggtttttcttcttttctggctcctcttcttccttttccacagctggcaattcctactcttacagctcttctaatgttttcctttcctttcctttatctttaggcaaaggctatggtgtgtgtgtgtgtgtgtgtgtgtgtgtgtgtgtgtgtgtgtgtgtgtgtgtgttctagcaacctctttcaaatgaattccaatggattctaacactaagctggagtgtcaggtactacttgtgatttcttctcttttatcttcctgggagttttacagaatctacagtagtgatcactacttcccacagtcttttcctgacactttctttctccctttctccagtttattcacttctcttttagattacaggacaattttcctctgttctccgtacatccagcctggctgtcctccagtctgtgttccatagagctactgaaaaccctactaagaaacaaattttgtaataccatttccttacaatgcttcagtaattaatgttaacatttaggttaaaaacagccttatcattaagaaaacttttaaactgatttaaaatttatataatgtgaaatcattttaaagtatacaattcagtggcatttactgcattcacaatgctgcacaaccacaaccataatttctaaataattctaagttttcatcaccccaaagggaaactccatacccatcaagcagtcatttgtcattctcccctccagctagccccgttcatccattaatcagctttctgtgtccgtgggtttacctattctggaggtttcatatacatgaaatcatcactatatgtgaccttttctgtctggtcttttacttagaataatgtcgtggaggtgcatcccattttgttgcatatattagcacttcatttttttgattgaataatgttccattgtatagctataccacatttgttattcattcatcaattgatggacattcgagttgtttctgccttttgaatgcctgattttgattcatttttgtagagtccttaggttttcctaagtataagatcatttcgtctgggaacaaggctaatttaatttcctctttttcaatttggatgccctttatttctttgtcttacctaaatgctttggctgattcattttgggcaaatacctgggaagagtgtttaattgctgggtcatatggtaattctatatttaactttttaaggaaatgccaaactgtctactacaacatctacaataagataaattttcaccagcaacttatgagggttccagtttgtgtacatcctcactaactcttgttattttattttccagttttaaatactattaatatctaactcagtgggtataaagttatatctcattgtatttatgatttgccttttcctaatgactaatgatattgtaaatgttttcatgtgcctgttgcccatgcatacatctttttgggagaaatgtatattcaacttactttcccgttttttatttgagttttatttttaaccaagaaataccttttaagtgatcagacctggaaccttgccaggtttaatgattatcaaagcagagccatattttgacttttgatgttatctattattatagtcttgttattcataattacttgaatattatcagcatctctagatcctttgtagttaaaacatagtaaagtattttaagtctttatactaaaatagtacgtcttgaaagttttaatatagaacactctgcttagcatttctttataacctaaaatgcaattaataaaagggtgtcatttcctctgccaattaagtagccttcattggttgatattgaacaaattgctgatacttatttctgtgatgtttactttttaaaaaaaatattttttgctttctttttaacacttccaaacaattgctaggttaatttgtcagttgcaaatctgaaataaaattgtttttagcagtctttcaaataaaattttcgttgagactaaagagatcctggattacaatcaacatttgtagatatgtcatacatagagaaccaaaaaaaaattataaatctgatataaatatcagtgtgccatacaggcatggtggctcatgcctgtaatctcagcattttgggaggctgaggcaggtggatcacttgagtctaggagttcgagattagcctgggcaacatggtgaaaccccatctctataaaaaatacaaaaattagccaagcatggtggtacacacctgtagtcccagctgtttgggaggctgaggtgggcggattgtttgagcttggtaggcagaggttacagtgagccaagattgtgcctctgcactccagcctaggtaacagagcgagaccctgtctcagaaagcaaaacaaaaacgcccaaatatcaatgtgctatgaaaccacacattgtatgtgttcattcccacaaattggagcattttaagaagcgctctaaattagtttatgtcttgcttttcttcttatgttctgtagattctttagtactccataagaaaaatttgctatagaaagcataaaaactgcaaatgcattatatcctccatgaaaccagctttaatttagttgctaaaccctgatcattgttgcactatacactcagaaaatgtatagcagtgactattttgtaaatatgaagagttcatattcagcacattcagcaatggtttatatctaaaatgatttttgaagaatgctttaaaaaacttctttgcctagagtctttaaagctggcactttaaaactatgtttcatggattgtcagttggaatggacttcaggaggtccataagtccatgaaattacagttttttaacatgaatttttctgaggatacatgatttttatcatactctcaaaagaatctaaaactcaaaaatggttaagagacacttaaataaaatgttgataaaggccatggtcattgattctcattcttcagaagctttgcatgtgtgagtttacctactcactaaaatgtacttgtaaatccaaaaccagtactcggtgcttttgcagtcatttgtaaacatatttggagaagcaaaaattttgagttaccttatgtgttcattcctctctgaggtcaaagaaggtgatggtttgccttgtttcagctgtcatactgtaaacaagtgtccttttcaatgcgtatttagtgccatattaatcacattttttgttgttgatttttctgtttaaaatggttcccaagcatagtgcagatatgctgtctagtgtttctaagcataagaaggctgtgatacacctgagagaataaaaatctgtaatagacaaacttggttcaggcatgagttacactgctgttgactgtgagtttattgttaataaatcaaatatgaagtatcaatatctgtataaatagttaaatataattatatatagatgtaaatataaattgttaaaatacggaatctttaaacagaaacatacattttagaaattatgtattggcattggttgaccaagatgatgtttggagaggttttcaggaaactaaccctgtctttttcccaggaacaataattctgcaggaggcagaacctgttgtctaggttggagtacagtggcatgaacatggctcactgcagttttgacctcctgtgcttcttctgccccagcttcccaagtagttcaggctacaggcacatgtcaccatgcctggtaatttttgtattttttgtagagacagggtttttcttgcccagactggtcttgaatttctgggctcaaacaatcctcccatcttggccccacaaagtactgagattagagatgtgagcctccatgcccagctatagttaaccttttgcagtgtttttttttttaacttaatgtttctaaatttcttctagggtaaacatttactacgtagaggctgtgtgtcatttacctcttcatggtatcacacatcagatacttctaacataatcatgataaatgttagtggtttcatggtcttatttacactccagctctaccagaattcactaatctacttcaagtttctgtctgaaatattctttttttttttttgatacagagtctcactttgttgcccaggctggagtgccgtggccccatttcagatcactgcaaactctgcctcctgtgttcaagtgattctcctgcctcagcttcccaagtagctgggacttacaggcacacgccaccacacccaactaattatatttttagtaaacatggagtttcaccatgttggccaggctggtctcaaactcctgacctcaagtgatctgcctgccttagcctcccaaagtgctaggattaacagacacgagccaccgcatcctgcctctgtctgaaatattcttattgttcatcatacagtatattgggctacagtactgtatttttctccagggtgttggtaaccatttatgctgagtttagccattttacttaagagtctactaattcactgtagataaagagttactactttggcatggtggagcatgcctgtaatcccagctctttgtgggaggccaaggcaggtggatcgctcgagtctaggagctcaagaccagccaagacaacatggcaaattttatttctacaaaaattacaaatattagccaggtgtggtggtgcatgcctgtagtcccagctactgaggaagctgaggtgggaggattatttgagaccgggaggtagaggctgcaatgagccatgattgtgccgctgtgctccagcctcagagacagagcagtaccacaaaaagagttagaagagttctttatctaacaaatatgagttgtatatttgcatagttgattgcattcatgaagtctaagtatttttttattcattaaatctaaaggaagttggggctctctgctttcgataagatgaagtaacaagtactgtacttatccttcacctaaaataatgattaaagaaaatttgtgtgtttatttcttaagacacagaacaagcatttgataaaatccaacatccattcctcataaaatcactcctgaaactggtgatagagaggaacttcctcaacctgataattagcatctataaggaaccaatggtaatattatatttactggtgaatgtctgaatgctttctcactaagatcaggaataagacaaggatgtctactttcactacttctgttcgatactgtactgcaggttctagccagtgcaattagttaagaaaaagaagtgcttctagattaaaaaacagaagtaaatcaatcattatacttcagtgatatgatcatctatgtatattattctatagaatctacaaaaaggtactagaatgaataattgagtttagcatgcttgcagaatataagatcagtatttaaaactcatgtagttttctgtactaggaacaaaaatttgaaattaaaatttaatagaagaaatattttctatcacataaataataggctatacttggggacaaatctgacaaaagatctggaagacctttactctgaaaactgtaaaaacattactgaatgaaaataagtgtgcagattctttacatatgatactaatagaatgatctgtttaaaattgattaattgtgcatcagctatatacataagccaaaacttaaacaattgtacaccttaaatatgtacagttaattttgttaattcaaatccctatactactgttaaaacaaattagaaaaacaaactaaaggaatttatgttcatatgacagtgaatgagttgtctgaactcacctcaatttttaatcctaagatgaatccatctctaaaaagtactgaacatctctgaaaagttatgaatatggtgtatgttttctcccataacctcatatatagcaattattgttattaggaaatcagaactagcttaaataatcataacattgaccatctgctttccttgttaaatacatttgactactaacttaatgttttcagttagccctctaaaatttgagaaagcaacatcttttttacctttttgccagatttctacaggctttctgatatatagttggccctctagatcattgctggcagtttgaaatatgtgtgattatgatagagtatttaaaatattttattataaatatttgatcaattttttattatataaattttcttcttttaaaaaaatacaatttagagatggggatcatactatgttgcccaggtcttgaactcctgggctcaagtgatccttctgccttggcctccaaaagtgctgggattatagatgtgagccactgcacccaggctagggtaaacttttgataaatatttttgattatgtagaataattttatggtgagttcaaagtagggttttgcaatttttattgtggagatgtatttatactgttagtttcaggatatctgtactgatcatctcctgtgtttttaatcatgatgtttccttttcaaacaacacattatgatgaaagatcaattttcaatgaaatcatttataagtatatactagctattgcaactttggggtttggaaaggaaaaattaaagtgtgttatgtttacatgttggaaacatgttagaaaaatcagtctaggattggaaggagatgggaagatttaggagtaactgctaatgggtacaaggtttcttcttagggtgagaaaatgttctacaatgatttgtggtaatggttacagaagtatgattatacctaaaatcattgaatcatatgctttaactggataaataaaaggcatttatattggaaaggaaatagtaaaactgtatctgtttgtagataacatgatcttatataccaaacaaaaatcttaagcagtcccctacagatctattagaagtaataaatggcttttcacactacccacatagacgtccatacggcgttctttctggattcccatcgtagcttaaagcgaaacttttcaccatgtctggagcccttgatgtcctgcaaatgaaggaggaggatgtccttaagttccttgcagcaggaacctgcttaggtggtaccaatcttgacttccagatggaacagtacatctctataaggaaaagtgatggcatccacatcgtaaatctgaagaggacctgggagaagcttctgctggcagcttgtgccattgttgccattgaaaaccctgctgatgtcagtgttatatcctccaggaatattggccaaagggctgtgctgaagtttgctgctgccactggagccactccaattgttggccacttcactcctggaaccttcactaaccacatccaggcagccttccaagagccacggcttcttgtggttactgaccccagggctgaccaccagcctctcacagaggcatcttacgttaacctatctaccgttgctttgtgtaacacagattctcctctgcactttgtggacattgccattctatgcaacaataagggagctcactcaatgggtttgatgtggtggatgccagcccgggaaggtttgcgcgcgtgtggcaccatttcccatgaacacccatgggaattcatgcctgatctctacagagatcctaaagagactgaaaaagcagagcagcctgctgctgaaaaggctgtgaccaaggaggaatttcagggtgaatggactgctccagctcctgagttaactgctactcagcctgaggttgcagactggtctgaaggtgtgcaggtgccctctgcgcctattcatcagttccctactgaagactggagtgctgagcctgccacggaaggctggtccacagctcccaatgctcaggccattgaatgggtaggagcaaacactgaaaggtcttaagctgttattgcacacgctcttaagcaacatggaaataaggttgacggaaaataaatgtcagtttaaaaaaaaaaaagtaatgcattcagcaaggttgacagataaaatatcaagatagaaaaatatattggatttttgagcaatattaatgggcaaattgaaaatgaagttatgaaacaatttcatttaaatatcttaaaaagaaataatgtacttaagtataaatataacaacagaagtgtggaacttatactctaaaaactacataacattgaaagacattaaaggaaactaaatggaaagacattaaatgttgatattttgaaaagatttaatatttttaggatggcagttctcccccaaattgatctaaaataaatttcctactaaaatcacagctaaattctttgcacaatttgacaagctgctcttaaaattaatatggaaattcaagggacccagtatagccaaaacaatcttgaaaaagaccaaaattgtgtttctcacttcccaattaaaaaacgtatgatgaagccataccaatatgtagttctggcataatgatagacatatctattaatggtatagaattgagaacagaaataagtcttcacatttatggtaacctgtctttctataagtgtgccatggcataaagaatagtcttttcaatgaagggtactagaacacctgcccatccatatgggaaaaaaaaaaagctggacccctatctcatatgcaaaaattaactcaaaatgaattaaagacttaaatgtaagaactaaaactgcaaccgttagaagacatagggatacatgtttatgactgggcatgggatatgagctggcaaatgattcttagataggtcaccaaaagcatgagcaataagagaaaagaataaataaattagatttcatcaagttttgaaagttttgtgctttaaaggacaccatcaagaaagtgaaaagacaacccacagaatgggagaaaattgcactcacatatctattttatcttgaatatataaagaattatttagactcaataatgatgaaaagacaaataactcactttaaaaaatgggcagaatatctgagtaggcagtttcccaaaagaagatatacaaatgactaaggagcacataaaaagatgctcaacataattagctatcaggtatattaaagtcaaaactacaatgagataccatttcactcctgctaggatgatgggtataatcagaaggacagagttttggcaaggatttggagaaccctaaggcattgctggtgggaatgttaaatagtgcagcctttttggaaaagagtcttgcaattccttaaatattttaacatagagttaccatatccagcaattctgctcctaggtatatacacaagacaaatgaaaatgtttgcacaaatgtttatagcagcattatgtataatagcctaaacatggaaacaacccaagtgtgttactgataaatgaataaacaaaatttggaatatccatgcaatagaatattatttgacaaaaaagaaatgaagtactgatacatgctacaacatgggcaaattttgaaaatatcgtgctaaatgaaggaagccagtcataaaagtacacatgttttatgattccatgtctgagaagtggcctgaacatgcatatttttagagacagaaaataaattagtgtttgcctgggacttgtgaagatgaggttttcggaagtgatgactcaagagtgaactggtttttttggggggtgttgaaaaatgttctaaaattgatgtggtgatgcctatacaactccaaatatactaaacaccattgaactgtacacttcaaagggatgaattgcatagtatgtgaattatatcttaaggagctgataaagaatatatatttattggtctgttttaccctttgaatggattttacccatatgtgatgtttttaccatgatacattaatcatttgccagagtttttgttccttaaattatgcatatcttacaaatgtaaaatgtcttatttgtcaatatcactactaaacaagaaaatagtctttaagcattgggaacctcactggtggatatgagttttacacgatcataattttcagagacccagggagaattatctcccattttttgattagttttctgtacactgttgcctaattatctttctgaaatacagattgatcaggtaactctctgatcccagcctgcttgtcattgtcatgcatggttagtccttcataaaatatgctattatggaccccatcttttactaaattcagagaaagcatgcccatgtctctctgtgttttttgtgtgtatgagtttctctatgtataattcactttagtttatttttcttcttttcgcctggtaaaatcttcaaacttcaagaaacagcatatctgttatttactctttgaccttttcattataccccatattccttggtgctttccaagttttttgttcgtacctttattataacactcctcgtatgttgttttcatgcttactcctccagtagagctatgaacttctcatgactttatttgtgcttctattccctcacagagtactttagatataataagagtctcttggattaatgagttcctaattttattgtgggtgctcagtaacatttttattttgatgatgttataattgaggtatgaatcagactccccttacactttctgcatataaatcttttttgtaaaagaattctatacattttaattatcctataaaaacttaattaccaatattgtttgtagatgtctgttgccagatttttaaaaaatgatgcattaccatccccataaatgataattgccttttgctttttttaatataaaaatgacaactttgcctgtcaaattataaaaaatgttttctcattattttcatttgccattctttggttactgtgctagagaatatatatgtctattgtttgttagtgtttatatcattgccctttaaaaaaattgtagttgtgcaagaatggatgtaggcaggctaaaatatggactctccagagatgtggatatgcctgggaaattgtcatttgatttacctgtcttcacaatcagcattttggaccgtgatacagttgttactacctatttacacttggctgataggcaggctcaaagctgtagcctcttattagagtcagtcaaggggggccagaatggcaagagccatttttttttttaaactgctggtcctacctcagcagcaccaggagagtggcaaagggggcttcttcaaagattttatggtatcttcactttatgtcaaagtctaagctatcagtatttttctttgtagtagttggtgtatgtgccaaagttagaaaatctttctctgtcttggttattaaaataagtggctgaattttctaatacctttatgggttctgttttgttttggtttgttttttcatttgtgtggggtttttgttgttgctgctgttgttgtttttacacttttggttaaagtgtgacaggaaaaacttttctttttttccctgaaaatggttctgtttttatgccagcttaatgtactaattccctcatttccgtctaaaaaaaaaatcacctttattttaatactatattgccataggtacttggatccgtgtttgaactctgtatttttctgttgatctgtatattagtaccaaattgtttctaaagcaattaacaaataatacattttaatacctggtagtaaactgctcccttaatcccatcattattactcatctatttcagaaggtactttcttattattcttccacatgaatttaaaaatcatattgatattttcaaaatatcacattggaatttgtaggttctttaggaagaaataacattttagggtacatttttgttttcttatcatatatcaagtttttcattttaattatttatttcatagctttttattatcgaaagtttcaaacatacacagagaaagaatagtaggtataatgagctccacgtttctattctctatctagcttcagtaattatttacatttgccaaacctgatttaagtacctctcctatgaagcaagtcccagatgtcttatcatttcatcctcaaatgctctagattgcctgagaatggtctcaaaaaacccaccatcatattattcacaatggtaatttcttactgctatttaatatccaatttagatttgcatttcataattgtttcaaaaatagccttttacagtaagtttatttgaatcagcatctaaagaattcaaacactatatttgtaccttgtgtcttttattattactgcttttctctctctcgtcttttttttttttttttaatactgtcattgacctttttttaaaagagaaactgtgttatttttccaggagaatatctcactttctgaatttggttagttgcttcatatttagtatttgctgagaatttgagctagagatttggttaaactcaggttttatttctttaggcaagaatcttcttaaagtgatgctccatcatttccattttatctcatctgtgagccatcatatctggtggttccacttttaatgatgctgagattaatcaatatgttcaggtgtaggttttttgtttgtctggttttctttctgctattgtatatagaacattttccttactgtttttctagtaggttattattggtatctgagaagatttttaaagcatgtgttttagtaactggacatctgaccaaactctcattactgtgtcaacttaaaaatcatgagatctgtaaatctggaaaagagaactttatttctgagaagggttacaacctgtaggctgggaagcacagcctctggattagatcaaaagtagccatttcaaagacgatgggtgagagaggagttttacactaaatgggttagctgaacatacatatttaacaggttataggaggagctatgagtattcatgaaaggggttacatgtatgtatgataagcaaacataacatgttacatatgtcccatgttcgctttggaatggagacttaacattaaaaatgtggtaaaatcagactctatacatcaaaggtgaaacttaggactcaaaggtgctttgtgcacattctctgtaaactgaccagtccatggtcaattgtcgtttatcaggaaggattgctttgtaagttggtcagcagtcatgtcaaaaccatgaaaagggaggggaatctggccacaacatcaggcagttggtcagtggaagaattttccattctttcttttccagggctggtgtttgtttaactcttaggaaaaatagtctaatgacaggtagtgaggaagagtgtatactgagacgtgaccaacctcctatctcatcaaggccgggaaacttcgtttttaaagtttttctggggcctccttagcccacagacatctgttcagtaggttggggcacttaggattttactttatctcacaaatatctaataaaatttttgggtgatcctcttcagtgactagtatagaattgtcacacttgagctttggagatgaggtgtctcaaattaaaccctaggatggttatttagtctttctgtgcctcagttttttttttttttaatctatgaaatggagatcatgtgtctacctcataggtttataatgaagattgaatcacttcccataataatcagaaactacatatttgggctgggagcagaggctcacacctgtaatcccagccccttgagcccaggagtttgaggttatagtgagttatgagcatgccaaagcactcagagtgagattctgtttcaaaaaaagaaagcagatgtttgttttttaatttttccatatcttttgcagattgtgatattgtgctttccctttttttcatattttaggcctttaattttaggatgtaattatataggccataacagttaaaaaatagcagtgataacatgcatcctacaataacatgaatagctaatatttattttagtataattttcttcttgtataattatgttgttttagtagtatgttttgaatatcaccagaataaatttttggtatctattaaaataatactataatttctttacattgatcttttaagatacagtttatccaatacttatgatgccaggttccagaatgcattagaagagtgtttgtggcatagggaatgttggaacagaagcaacactttacaatgttaaatagttttattgagaaggtgagatttgggtaaagactttcaagatgagtgaggatccatatgggtttctgggggaaatccagttcagtggaggggttggcatttgctaaaggagggcatgtttggtgtgtttcaaaatccagtagggagccgggtgtggtggtgtgcttctggagtcctagctgctcaggaggctaaggtgggaggattgcttgagcccaggagttcagatctagcctggacaacatagcaagatcccatctctaaaataaaataaaaatttaaaaaattgtttaaaatcctgtagagagttcagagtggttggagcagagtaatggagaatagtagacaatggagttagagaggcaatgagaggtaaagggaagtggcttgaacctgtagggcctcatagactattgtaaagatttttgctttttagtgagtgttgttggaagcattacagggttttgaacaaaggaatgacatactttggcttgcatttaaaaaggacagctctatgtgcgtggagtcaaggatggaagcagagaggttaggaaatcatcgcaacagtctaggcaagcagttatggtaacttggatgggtggtagcgtggagttaatgaaaagtggttgaaatctggaaatagtttgagaacaggcttttcaaatggactggatgtggtgtgtgaataacactcttctcactggtcttgttgcctctccaatccagttatacacagtagcaaaaatgatcttactttacatttgataatttcaccttcttgattaaaatccttcagtgacatactattacactgaataaaatttatccttcttaatataaccaacaaggcccacataatctagaactgcatatttttctaaccgttttcatctccctgagctccagccatacaggtgttaaattgttttaatatgccaaagtttttcctgcctcagatgctttgcattgctcctccctctggaaacttcccctaaccgtaaggtcactctttacccaatcagctcatttgcatgtttcacgtctcagtttaaatgtccttttgtctatttaaaatatattttagctgagtgcctttaatcccagctacttgggaggctgaggcaggaggataacttgaggccaggagatagagaccagcctgggcaacatagagagacctggtctctgaaaaattgaagaattagctgggtttgatggcttgcacatgtagttctagctacacaggaggctgaggcagggaggatcacttgagcccaagagttcaaggttacagtgagctatgattgtaccactgcactccagtctgagtgacagagtgagactccatctctaaaaaaataaataattggttccttctttgcctgcctcccactctttgtctttctcaaacatttttttcttcatagcatttcttacaattatgcattttatttctgtgtaatgtttttgtttgctatgctttgcattttatattgtgtggaatctccatgaaaataaggaccagcctgacttgttcaagtttgtggtcaagtaacaggatggtacctggcccttagaactatctttataaatatcattagattggattgactgactcaattaatgaacaaatgaacaaacaaaataaatcattatatgctgaagtagcagtcctggacattgtatctaatttagattttaatttaaccttgttattttgatactcgcttcccttaatcagtcattgcatgttccttattgtaaggtggttgtttttctttatcatgagaagaatagttcttctccgggcgcagtggctcacatctgtaatcccagcactttggggaggctgagacgggcggatcacaaggtcaggagattgagaccatcctggttaacatggtaaaaccccatctctactaaaaatgcaaaaaattagctgggtgtggtggcatgcacctgtagtcccagctacttgggaggctgaggcaggacaatcgcttgaacctgggaggcagaggttgcagtgaatcgagatcgtgccactgcactccagcctgggcgacagagtgagaccctgtctcaaaaaaaaacacatttttttatttagctattagcttctaggcaaaatcttaaatttcagaaaataattatactcatatagtcatactacctgtcagggaaatgtgtcaaaggaaatatgaaacaatagctttaaagttgtcccgcaccctcaccctgtttttcttttgaaggtattatactaaaggaagaaagggaaaaagagaaatctatggtgtgagttcaagtttactactgtaagtgtttaagaaagggctctgttaccatgacaacaaatgcatgaatttcatgtggaaaattttcagtgtatgggactgataaaattgtaacattctgattttctctggtatagaattgttctttgtcaagttaaaaaaaatctgttaatatatgttaaaattaaatttttaaatgttttatgatattgttttctaattgtttattataacttaaaatcatagccaaaagagtgtactttcgtagatctgtcaagcagaaagttaagtatttgatttgacattaaaaattacttttctaatctgtattagatttttgctaaatggtaaataaaatggtaaatagtttcatgtattgggagttcttgacaatagaaaatgacctgccactttatagattcctttgccttaaatgcttactaactcaggtagaggaaagctgttaagctttaagtgctttgtcatatttgcaggcttttatagtggaagagaacagcagtcagcaatgatgatggaaaactgtggcaggtagacttaaaacaccataaagcacagacgattgtgtgtaatgccttgaattgaatcctttttgaatgaaatgatcagccatatgtgccacccttatggaccctgtaagaagagtagaagaaatgtgccctaatgctaactgtgcatgaaattgcagtgttaggagatattgaccagatgtttcaatctcagcaaatggcttgttatgtgactgagtgaaaatatctttgctgctttgatcacatacaccttgaaggaaggggtaatttaatagaggctgtcatagttcatcattgtcaataaactttgacttgacctttgccttacgtttttgatgttgctgctgttaagtgttgttgggcagatgtttactgccttgagggattttgctttttataaagtgtatactagaaaaagtaaaggagaaggattttctcaattcttttcttattctttggttattagttggcatgcttctctgtggattttgtagaatttctgggcagatgcatttgagtgacattcttatgtctaaagatcactgtggtgtttctctaaaggtttcttcctttcctcaccttcctttttcttttctcgagacatggtctcactctgtcactcaggctggagtgcaagtgatgtaatcttggctcactgcagcctctacctcccaggctcaggcgatcctctcacctcagcctcctgagtagctagaactacaggtgcacaccaccatgcctggctaatttttgtattttttctagagatggggttttaccacattgcctaggctggtctcgaacttctgagctcaagccatctgccggcctcagcctcccaaaatgctgggattgcaggtgtgagccaccgcacctggccctttctcaccgttttgtcctggttttaatttaccacaataaacttccttggtggtttttctttcttattttatatacagcctattcttttgttctgatgaaagtcacattgaattaaaacttgacacctattgtaacaccataccaggtgctgtgttatttttttatccctagttttggagacctttggagataaatccatgctattttgtaatccatttttgttaatcttaagaaattgagtgaaagtttcagtaacacaatttttttaaaattataagatacagtattttaaaattttggtaaatagctttggattaaatgagtttcttgtttaatttgatgaatttgactcagttctgtaacctttttgctctttttcttgaaaagaaaaaggcttcctcactggctatatctgggttctgcctacactcttccctcacttccccttggtgtaggtggcctagaccgtgttagtcacctaatgaaatctgtgaatcctctcttgaaaaacacagcaaagtttccttacaatttcaggatgtttattggattttccccccctcctctcacacataccctgcaatgataggggcccctggacttcaagcagactaacaaagcttagaaaataagattcatactccttcttagtattctagatatataacaatttgacttagaagtaacaataacaatagtattagtgatactgctacaataattacaacagtaataataataataataattaaaatttactttctgccaaccttatgccagattctatgctgaacctttaacctgtattactggttatattgttaatgatacctctagatagagtatatgcagcatacttttattctgtactttaggaaatactatatctttagaatacagatttgagtaagagattataagcattttgattctaagactttttggaatactgaacttttagttttctgattccagtagtcagtctgtctgtctctgtctctgtctctgtctctctctctctctctctttctcggcctctctgccattcatcttcttctgaaaattagctatcccacgtaagcctcatatatcccctaattcctatttgtagttgtgagggaggaaaaatattttccttctaagttctctgctgtaagattcttgtaacaaaagacagattaacaaaagttaagtacactaatttatattctaagttttatgtaacatagagggaaatgaagacttgaagaaacaattaaacctggtgtttttacattaggttttatgaagagtggaagggaaaggcaataggacaaaaaggggtatgaactaagagtagtaaactgaggggaccttagcaagacctgtttgtttagattcatctcatgtccttacatcttctgagataaggatgttctttttttctgcatatagtaaacatcctctcacatggatggtcttatgatttgcttcagaggaaatcagaaagtccttcctgcacctgctgttctcaaattccttcagcttaaaattttcagtatgtcaagtgccatattttgggggtagtgtgtcctgatctccatcatagttaagtgtcagcttggacacagtttctcatatttatcttaggaaatcttctttggccactctgcaaagactaaggtgctacttgcatgttctgcaacaactcctattatatatatatcatctcttaaaataaatagtaacatatcttgtatgtaagctttatgtacccttaaattgtaagttttaagaagatacaatcctggctttcctgttcacttatttgacaattatttaattgcatagaatgtagcaggcactcttctagatttggaaacacaccctacaactcttttaaaaaagccaagaaaacagtcttgaacagcaaattacaattaagtggaattaattctatgataggaatgatacagtttgttgcggcaacataaaatgcaggcatataggctgggcacggttgctcacacctgtaatcccagcactttgggaggccgaggtggatggatcacttgaggtcaggagttcaagaccagcctggccaacatggtggaaccccacctctattaaaaatgcaaatattagctgggcatggtggcgtgcacctgtaatcccagctactcaggaggctggggtaggagaattgctcgaacctggaaggcagaggtttgcggtgagtcaagatcgcaccactgctctccagcctgggtgacagagcaagactccgtctcaaaaaaataaaaaataaataacaatgggtatatagaacagaatttaggacaacattgtctcagtaagtgaaacctgaaacctaagtaggaagctagaaagaacaaacagaaacagaatgaagtattcagtgtactggaacattgcattcaagagtgttaatgcttaggattaacttggagaggaagttaatggttcaatcataaagttgtttatgttgaacttgcttaagatacttgggtaacgattgaaggacattttaggaagagcactcaaaatgcagtggattggagaaaaacagaactaaaggcagggagatgatctaagaagcttttgcaaatggttgcatggttgggaggatggagtgacagagagaatgggaaatgacatccaatgggtagaggtttctttttgagataatgaaaatgtgatggttgcacagctatgtgaataaacaggaaacaactgaattgtatattttaaagtggcaaattgtatggttatatgaatatatctcaataaatttttttaaaagagacttttatagtagtctaattgagagtagatggtggcctgtactaaagtggtgttaatagaggcaggagtaaaagtgtgtcaatttaataggcaaaatagggttgagtaggtatttggatattcagagcagtcatttgaaaacaagtataagctaaaaatgagggggtctcagcatatagatgataattgaaaccatgagagtagattagatcatatccagagaaagtatatacggtaagaattgtaggtaacctgggaatccaggcctgagaaatgctaaggaatggggagaaggaaagaagcctacaaaagagatagagaagacttctttatccattattaattacaataatgtccaacaaataataggtgatcaacaaatattggtggaatgaattgaatgaatatacactaaaaattctgcattttatcacagtctcagggcactgttgtcatcgtcagctgtactctgtaataggcactgccttgaacactttgcttacattatcctattcaatcatcacaataattccacaagaaacatagtctctgaaatagtagcttgtttaccatcacatggctggatgaacttatatatctgagtctaaagtttattttttctactaggcctaatattccccgaatctgttctgagaatgttaacagatatttactaacaaaaataacaatagaactatttcagggaaagaacaggattattagaaattgatttttattaataggatgcttgctggcaggggcaatggagcagttttttaaggaaagaagcataacatactagttattcagttagaatagattcttaatatttatgaaaatcttgtgttttgccctgtctcacttggtggtattgtaatcatctgagaatctatcctataagttatgtgatatatgctattttccttatcaatctatttcagttttgatttcctcatcatcctttgcagtctgcttgttgctgtttctcagttttgacatttaatttcttttagttgtgctttacagtttttctgagatgcctcattgagttttctgtataaaatttcatatctttggcttatcttgcaactcttttagtacctaggtgtcattcttcatcattctattatgaattgaattaaagcatatggcattatttcagaagtgactgcctcttgggcatcattgtcagttatattgtcctaaatattgcatttaggtaataaaaaggaaatcttccttgaaggtaaagttaatattaatagaaatctttccatatgttgttaaagactcttgttatgaagtttaatatgccatttatttaggccttatttaaattcagttgtaaattttttccttctggctccttaccttagtgaactgtcatctcttatcatcatactctttgctcgaaaaccttcatgtgttgctttctaccctcaggatgttgcctaaatttcttgaagtggtatttactgatctggcctacatctacctttcccattagtctcttccttcccacatagttgctttgtcggtatactcctaatagtcttttatttctgtttttcattgtttttgttaatattatattcttgtttcccaatctgtgcactaagtccccttggggtgctgtagcaaacccacagagagtcttcagggtatttcaaaatttcaaggtaaacacagtgacgtctatcagacacagcatgaaccactagctccagatatttcagtttttttttttttgagatggagacttgctgtgtcacccaggctgtagcgcagtggcgggatcttggctcactgcagcctccacctcctgagttcaagcgattctcctgcctcagcctcctgagtagctgggattacaggcatgtgccaccacgcctgggtaattattgcatttttagtagagacggtgtttcaccatgttggtcaggctgttcttgaactcctgacctcgtgatccgcctgcctcagccttccaaagtgctgggattacaggcgtgagccactgcgcctggcctggtatttcagttttaacattagattactacattccttttggtggcattatactgtgcgaaactgaatctttgacggtttctgtgataaaaagcaaatcagtgtgaaacaaatgagggtgatggttaccagtctgattccaagatttgagaattttgcagtgcctaacaggtagaaaatcattaggaaataaacacttttggctgaaacgaattatttaataaatggaatttctttcatcctaggggcaccatgataaaatttctaacataggaaaggaggcatgtgctatatgctgtatgactcttttttctttctagtttgtaaccattttggaagatcatacccatccttcaaagaccaattgatactgctacctgtctttggaggcctttcctgatcccctccactgcagttgatctctctcatgggtattttccagtaatatgctgcttttttactattgctgtttaagttaaactaattgaagtatttatttgaagttaccaatagtggccgtggttttcctattcctccagttaggtataattacttaaagtataacaagagccctttccttctttgtataaaggtgatacaaatataataatagaaaccctatactgtactaaactgcgtaggttgttagtcaatttctttttatttcttttttttcttttttctttttttttgagaggagttccactcttattgcccaggctggaatgcaatggcgcaatctcggcccactgcaacctccacctcctgggttcaagcgattctccttacctcagcctcctgagtagctgggattacaggcatgcgccactatgcctggttaattttttgtatttttagagatggagtttttccatgttggtttggctggtcttgaactcccaacctcaggtgatctgcctgcctcggcttcccaaagtgtcgggattacaggcgtgagccactgcacacggccttgtttgtcaatttctaattcttacaacatccttaaaagatcataggttatgttatccacattttatatttgaagaaattgacgtttagcagtgttagtttttctcacacccacatacctcctgacctttagctattctagttccttttcctttaatattgattatagaatcaactttttgatatcctcaaaaatccattgagagtttggttgggattgcattgaacttatgaatcaatttggggagaattaatgtcttaagaatattgagttttcaaatccatgtacataatatagctcttcgtttatataagttgtttttttttcctcagcagtcttttgtagtgttctacatatatgtcttgcacatatttggttaaatgtgttcctacatgtttcaattttggtggtattgtaaatattgttttcttaattttaattttcaactcttctttgaaaatttatagaaatacattagatttttatatattgatcttaaagtctgagaccttgattgacttacttttaattctagagcatttatgtggattccttatgattttacatatattccttaaacatgcacaggttggtatctagccatagcctcaagggttactctgtagatttcaactcattcttctctgaaaatctttttcacaatttctagtctcctggctctccttgaacacatctctttctcctcattttagtgaaaatgccaggctctatttgccttctttctccctctccatggtgtggaacttgcctcctggcagagtacctgcatgatgtcagggcacaccttgtttctttcctatcagagatcacagtcctaccatgcctgttattcaatgtctgaaaattctgtaggtgtttccttttggttttctggtttacagcacaacagtaattctagagcctgctactcactcatggccagagcagaagttaaagtttttaaggtatactgtacatatgtgaaccaagggaaggtaggcagtttattttagctaaaagaaggagcataatcaaaggttataaacaaggttgaatctccatcctggagaatcaaaatctagtagttgtgactttgtattaggaacatcatcatttttatctttttattccctggcagacatgcattaaatgtttgttgattgagtatcaaaatgataggaaatagattagttggatgttggtgaaacattgtgttttagatgcttacagatgtactaaaattttaacagaaatctttgcaaattacttgttaaattttcctaaactgatttttaaaaatctatttcattctcaattataacatctttactgagattattaagtgctttgaagcagttaacgtggcttttttttttaatggctgtaaaaaaactgaatttttaggcttgttaaactctggttttagaatgacttttgagtggaaatcactgatcaaaagcaaagttctcacattttgtcaatatctgaatgtcagaaatagaatgtcaggcagtttcccatgttgaaatattcgatagtaaaaggatagcaaagttgctgaatatttctactgtttatcaatttttgccttgcaggttcaaataatatttatttgtagtggaaatatttcaattcatttaaatcctgattatggagtagttagtaaatcaggtttaagcctgacagtgagttgatatagctcttatttcagactgtagtttgaacatgtagactctctgattataactaggctaaattatataataatgactttattttcactgaacaaagtttgctattattttgatgacaaattatttaagtaatcatagtaaaagttgctattggctctgggttttatttattttgctatatatagtagacatggttgatcatttaatcatgccttatagataaataaaagtaagttatagaataacacagaaattttctgctaaatttatactttcactaaatttaataacaatagaaattctctgttaaatttatactttcactaattgtagaataaagtattttaagttaggcatttatactgagacattttatgatattaactgcttcatgttatttactcattttgataaatggagtgataatatccaaaatggaataaattaagtttaaattattgttattctttaaaggaatgatttagctacagtatgtttgtcccaccttttaattttgaacattttctaacttacagaatagtaaaatgaacttttctatacctttcacattgatccaccaattgttaacatttcaacacatttgtgttctctctttaaataaatgtatgtgtgtgtattttcctcagaaccattctgaagtatttattccttattcaagaaattaagcattgatactgttttctgatgtgtgatcaagattccagatgtcacagttattctggtagtgtccttgatagctgtttaattttattctcagtccaggatccaataagaatcacacattacatgtattagtactatttctttaatatactttcctcccacctttttggttaaggcattttcttcaagagtccaacccagttgattgtaatatgtgccaccttgtggacttaatctcatgattttaggcaataatagtacgtaagtgacactgtgtatttcccattgcatcacatcgtaaggtttatggctttattgataatgctaattgataatggttaagatagcatccctcagattttttgcttagaaccttcttccctttccccattccatgtttgtgttttccttatcctgttcagcaaacctagttcccaacagcatcaactttatattcatttgctctatcctacaatacgcacaaaatagtttcaccaataacataaccaacaataaacctactaaataaagtttgatttatttgttgtttttgttccttataattattccattaagactgtattgtcataagagcatactgaaaaattatttgcattattttttctatgtgcttatgttacaatttgataccttctttgatttttcattcttgttatactcaacttcataatttgtttttcttctaatggaatttgaaattaaaattaaattttattatttgaaaatgcaaaattttaacatgtttcagaagtcaaatttgtatggaatgctatattcagagaactcttctattcctattcctctactcctttcccactcactctcatagaaaagcatttttcatttctagtttattctttctgtgtttctttttataaaattagcaaacacaaaattatatatacattctaatatatgtatatagtatagtatctatactaaaagaatatatatggttgagtgaggtggcttgcacctatagtcccaactactcagaagactgagctgggaggatctgttgaattcaggagttcgaggcaagaatatacacacacacacacacacacacacacacacacacacacacacacattctcttttatgtaataaaaaccataacattaactctaccatcttaaccatttttaaatgtaccaattagtatacgcatgttgttacatagtcaacctctagaaatttttcatcttgcaacactgaaactctgtacccattaaactcttaattctctgacttccctccctgacgtccttggcaaccaacattctacttatgtttctatgattttgactacttcagatacttcctatgaatggaatcatacaatatgtgtcttttttgtgacagaccttatataacttagcaagttcttgatgttcatctatgttgtagcatgtgacaggatttccttcttttgtttctttatcctttaattgttgatagatgtctgggttgcttgtacttcttggctatcatgaatattgctgcagtgaacatggacatgcaaatatatctttgagatcctgctttgaattcttttgactgtatacccagaagtgaggttgcttgattatatgttaatttaatttttaatatttctttcaggaacttccataccattttagtagtggctgtaccatgttacatttccaccaacactgcacaagggttcattcacttctccacattttgccagcattttttgttttctgtgttttcggtagtaaccatcctgatcagtgtgaagtgatatctcattgtggttttgatttccctgatgattactgatgttgaacatcttttcttgtgcttattggccatttatatatcatttttggagaaatgtctattcaagtcctttgcccattttaagatcatgttatttgtatttttattgttcatttagaagtttgttatatattctggatattaacctttcattggatatatggtttggaaataagttgccttttcactctgttgattgcctcctttgccatgcagaagttaagcttgatataatcacatttatctatttttgcttttgttgcctgtgcttttgttccatatttatgaaatcattgctaaatccaatgtcctgaagctgtcccccatatttgaaaataatatatattattaagttttattttttaaacaaagctttttacctttgagacttgatttttttttgaagttaacaaaatatcctggaaattactttgtatagaaggagtgttccacagagcttttcctttttttgtgttgttttgctgggatttttgaatggctgtgtggtattccattgtgtggatatatcataatttaatcgactgatcttctacaggtggacttctagtttatttccaacattttgccattacaaataacatctcaatacttatatatgtgttgttttatattgtggatgagtctgtagaagtgggattgctggtcattaagctgttactatgtctcattcttacagttctgtctttgttactttttcctctcctcatccttttacctctcaaatatgcatgtatttcttttctattccaaatatttgagaacagattttatcaaaatctattttgatatcttttgactttgtatgtagattatttgtaggttattttgctacctgtaagtctttgaaactaaacaggtgttacctatagaatcactatagaatattagaaccctcagggatttgagctaattataaaaggtaaaaagttcaaatctgtgaaacatatgcatcttacaagaaatccattaaagcttataataattacttcaatgaaaaaatgagatatttgtaactagaactgtaacactatttctgaatttttaaaagaatttttttagatatgagcatgttttagcttaatttatatatgaattactacaataagtatgacaatcatagtaacagccacagctaatatatgttgttgactatgtgctgggtaccatgctcagcaatgcaagtacattaatttacatcatttcaattagtcctcaacgaccttatgagatgtatttgtaattatatctccactttaaacatgagtgaaatgagaaatgttaagagatatgctctaacatgctctaactcatgcagctagtaagtggcagaagcaagatttgaacccagagagtcttcaatcaagatggattctgctctttttatgacaatgctagacttcttatattgggacccactattattttcctatatcaggccagcatttgtcttaaggtctgtatgattttagctgctgagtccttaacaactttatgtactttatttctctccccaaagcagtataagatattacatggttgttatattaagtttttttaatcgtaagtgatagcacagaattgaaatcccattcataacagctacagtttctcacaaagcattcttgtcacatcactatctgtggcagaatattaaactatgtgtaccatttttttgccccattaaattatttatgttcctgttttacagtggatgattcaacagccacacaaagcagcaacattttttggatgcattgggatagataaatttggggagatcctgaagagaaaagctgctgaagcccatgtggatgctcattactacgagcagaatgagcagccaacaggaacttgtgctgcatgcatcactggtgacaacaggtcagtgtaattccaagggaaccactatactaattggctattttaacactggtaaaatatgaattccaatgtgaatttggaattttgactttataattccttttaatgtttgataaatgcttattccttatatcagttttcctgtattgtttttaaatttacttttgttaaacatgcagttgaattcatgaggcataatggaataaaagtttgaggttatttagtccagtctctactttttataattagaatcagaaaaggctgatagcttgctcaatgccttgtagcttgctcaacaccttgtagctaatttgttgcaaaacttgaattagaaacaatgttcttttcaccatatcctgaggttggaatacgagagagagagacagagagacagagagagagtgtgtgtgtgtattttatgtatataaaatacaacattacattcaggctcgtaagacttagtcatctaaatggtcatctaaaccatttctggcaaatagtaattcattcatattgaataaactcagtcgtgggtagtataccactaacaaaacaaccaagtatatttctatacacccttacttattagaaaagtattcttaatatgaacttgaaatatctctctcaggcccctccatatattggttggttgttcttttgtacccacatggagatactccttcagtgtattcatgcactgctaacgttattaccatatcagcacaggcttttttcccctttgcaagggaaaaacaaaataactgccctagctattatattgttgggataatcaaagatgacctctttttaaatagtgattcactagaaattttgcattacttatagttggaaatatgtagtctgtcctcctccattccctatctcctttcttttcccatcttctcttcctttctttttttcccttttcatcctcctttattttcttccccctctccaccacgaccttgctccatttcttctatttacccactttattgctcactacttgaccttcagcagaggtatattaaggaatggactattctagagactggggatcaataagcacagtatttactaaataaccaaaatacaatattcaaaaattattagggtatgaaaggcattttcagatctttcctttaattttgttttttatatacaggagaactttatggttttaagattacagtaaacattgaaatatgggattcagggattttaaaaaaaaacaactaaaaatgttgaaatatgtttgtttagacctttgcccttagttttcccaagaccagccttaatctgtaggtgcaaagttttcccattagtgagaagtaggtcagattttcttctgatatcacttaggctacagtaaaattactaaattgttttagtatgctaaattgctgtcctaaagaacagttatggttgggtgcagtggctcacgcctgtaatcccagcactttgggaggccgagtcaggtggatcacctgaggtcaggagttcgagaccagcctggccaacatggtgaaactccgtctctactaaaaatgtaaaaattagccaggtgtgcacctgtaatcccagctactcgggagacgaaagtaggagaattgcttgaacctaggaggtggaggttgcagtgagccgagattgtgctattgcgctccagcctgggcaacagagcaagattctgtctcaaaaccaaagagagagagagaacagttatgataatattagatcttctggatgtcaaaaacttaacttttatactaattttatggttatagtgatattgttgagatgatatgggactcaaaaattggggagaaatcttcagtatctaaatcattatctaaattctggaagctaatacagttggatcaattgttttggataggtccagtaacctttgctgccactatcaaaaactcagaaattggccgggtgtggtggtcacaccttgtaatcctaacactttaggagaccgaagtaggctgatcactcgagctcaggagtttaaggccagcctggccaacatggcgaaactccatctctacaaaaaatacaaaaattagctggggatggtggcatgtacctgtggtccccgctgcttgggaggctgaggtggaaggattgcttgagcccaggaggttgaggctgcagtggactggggtcgtgctgcccactgcacttcagtctgggcaaaagagtgagcccctgtctaaaaaacaaaaaacaaaacaaaaaatttcagaaattgaagtgtttgggtaatgcagtatctttcttgatccaggttcttcctcttcaaagtcagaatcaaatacgttgggataataagaatactcatatttttctggtcgggcatggcagctcatgcctgtaatcccagcactttgggaggccgaggcgggtggatcatttgaggccaggagtttgagaccagcctggccaacatggtgaaactccacctctactaaaaatacaaaaaaattagccgagcatcatggcgggcacttgtaatcccagctacttgggagactgaggcaaggaaattgcttgaacccggaggcggaggttgcagtgagccaagacggagccattgctcttctctagcctgggcaacaagaacgaaacttcatctggaaaaaaaaaaaaaagaatacttttatttttcttttggagaaactgtagtttcccatcaaaaagtagttttattatcagaatagagtttagtatctggtaccagaaatgtttgcttttatttggtagccattttgtcaaaattttcctaaagtcataattactaaaatatttttataaattaggtctaaattttcttaagtttgtaatatagttattttgtatatgaatatgttgatgcatattactctttctttccttcatttacttgaacataaacagatgtatcctttagtagtaaattggcagatggatgagtggaaatacgttttggaagagaattgaggtttttttttttaacagtgtaatcgaacatattaccaaagtctgaaatgataagattttttttgtaagctataactgttacaatttaattagaaaaagagaaaaattggcaagtaattttttaaattctggagcagtatgaggaaggaaagtatttttatttataatgtaaataattattgtatttatttttaattaaacaagccaagtgacacttgtagcaggattttatttatttatttatttattttttagagatgtggttttgccttgttgcctaggctggagtgcagtggcatgatcatagctcattgcagcctcaaactcctgggctcaagcaatcctcccacctcagcttcctgagtccctaggactataagtgtgcaccactacccccagctaatttttaaaattattttgtagagatgggatctggctgtgttgcccaggctgacctcaaactcctggcatcaagcaatcctcccaccttggcctctgaaagagctgggatttcagctttgagctactgcacccaacctgcagcaagattttaaatgcagtatcctgcttagatattccatttctaaaattggaccagtcaggggacttttcaactatagaaaacaattctaattgatttcagcccttagaatgtaatggtttacaaattaattcctcttagcgaatatggtctacatttataagtgtcttttacgaaattaattccatatttggcttttaaaggcttcgattaaatagacaattatagtatgttgatatttatttttataaagatatttttctacttaaaaaatgtttttagttgcatagatttctttttatataatgagttagccttatttcttaactgcattttgaactattaaggtgtaaaaagtaggtcctattttactatcaaaaggcaacttaaatgccaatttctttctcaaaataccaggtgttgtttagaacaaaaattatcatagatgcctcagaaagttctcaaaacaaaattattatttatatttatttaaaaatcaataacattagttttgaagaattaattaaaatgtaaattttaaactttgcaaaaaatattggtaattatctattgaaacatatgctaagtttgactataatattacttgcttattctttggttgttttaggtccctcatagctaatcttgctgctgccaattgttataaaaaggaaaaacatcttgatctggagaaaaactggatgttggtagaaaaagcaagagtttgttatatagcagtaagtacttacctaattcaaatctctagtacatatttacatgatggattatagttgttgtctgatatatattttaaaataattatcttttatttaccctgcaaattatttatctctctcaaagcatatgttagattcactattgtgaaaatagaacagaaatcattatctttctatgggtaacataatttgtattatttatcttcaggtctacctatttttggatacattatgcataggtgcttgccaaccaagcgcagaattctatattaaatcagtttccaaatatattttaaaataattctacaaacttacatcttacatttgtaggcaacttgcattgtgcagaaaaatattagtagtataaatattcactgcaaatagtttgagctgaattgcttaaaaaacttaattgctatttattccatagtaattaccatgacacctcttaatttaatatttcagaaacattgatcgtgacaaatctcttaaatctgggaacaagggcagggtgtaatttgaattattaagtcttctgacacaaaaataattggttaagaatttatttctaaaataggatggtactaaaaattctgaattaatcaccccatgattaccttgtttttatttaatatgtgttaaatgtggctttacacaaataagtagatacctatgaaaaaagcatctcgtatgcatgtaatatatggttttggtataacagctgctgccatttcattacctgagctctgtgaaatagctggtaagatgtgtaaaaaattgattaccctactaggaggaacatgtttattgaaaatataattatttctttcagtctaatgttaatgtctcctacagcatgtttgtgtgcactgttctaggctttacaacattgttattgattcctctgtataccaaatcctatccctttataactgtcaaataaatgcttacattgagaagattatataatggaaagttatgctatcttttctgccagtatgtgagaaaaacatttcaagaattaaatattttacccctttattatttccatttcattttatttctcaaattggtctcatgttctttccatttttcaaatcttgatactgtatttcttgtagtgtgattctttagaggggatttatgtactatttcaaaccatcttacacttgaaagtctgattttcaaaaagcaccatgtttagaatttggcataatttatatatacttgttgactatgaaataagacagtgtattctgatgaaaaagtatatttaacttgacaattacagtcttctatgtttcaatatatagttgttcaatcctgaattgtgagccaacttgcaaacaactcatagttgtaatgattatacagtataacatgtctagccaactttgggtgaatggaacttttatgaaagtgtagattcaacttgcagacaactcatagttttagcatttatgcactatattgtatctagccatatttgggtgaatggagttttacagtagtattaaatatttatacttacgtgcaattttgtacagcataaagtgatcagcttttggtgaaattaataaggcaaatgatattatttttgagatttgggtggtgtattcagccagaagaaataacaaaatggatttcagttgttatctgtgatacaagtgttagcttgtagcttctgtttcagcagtttcataaaaagaatgatctcttacattgccaggtaaatctgtactcttctcctagcttggcttattccaaaatagttctgaaaatagtagactcatattggatacctgggacgctgtatattcttagtgaacattcaacaaatatttacttggtgaataactaagagcataattcgtatttattgaaatctgtaaacttccttttgaaatacaatgttatttccacaaagacactgcaggttttgcaaatctgtaattccctttgatttcagagcattccgaaatgatgtgtagtctagtctagttttttcttagcatatggtcaaaccataaattaagtgggctgccccatactttctggttctatgaggtcaacagtctcattacattatcatcataaactaatgaggtttaagaaattaaagttctgggggctctttaattctaaaatgtttttgatctaaggaagcaacgcagtttatctattcaacaaatatccgtaactaaaacatctgtctgcatcacataagctaaaccagatctacatactcagctctgcttcttcacactattctccaaactagcagtgtttcatgaatattaagaaaattccaaaccttcttcttcattttcttcaccatataatttactgagtaagttcacactggaaaccttcctgactgaaaagctaaaattgaatatggatacaccagcatcctcttttggtttaaatacagtgccaagatcttttaaaatttattttttacctttcataataaatgtctcattttatgccacgtaaactcagtttttccatgtttaaaccagcttctcagattctttgttagcaggtaattagggactactggctatggtgactaggtaattatgtttttgaaaacataagtctcaggttctcttcaccttagaatcagattgggatatatctgttttttctcacttaagaaataatatttcctggcatagtggtttatgcctgtagtcccagtgctttgggaggccaaagccagtggattgcttttggtcaggagatcgagtccagcttgggcaacaagtaggtctctaaggacttgctttatgaatctgggtgctcctgtattgggtgctttatgaatctgggtgctcctgtattgggtgcatatatatttaggatagttagctcttcttgttgcattgatccctttaccattatgtaatggccttctttatctcttttgatctttgttggtttaaagtctgttttatcagagactaggattgcaacccctgctttttttttttgttttccatttgcttggtagatcttcctccatccctttattttgagcctatgtgtgtctctgcatgtgagatgggtctcctgaatacagtacactgatggatcttgactctatccaatttgccagtctgtgtcttttaattggggcgtttagcccatttacatttaaggttaatattgttatgtgtgaagttgatcctgtcattatgatgttagctggttattttgctcgttagttgatgcagtttcttcctagccttgatggtctttacaatgtagcatgtttttgcagtggctggtacccgttgttctttccatgtttagtgcttccttcaggagctcttgtaaggcaggcctggtggtgacaaaatctctcagcatttgcttgtctgtaaaggattttatttctccttcacttatgaagcttagtttggctcgatatgaatttctgggttgaaaattctattctttaagaatgttgaatattggcccccactctcttttggcttgtagagtgtctgcagagagatctgctgttattctgatgggcttccctttgtgagtaacccaacctttctctctggctgcccttaacattttttccttcatttcaactttggtgaatctgacaattatgtgtcttggtgttgctcttctcgaggagtatctttgtggtgttctctgtatttcccaaatttgaatgttggcctgccttgctaggttggggacattctcctgaataatatcctgcagagtgttttccaacttggttccattctccctgtcactttcagatataccaatcagatgtagatttggtcttttcacatagtcccatatttcttggaggctttgtgcgtttctttttactctttttttttctctaaactactcttcttgcttcatttcattcatttgatcttcaatcactgataccctttcttccacttgatcgaatcagctactgaagcttgtgcatgtgtcacgtagttctcgtgccatggttttcagctccatcaggtcatttaaggtcttatccatgctgtttattctagttagcctgtcgtctaatcttttttgaaggtttttagcttcttttagatgggttcgaacatcctcctttagctcggagaagtttgttattacctatcttttgaagccttcttctctcaactcgtcaaagtcattctccatccagctgtgttctattgctggcgaggagctgtgttcctttggaggagaagagacgctctgatttttagaattgtcagcttttctcctctggtttctccccatctttgtggttttatctactttggtctttgatgatggtgacctacagatagggttttggtgtggatgtcctttctgtttgttacttttccttctaatagtcaggatcctcagctgcaggtctgttggagtttgctggaggtccactccagaccctgtttgcctggctatcaccagcagaggctgccaaatattgcagaacagcaaatgttgctgcctgatccgtcctctggaagctttgtctcagaggggcgcccagttgtatgaggtgtctgttggcccctactgggaggtatctcccagttaggttactcagggatcagggacccacttgaggaggcagtctgtccattctcagatctcaaactttgtgctgggagaaccactactctctccaaagctgtcagacagggacatttaaatctatagaagtttctattgccttttattcagctatgccctgcccccagagatggagtctacagaggcaggcaggcctccttgagctgctgtgggctctacctagttcgagcttcctggccgctttgtttacctactcaagcctcagcaatggcgggcacccctcccccagcctcactgcttccctgcagttgatctgatagcggactgctgtgctagcagtgagcaaggttccatgggcatgggaccctccgagccatgcgtgggatataatctcctggtgtgccgtttgctaaggccattggaaaagcgcagtattagggtgagagtgtcctgattttccaggtaccgtctgtcatggcttcccttggctaggaaatggaattccccaaccccttgcgcttcccaggtgaagcgatgccccgccctgctttggctcacactctgtgggctgcatccactgtccgacaagccccagtgagatgaacctggtacctcagttggaaatgcagaaatcacccgtcttctgcatcactcacgctgggagctgtagaatggagctgttcctattcctttttttgttttgttttgttttgttttgagatggagtcttgctgtgtcatccaggctggagtgcagtggcacaatctctgcccactgcaacctccgcctcctgggttcacaccattctccttgccttagcctcccaagtagctgggactgcacgtgcctgccaccatgcccggctaattttttgtatttttagtagagacggggtttcaccatgttagccaggatggtctcgatctcctgacctcatgatccacacgctttggcctcccaaagttctgggattacaggcatgagccaccacacccagcctaattgttttttttttttttaatcagctttgttaatatatgtctcacaacttacaatacatacattttacttctacatatatattataaacatcgtaaccttgctgctatttttgtttaaattgtcaaatatatattttaaaagacttaataagaaaaaattcatatttttactcaggtatttatcatttctagttctctttattccttttggttagaattagatttccatctggtatcattttccttctgcctagagggcattctttaacatctcttgtatttggatctgtcagtaataaattctttcagcttttgtatgtttgaaaacatctttatttcaccttcatttttgaaagacatttgtgccagatatatagttctagtttgacagtttttcagtacatgaaaaatgttaccccattgccatcttacttgcatagttcttgataagaaatctgacattcttttgttcttcaatgtttcacaacccccattccccaaattttgctgcttttaagatttttcatatgagaccaggtgcggtggctcacacctgtaatcccagtgctttgggaggtcaagatgggaggatggcttttgaggcatggagatcaagattagcctaggcaacatagtgagaccccatccttacaaaaaatacacacagagaaaattactcattttgatcagtttagttatgatgggccttagtgtattcttcttcatgtttcttgtgcttgggttttgtttaacttcttagagctatcggtttttagtttttattatgtttggaatatttgcagccattatacatcttcaaattggttttctgacccttttatgccacttgaagttgtctcatagctcactgacactctttttttattttgtttctttctctatgttttattttggatacctcctttgctgtgccttccatttcactaatattttcttctgtaatacctgaactgttattaatctcatcaaataaataaagctaaatatttcttactactgggggaagacttttcttagtactccatggcacagagcactaaggggtccctaatctctggtactgcaactatatcagttcctgttaggaaccaggccacacagcaggaggtgagtagcaggccaccaagcattaccacctgagctccacctcctgtcacatcagcggaggattctttttttttttttttcaaatgtgaaaaatctaattttattcagtttagattaatgtatagctatacactctggactcttaatgaaacctttcccattctttttttttagattttattattatactttaagttttagggtacacgtgcacaacatgcaggtttgttacatatgtatacatgtgccatgttggtgtgctgcacccagcagaggattcttataggggtgcaaatcctattttgaactgcacaagcgagggatctaggttgtatacgtcttatgagaatctaactaatgcctgatgatctgaggtgcaacagtttcatcctgaaaccacgcctcctacccgtccgtggaaaaattgtcttccacaaaactagtccctggtgccaaaaacgttggagactttgatgaaaaaaatgatgagtttttctgctctaggtctttgaaacagccactatttccaaatgtgtatgtgcctcaggtactgttccttctatttttttttcctcttaatacttttggatgtttctttcccaggtactgaccttaagaaaagaccctctacagaattccaggtttctctgtaaatctttctgttctctgatattgtggtctttcaactcttaactgctctgaaattcccagactctcagttgtatttcctcaactcactggcatctactacagttctccttataccatattctggaaactcttgcaataaactgctgtagtcatatggctgacctccattgtttcccatctctcagagatacgtattttttattcttgatgtccagtgtattaaaaaccattgtttctagttttgctattgttgtttcatgatagggagtaaatctagtttctgttcctctactgtcttctgctttgcattgtttttgaaaggaagcctgctgccattcctatcattgttccctcttacctaatatgtcttttaacctcctttatctgcttttaagatgtttatcactgattttaaacaattttattatgatgtaccttggcatagttttatattttgtgtggttggggttttttatagtttcattcactttggaaattatttaacaataagttttctctttccacctccatctacctttgggactccgattaaaataataataataataataataagaagaagaagaagaagaagaagaagaagaagaagaagaagccacttgtagttgacccatgtctcagtgattctgttttcaatatttttgtttttctatctgttcttcattttgaataattactctctcccctattttgtcttttcttttttatttttatttttattttttgagatggagtcttgctctgtcacccaggctggagtgcagtggtgcaatcttggctcactgcaacccccgcctcctgggttcaagtgattctcctgcctcagcctcctgagtagctgggactacaggcacgcctcaccacacccggctaatttttgtatttttagtagaggtgggttttcaccatattgtttcggctggtcctgaactcctgacctcatgatctgcttgcctcggcctcccaaagtgctgggattacaggcgtgggccactgtgcctggcctctttcttttttttttttttttcagacaagttctcgttccgtcgcccaagctggagtgcagtggcacaatattgggtcaatgcaacccccacctcagcctcccaagtaactggaactgcaggagtgcaccaccatgcctggctagtttttgtattttctctagagacaggttttgctgtgttgctcaggctggtctcaaactcctgaactcaacttatctgcctgtctcgacctcccaaattgctgggattgcaggcatgagccgccatgtccagcattgaataatttctattactctgaagtttactaattatttcatctacaatgtttaatctgccattaatctcatccagttgacattttatctctgacattatagttttcatctcttgaactttgatttggacctcttttactcatgccatatctctacatagtatgcttatgttgtcatgtgctttcggaatgttgttataacaattgttttaatattcatgtctactaattctgtcacttttttttaatctgattaccttggtattggtttttcctgattacctgggtattcattgtttcctcatacatgtgtactgaagactccaaaggaatcccttgcatatctcgagttctcactttccacctctttcttctccaagcagctctgtcctctccagtactctgccccagcatgtggtagccagcttggcctccctgaatggaaactacttgactctatttaggttcttccttcccgctctgcagcctgggaactctattcaaggtgtaagtttgagtaattgtagcgcttaccttattctgccccttctttgattattatccaatgcctgaaaattgtgttttcatgtattttgttcattgttagttgtttaagatgggaatataaatctgctccctggtccttcatagtggctggaagtgcaaatctctaggttgattttggtttttccctttttcaggtaactcgctttttttttcaagaatgcctaatttttttatttgaatttgagtctcagtctgttgcccaggctggagtgcagtgacacaatctcggctcactgcaacctccatctcctgggtttgaacgattctcctgcgtcagtctacccagtagctgggattataggcacctaccaccatgcctggctgagttttgtattttttttttttttttttagttgagatgaggtttcaccattttggctaggctggtcttgaactcctgacctcaagtgatccacccgccttggactcccaatgtgctggtattacaggcatgagccactgcccccagcctgaatttgaatttgataataactatgatttatctctatgcgaattctgtattgagttttcctcgaacaatgtattcattttaaactgtagatttcattcccagttaactttcttgtccccaaatattgtttctcctttacttgacctattggagtgtcagaaaatgatcataaccatcactgataaatgtgttatggggaatattagagtaaaagcagaaattccaagttgtggtgagaaagtacagtagaaccttgaacaatgtgagggttctgggcactgaccccttcgaaaatccacatacaatgtttacctcctcaaaaacttaactactaatagtagttaattggaagccttactgataacgtaaatagttgattaacacgtattttgtatatgtattatattctgtattcttacaataaattaagctaaagaaaaaatgctataatatcatatggaatgaaaatatattattattcattaagtggaaatggatcatcataaaggtctttatcttagtcatcttcatgttgagtgggctgaggaggggaagaagaggaggagtggttggccttcatgtctcagaggttggcagaggcagaagaaaatctatgtataggttgacctgcacagttcaaattcatattgttatagtatcagttgtaatcttaaattcatcttcaggttgatttagtgtcaaaattccctcaaatattattctagattctataaaatgttctagataccattttatcgcttaaaaataaatgtgaaagctctcagctaagatatagttgttcatctatgtgtaattactagttttgtaattttttgtaatttcttagtcacctctgcatagtgtttggattacattgtgagtacagtaggattttgtttagaaatctatgcgttatttcaaataacatctctttatgataggaaaaaaggttccaagtttgaaataacactgtgaagaactaatcaccatgcaagtttaggcttattatggggaaatttttaaactttaggtattaaaaagatttttaagaaatagattttaacaaactttcagtaccttgtgacttaccctgcgtaaacaaggtcagccaaatttgtaccctgtttcatggattagaaattaaacactataagtgaaagaataataagtcatatcttgtcaataattttgtgagagtatgagacttgtggtgagttttcctttagcactcatgcctattttcttttttaaattattttttcagttcctatgtcttattacaggtcttctcttttcctctcttcatttatttataactctgtcttgaccacttatatctgttttcggtctagaattttactactttggagaatgtggtttttgtgagggtagagttttcaaatgtcactaatgtttgcttctggaataagggaagtatgattataggtcagtagaagaaacatggtatgaagaaatgtacagccttggtggtaagcaatagaattcatacttacaaagaaacagaagtatatgtatattaaaggcaagtaagaatcactaccaaatgtttacattttacatctcctgctttgtttgccctataggtttttcatacctatgccatgagtaacaatttttcttagtaaaactttcatttatactcagttacaattaaatatctttatcagtaatctaaaagcaataaagcccttaaaatgaggtagtgtgataaattataagaaatctcatctaagaaatcatatgtttgaaattttacgtgtcagtaatgtggtttgtgtccattgaattaacaagttagaatgaatttataattaaataaataatttctatttttttaggatttggttatcttttggcagtatttaccaaaagacatggttacactaaaacgtgactagaaatttaaaaagattgctcaaaatttcatgctcagaatttagaacgtgccatctagtattctttgctctgtcatgaaaagatttgagaaagtttcagtgaaagtgaattaagttgttttgtaatggtaacctaatggaaattgaagtaatttttttttaaaaaaggtaagtattatttaggccaggcacagtggctcaagcctgaaattccagcccttcgggaggctgaagtgggtggatcacctaagatcaagagtttgagaccagcctggccaaaatttttggtagagaccagaccatctctactaaaaatacaaaaattagccaatcatggtggtgcattccttagtcccagctgctggggaggctgaggtaggagaatcgctcaaacccaggaggcagaggttgcggtgagccaagatcgcgccactacactccagcctggctgacagagtgagactctgtctgaaaacaaacaaacaaacaaacaaaaacttacttaaagtgatagctttaaaccttattcgaccatggaacaagcctttgtaacataatctatactgttacaataagtacactttggcagagtaagtgaactaatgatttttttttataatttaagctagtctgtgaatgacagttgattaaataatgtcacagctctttatatatagcattaaatagagttcaaagtatttttggaatttattaatttataatattcttctgtgattattaaagaggtgggatagctaaactttttctcaccttttatcattgttccaagtgcagttttgaactcgtatgtgttagaactcccattatattggtcaaatcgatgatcaccatatgactttattcctgcatttttgcctcaaatttttaactatcctattctggactgcttcattaacttcattagggattaactatgaatgtttaagcctttattttacaatgtccttgcaggtgtccttaactgtttcatttataaacacagagaataaaatgaaaaaaaaatctgtagagttgtttgttctatttggagcttttcatgttggtgtaaaattcctgacacttaacacatatgaatctttttcattcatgtttaataattttatttgagagtcacttcaagtaaagcccaaactgtgttaacatttgagttaagcaaagacatctttgcttaacaataaagcaaatatcacaataaagcaagtcacatgaatattttggtttctgaattcatataaaagttatgtttacactatatggtactctcaagtgtgtggtagcattacatctttaaaaataaacatactttaattaaaaatactttgttgctaaaaaatgctagtgatcatctgagcctttagcgagtaataatctttttgctgttggagggtcttgcaccagtgttgatggctgctgactgctcagagtggtggcttctgaaggttggggtagctgtgacgatttcttaaaataagacagcaatgaagtttgccacatcaattgactcttctttcataaaagatttctctgtagcatacaatgttgtttgatagcatttacctacagtagaacttctttgaaattggagtcagccctctctaactctgttgttgctttaacagttatgtttatgcagtattctgaatttttcgttgtcatttcaacagcattcatagcgtgttcaccaggagtagattccatgtcaagaaaccactctctgtgttcatctataagaagcaatttctcatccattcaagttttatcatgtgattgcagcaattcagtcctatcttcaggcttcacttctaatactagttctcttgctatttccatcacatgtgcattgacttcttccactgaagtcttgaagccctcaaagtcatccatgagggttggaatccacttattccaaactcctattaatgttaatattttgaccacctcacatgaatcgtgaatgttcttttttttttaaacagggttttactcctgtcactcaggcagggaagtgcagtaacaatcactgcacattgcagtctcaatctcccaggcaagctcaagcaatcctcccacctcatcatttattttatttttgtagagacgaggtctcaccatattggccaggctggtctcgaactgctgggcttaagtgatcctcccactgcggcctcccaaagcgctgggattgcaggtgtgagccaccatgcccagcccatgaatgttcttaatgacaactggaatgatgaattattttcaggaggttttcaatttactctgcccaaacccatcagatgagtcactatggcagctatagccttatgaaatatattacttaaataagatttgaaagtcaaaattactcattgatccatgggctgcagaatgaatgttgttttagcagccgtgaaaacaacattcatcttcttatacgtctccatcagagcccttgggttaccagatgcattgttaatgagcagtaatattttaaagggaatctttttttctgagcagtagatctcaacagtgggcttaaaatattcagtataccagctgggcacagtggcttatgcctgtaatcccagcactttaggaggccaaggcgggaggatcacctgaggtcaggaattcgagaccagcctggtcgacatggtgaaaccacatctctactaataatacaaaaatgagctgggcatggtggtgcacacctgtaatcccagctactcaggaggctgaagcaggagaattgcttgaaccctggaggcggaggttgcggtgagccaagattgcgccattgcactccagcctgggtgacaagagtgaaactgtccccaaaaaaaaaaaaattcagcataccatactcaaacaggtatgtgttcatccaggctttgttatttcatttatagaacacaggcagagcagatttaacataactcttaagggctctaggatttttagaatggtaaatgagcattgacttcaactgaaagtcaccagctgcattagcccctaaaaaaaaaagagtcgtcctatcctttgaagcttcgaagccaagcatttacttctttttagctgtaaaagtcttcaatagcatcttctgccagtagaagactcttttgtctatgttgaaaacctgttgttcagtgcagccaccttcatcaatgatgttggcaagatctgggtaactcttcagcacctgctattttaccttgcacttttatgatatggagattgcttctttctttcaacctcacaaattagcctctcttagcttcagacttttcttgcacagcatcctcacctctcagctttaacagaattgaaaagagttaaggttgtgctcgggattaagctttgacctaagagaatgctatgctggtttgatgttctatacagaccagtaaaactttctccatgtcagcaataagcttatttcactctcttattcatgcgttcactggagtagcacttttaattttcttcaagaactttttctttgcattgagaacttgcctgtttgttgtgagaggtcaaactttcagcctgtctcacctttcgatatgccttcctcactaaactcaatcatttctagcttttgacttaaagtgagagacatgcaactcctcctttcacttgaacacttagagaccactgtaggattattaattggcctaatgtcactattgttgtgtctcaagaaatagggaggccttaggagaggtagagagatggggtaatggccagctggtagagcagtgaaaacacagcatttatcagttaagttcaccatcttctatgggtgtggtttgtggcatcccaaaacaattacaataataatatcatagatcagtgatcactataaaagatataaaagtttgaaatattgaaagaattaccaaaatatgacagagatccaagcgagcacattctgttggaaaataatgacaccatactcaaggcaggcttgccataaaccttcgatttgtaaaaaaaaataataaaaaggtatctgtgaagtgcaataaaataaggtatgcttataccaaaacagacttaattatgctatttcttaccattagtgttagagttcagtttctaatgtttttcattttccatatgttattgatgttcagtgagttacacaaattatttactgttgttacttccaccttagtagggagaatctttgatttttgctggataaattttcaaacaagagtgtgattataggctggacgtggtggctcacgcctgtaatcccagcattttgggaggccgaggtgggcagatcacttgaggtcaggagttggagaccagcctggccaacatggtgaaaccccctctctactaaaaatacaaaaattagccgggcgtggtggcgcatgcctgtaatcccagcacttgagaagctgaggcaggagaatggcttgaacctgggaggcagaggttgcactcctgcctaggtgacagagtgagactccatctcaaaaaaaaagaaaagaaagaaaagtgtgattacagagatcctatttgtgtttatttttaatttctctagaatttgttttcttcaataaataaaattctaataccagttttttttgagtaacactgtgatttttatacagaaagactttctccaaattggagaatgtactcttttattcctgtaatttttcttaactcttatttttggcagctaccaaaagtaaaactctctaccaagacagagaagaaatctttgggaatattaagtaatgttatttttcattacacggactaacctttttactaagaagaattgggatagtattggttatgggagcttaggagccctaaagataaagattggaagattttgtgttgtggacttgtggcactgtaacaaagtctgggaattttatgtgagattggaaaccacactatgtgctaattgcctcagaatggtaagaaaataagcatatgtatagcatttagttgttaagacagtaggcacttatgcagagccccaaatgaattaacaaatcatctactgaaatattttcacttctgtttactttatgtattttagaccaatcagcagttgcttgagaaaatgaaatgtttactaaatctctttaataaacatgtttaagagaggaaaaacttataaacattcagatggcagtgtacatttttaagtgctagttgtcatatctttgaaattgtatgtaaactggacataaacaatcaagtgtctacagaatggtatctgtcttccaatatatttactgaagatattatagaatctttatagtttaatatgatttaccccacatgttctgttgttgctatcttttcagataaagttgaatttaatctttcttatcagcttttattgaggtatttatgaaccattgagttcacccacttaaaaaatatcattcagtggctgttagtgtatttacagagttctgctaccatcactgtaatctaatgttagaacattcacatcaccacagaaggaaatgttatacccatcagtagtaatgctccataccccctggatttaatcttatatccacatctctcataatagtttcagtggtatctagttattatgactacaaatgatgcaattgttcctgattacacaaataatgtatttatgtctttattgttggcatgtaatggaagacataataagtctgctttgatctcttgctcttacctatttctctattgcaagtgttataaagagtcttttaagcttttgctcatatatataaatatatatatacatacatttatatatacacacacatacatatatacacacacacacacacacacacacacacacacatatatgtaatgctaccgtgtttgagggtcatgagggtcagttttttgaaataccagtttttttctgatttaggtggatgacatggtacgtgaagcttaaaaaaaaatttggtaaattggtatgaaaaaatgagaggacaacgtttttcctttctggtacttagcaggaaggcaagttcttgtatgaacccatatttcctgttacccattttcagaccaatattggtttctcatctatataatagggatcttttgactctaacctcttaaatctatcatgtgttttctttcttcaccttggaaatagcttcttgaagccccagacttctagagcacattcatattaactaacattgtcctggtttactagttagggatattagtaaatcctaaatagttgaagacgttctgaaagatatattgctgctttttaaaaatttatttatcttgttctctatacggatttctggcacaaggttggtttttgtttttgtttttgtttctgttttttttttgtcaattgtggtaagtccatggatgcttttctctataactttcccattttcccttatcacaccgtcactgcaaacatctaatttctgtccagtctctcaactcttttcagctctgctgtcctaactaatcattttttgtattcatctttcaaagtatttgtttctgtcttcattctataagtaacaagattatttaaggttattttgtattacagaaatagtaaaaatcaaataaaatatcaaatgtagaatagtccaccaaaaatattttatttcatcttttccagagaggtacacatataataaagtaaatgagcattatatattttattattaatcctcaataatatatttttcacaggtatgttgcttcttgtaagtttaccttttttaatgtgaaaactacaataaactaaattaaattttaaaaatattttacttactaaagtcaactgatgttttcctggtagattgataggcttcttgtggtagcttttaatcatttgcaagttttgagcccatttctaaaacttttctcattgtaaatatgtatttcctttcttatattaactgagaatttgtttttataaaaataaagtggggaatcagactcaaggtgaaatgttgtagacttagtgccagcaataagcagaattatttaaaatcattcaaatatctttaattcccttgttgtctttttcaaaaactgtacattttaactacattaatataacggaagactttttaaggcttagttttcctttatagatattccctaatttcatttttatttcagtctgtcagggttgtgaatgtgatgttttaaggtacactgtagtgttttcacatcctcagatgaactgaattgggacaatactttgtaggaagttttttaatatagtatgtagacacattggtaaaaatcagtatgtccactggcttattagtttcacagatgcttccataattcttagtgtactcttgggtattttaaattatcatttcctgacagcaatcctgaaacatgccagtcttttaaagccttatttctgagaactaaagcaaggcatcagcgaaccatatctgacatgccatgttaatttccataactatcatttctgggaggtggtaggatttctaaggcatggagaatctcagtaaatctactttaaaaaaaaaaaaagcaaaatatctgttttattactgggtttccattcacgagccctgactgcttcattcccacttaaataatttcaaaaatagtgataagcatattttttctcttatagattattaaatatttactcacgtgcacaatatatcaaaacatattttgaattctatattcttagtgttgggtgttcatgttgtgaatgaaaacctcattctgttatctcatagcatatttatatatacaaataatttttgccttaagtaggaaagaaacagctaaaagatacataggttattttgctttttaaaattttagcaaactattctgtgaatcttttgtgtgtttggggctgtttgtagaggaaaatttcatcaagcaacattttgggaacattggccttttgtactctttcctaaataaacagaaacttgtactccccaaaataaaatgtttctttgtatattgttacctgcaagttattgataatggaaggaacaccttttcaatccttagtcccctttcccccaacacagcttttagattgtcgataaacttcccagctcagtaattaactgagctcagtcattgcaccctgtatcatgtgatttttttttccagtggaatacattattagagcacttacacagccagtctagctgcagcagcccaggcggcaacagcagtgccatttttcacaaagaaaatgttgaacaggagccaaatgtttggtggcagtctgttgctaggaaatcaaggtcctgaggcgattaatgacaaagcaagcaataacaagaaggcagaattacagatttaaaagagaaaaaagtggttggtgttataattacccaaagaaatccgcactcattaaattggctgtttttatgattgactttaattggaggttagctcagatatttagctcctttcccacccctttaaacacacacaggcacataatctgtagaactgcagacttgtttttctaagcattgagaggagcttgccctgtaatttgatccccactgacagatgcattttctatgctgccattttgaattaacctattgtagaacaattttcttcagccctgttgaataaaacatccagtctgattacctccgatggatttgatagagtaaaagaatgtacttctcattgaagtagattgtttgcatggactctactgattgtgaactctgccagtaagcacaatcatttgtaataaattttcaaagaaatttgtgaggaaaaggtaatgagagtcacccttttatagtttaatgtttggcacctccatcaaaataatataattcttataagacagtgttatttttccagtaagcttttcacgtggttttagaaaaaatttctgaatcttcatttggactattcatatatttaggaatagagtcttgtatttacactctaaaatgaccattcttcctccccaacaacagtattttagtgcaagactcaatatgcaaagcactctattgcaaaaatatttttggtatgtacaatatttaaagtgattttaagattggcctatttcagtctttgaagtatttcccccccccaaaaatcccttatttaaattttttagggtgtgataaagcatattactagaaaagcatcaatcggtctttcaggtacaataccagaggaaccatcacagtttatttacctttcagaagctttaaaaataaagttacatgatgcctctgctctccagatttctaatcaaaccctggaacaaaagagccaagcacattctatctgacaatgcacacactgctaatcagatgccaatgccaagctgtctgctttgttaaatacttagcttcctagaggcaggaagacagctgctataagtatgatgaaattttgtagttcaatctatttttgctacccttgggctaccaagatactgttaatttagaccaccccaattggtacattttagggagttttttaaagagtttgtaattaaaatgataaaacatcgttattacattgaagaccttctgtaagttttacatttggcagatacctactgagataaccccagcatgtaatttacaatgatgtaatggttgtaattgcattttagaaaaaaagaactataggaggcaagtgcttccattagaagagtttttaaatctgcttctgtttcatttaaatctacttctatccccaaattacttacttataattgactagagcagctataaaccttaagatgctatctgaatatttttaaaaagttatcaccccagacactgccaccagggggaggaagctaaaatcttaaagttcttaactgatgatgatactgccagtaggtagattatattgcttagccctacatagttaactacttcctccagataataccgccttttgggacatgattctcacaacctgtaatatgtgatacctgtagacttagcacactattaattgtaaataaaatggaaactttcgtactctggtggttggggtcaggaaggggaaagaggaagtacaaataagcaacctggacatttttattgtttttctcttatctgttagtctacttgaagagctatccttgaaagtgagtgctttagatctatgaaactgggcagctatcatagcacatctattaagatctaataatcacataattaatgtagcaaaatgaatagactgtaaggtagttttctattttttgttactacactgtggttttgtttttaataaatagttttggctttattttaaacaattaaaaattcaaaatatttttatgaccaaagcttgtaggttctatccctggaaaatattttataaatgcagaaaatagttgcttaggattggaatccaactctgtttaccatgaacaacttaaaagttgatctcataatcttgcatgttgtggaataataccacgaaaaagttaattaaagaatttagatgtttgttctcctgtctagaactcaataacttttaagtagtaactctccctacagtttaactgttaaacagtaactcttctgacagttttaggttttattctgtgaagactcatgatttttaatttttgcatcttaatttttcagttatttcaggtattgaaattacaaacgacgggaaagaaaagtggttgactaaaaaggggatacaaaaggcaatttttagggcgatgtactgttctgtatggtactgtggtggtggatacatgatactatgcatttgttaaagcccaaagaactgtacatcacaaagggttaattttaatgtatgcaggttttttaaatgttagggatttcaggatagaatgcaagctgtaacaaatgaatctaattgtattacaaatgtatggcataacttcactgaatgggtgggggaaaaggagctgacctaagtaactttggaaaatggtgttttgattggacaatgtaaagctaaagactaaggaacactatagaaacactctattctagttggtaaatttgtttctcataacggtatgggtgaacagttctgaacctctttacatgtatcctggggttgaacaaataagtaaatggatgatgaatggtggaagctaggtttctcactgtcaggaagggatgttacagataaataaacaagaggggagagccagaatgaaacctgtggtactggattagagttggagatataagtatttactcatgtttagcttaatatatgcagatggatagatgcagaaataattatagatgcatgtgtatatgtggattagtatacatgcatatgtttcctagctgtgtttactgagaaggcctagaagcagtgatatcccagtagccacaaacacatctaacgctcacatcctggtttgtaaatcctattctccaataaaaggatccaggactccttttaaatatgactgattctggggctggtgatgggaaaatacaacataagcatggaatatcttgtagtgccagaaggcaagagatttcttaaaaataataaagattaagcatgccaaaagggacacatgagccaatgtgaaagaactccgagtggccgtagctggaataattagagcaacaaaataaaacatgtagcattggattaaggataaattattgagtaaatatacatgagttcacagtgttatgtataaattgtataaataagtaaatggaggagaagagataaatctccctgacagaagaattccaaataacatattgccccctccagaagggggatcctacttcccttctccttgagagtatgagctggattgagtgagtcatatccaaaaattgagtttggaagacagcgaaatactgacttgactatttccattggagaaagctggtaaacaactatgttaactaagtgatcaaggttaacatcacaaatgggaagtcatgctgatgtgaagaggtggaaacttcatctctctgatattctttccctaaacctgtagcctcaatctaatcattaggaaaacatcagacaaatcccaactgatggacattctaccacataagttgagcattcctgaaaactgtcaaggttgtgaacaatgaagaaagactatgaacatctcactgacaagaagagactacagagtcatgacaactaaatgttacatagtttcctggatcaggtccagaatagaaataggatattagtgtaaaaactggtgaaatctaaataaagtcttgactttagtcaataatccaccaacattggtttcttggtttggccaaatgtaccacagtaatgtaagatgctaagatagtgacattagaacaaattggatgaggggtacataggaagtctgtatattaaacttgcaatttttctgtatatctaagttcccaaatataaaataaatttatttgaggttgatcaatgggctgactatattgacaagatactgataggttacatgttgaagaaaacatacaatataaaatagagaaaaagtcagttccatcccttcccactccccctttacctacctgctccccagtactcatcattgtgatttagtcagaacagggtttagtgccagaggtcagggtgactgagggtggaggagttgtgagcaatgggttcatggctgtcacaataatgctgtggcaattctatggtttcccagctgggagttaggagtggggagggggctgcagcctgatgacagccagctgaaggaagagctacctctcccttccctagctgctcatcacctgaacccaagaccacgccaaacaagatatggatgtagatgctcttgctgagtctgttccgcaagagggaaagaaagggtagctgctccaaacacgccgtcctcatatacaagggtgaggggaacagaagcatgtggctgctaccagcaaaggaaaagtaggagagcaatagaaaggggaggaaatgggaagagcagaaaatcaatattatttaaaaagtgacctaagacttaaaattgaattagtatttgtacagaaagatgcaggtggaataactcactctggcctgtgatcaaaattatatggagaaatcatggtgggccccttcctctgtccccagtggtggcaccagttgctgagtgtgattagttagaatggattccagtctagtcgttcaggcagaggaagtagttgcagtgggcaggcaagaggggctcagttgctgcagcactggctcttgctggctgggtggttcttctggaggtccgtacctcagttttggcctggagcaccaggtgcactctggggcttattaggaatcttcttagctctcgccgtgtaaacttcattcacgttcattgcagtctttactgatgtctccatagtcaactgtcgtcgtctgcatagtcctgtgcttcgtggaattctggggctttcttgctggccaggtctgccttgttacccacaagtacagtgacaatgttggggctggcctgcctctctagctccttcacccatttcttggctggtgcaaatgtatcttttttggtgatttcatagtacatgggggctgggctatgataccgctcctgtccagcgctgccccagatctcaaacttgactattgtgtcgtctaagcagacagtctgtgtaaggaaggctgctctgattatgctctcctggtactcttgaaattgtcccttgacaaagtggaggacaaggctggatttggccaccatagactcattgttcccagtggctggtccaccaggtcgtgtgctgtgccttgccgacccgccactacccgtccagctgttgtgataccagagagcatggggacgggagccattgctatgcaaagaggcacttagttgggaagggggtctccaaaatgacgcaagggcagtagtattacttggggctggggctcacacaggctccgcttctctccccccacccctggtggtatctccatataaaaattttacttaaacgcagagaccatatatgtacttaaacacttgtctaaagaaataaaatatggccgggcatggtggctcatgcctgtaatcccagcacagaggccgaggcaggaggatcacctgaggtcaggagttcatgaccagcctgaccaacatggagaaaccctgcctctactaaaaatacaaaattagccgggcatggcagcacatgcctgtaatcccagctactcaggaggctgaggcaggagaattgcttgaacctgggaggtggaggttgcggtgagccaagatccccgccactgcactccagcctgggcaacaagagcaaaactccgtctcaaaaaaaaaaaaaaaaaaaaaaaaaaaaaaaaattcccctgcctctctccaccccagagggtaaccattatcctaaattttattattattattcacatgcttttctttataggatagccatacatgtatcactaactgttctaccatatctcataacctcttatatagtttcccttttttgtcatatttgctgtgttctggataatttcttcagatctatcttccgatattggtaattgtatcttcagcagtgtctcatattctgttttacctgacattgaattttatgtaataatcattacttccattttcatttcttcccctgaaatcagtttactttatcattttgataaactcatttcattctcatatatacaatcctcttgtttatttaaatatattaaacttattttctattttgtgcctagcctaatatttaaagcttatgcagttctgattttgctgtctgttgtttctgctggctgttactcaaactgccttattttcctgtgtgttagcttgtattcattatttgtggtgatttctgagactgagatgaagatacgtttccaaagagagtatttacatttgaatctgccaaaagcctggggatactgtcaacctgggaacacattcaaataaatgttgggcttaaagttttgtgggctgcataggtaacatgagttccagatccataaaccttcatgagggtgggcttgtggttaaattttcagggaagatgtatttacctgcacccagcatcaagtttgaaagaggttaatttccttgtttattccttctgtagggtagacatcattctattcaactcttacactaaacatgtatgtagctctttaggatcccaactttatgtggagagtctaattagacttcgtatcgttaatgtaccctagaatttatcccctaaaccttgggttcagtagtgtcctggtaaatattttaaagctggctgtccagggcaaaaaaaaaaaaatcctaatttctcacatttttctatttcacactatggctgatttcacgataccagcctgaagtcattgaacgtggagttgggaaaagatatgtacagttagctttctcaactccagtgtatcactgccagttctgtacatggctgtgaaaactgaagctcaatgcacagggcttggcatatccctcagaatgaaagaatctgagtgtttgcctacccctctggatttccatttttactttgttttaaccttttgagtattctgtgtcaactcagcaatatacttcaaaaaaagattcttttgttttctttttattttaacccagcatttgttgttgtttttagcaaaagtcctgtgttagggtacctatttagtcagaaatagaagtctctgtgcttgtttgtaagtataatgtattatttttctttttggggaaatatagaaagaaatagaagtctctgttcttgtttgtaaatttaatgtatttttcttttttgagaaatagagaaaagtacagagaatattaaaacacccataatcctatcatatatgttcattttatgtgcatgtatgtctctatacatttttatataatttgcattatatctactatttcagtatatgatttttgttaatatataatgaatgtttgctcatgccgttaactattcctttaaaacagcccccattatatatgagactaaacataaaatgctgcacacataggagttagtataattcagaaatttagtctgtattgcatttggaaataattttgtgaaggttattcatgcagcattattaataattgcaaaatattggaaaccatataaatgaccagttctagaagattggttgaatatactctggaacatacaatagactactatgtttataaaagctatctgtttttataaatatatggagtaatttccaggaaatattacatgaaacaaaaagcagaaacaaatacccatagtgctacttgtcatacaagaaaaagggagaattaaagaatgtgtatgttcaggaaggataaagcagaaaacagtaaaattagttacaagaggtagaagggagagtgaggtggaagggatgtgggagggagtgagacttggatattggggtatactttcttggcatagtttcaacttttgaaagcatgttaatgtccaacatattcaaacagttaaataaaaatgatatcactgggacagggacctaaaattgtaaacaaacaagtgaacttaattcatttttttttcttatttttttattattatactttaagttctgggatacatgtgcagaatgtacaggtttgttacataggtatacatgtgccatggtggtttgctgcacccatcaactatcacctacattaggtatttcacctaatgctatccctcccctaaccccccaagcctcaacaggcccctgtgtgttatgttcccttccgtgtgtccatgtgttctcattgataaagttaattttaaagtaaaatgaatactatatccataccgaaaggggataaagaagaaagaaatgaaggaagaagggaggacagatttatgaacaccagattcaactatatgtccttagcttggggtgggtgggagagaaatgaagaattgcaaacaaatcctgaactcacttttgtaggtttattttattttattttatttttttgaggtggagtctggctctgtcgcccaggttggagtgcagtggcgtgatctccgctcactgcaagctcgacctcctgggttcacgccattctcctgcctcagcttcccgagtagctgggactataggtgcccaccaccacgcctggctaattttttgtatttttagtagagacggggtttcaccgtgttagccaggatggtctcgatctcttgaccttgtgatccacctgccttggcttcccaaagtgctgggattacaggtgtgagccaccgtgcccggcctataggtttattttaatggtatgggcaaactaaatcagagactattttgagcaaatgagtgagcctggtttctcactatggaagaagggacaaacatatagacaggaggaagacaggtaagaattctgtgtagaggaattggattggaggtgtctgtgtacatatggacatttctgtgtgtgtatgtatctgttgatgtgtgtgcatgtatttttgtatatgtatatgtatgtgtgtgtgtgtgtgtgtgtgtgtgtgtgaagagacattcatatatttcttagctctattgctgaaagagcaaaggagcgaagtcacaatagtagtgacacacctagcgttatttcccactgttagtttcctaaggctgctgtaataaattaccgtaaacttaacagaaatttattctttcatagttcaggcggccagagctccaaaccgaaggtgtttgtggggttggttccttcttggggaggcagagggagaacctatccatacctctctcctagcttctggtggttgtgcataatccttggagcttgatggtttgtgacattataacttcaattcctgccttcattgtcatatgacattcaccctatgtttacctgtccaaattttactctttttatcagagtaatccactcattagggccgactctaattcactgtgactttatcttaacttccaaagaccccgtttctaaataagctcacattcacagggttagtacctgattatgactttttgaggagcacagttcagtccctaatgcctactaaaactaaagctcttcactcaaatgactggcttcagtctggggcagggtaggtacaagatgaacctagaacatgttgtaatgccaaaaagtaaggaaatgctaaaaagtaagataagttgtttgttaagtatacagaatctagcttgaagagttccccactggtcaaatctagggcaatttgagcatcaaataattaaatacagtaatgaattataagctgttggaaataaagaactttataagaccattccaatcactaatgggtggatggatagaaaatgaagatattttacttacagtggcatgctgaaagttgaccagcaaatgtggaggttgtgctagagttgggaaaaaacaaaacaaggaaacctcattttgcagtcatcatgttaaagattagatcaggcaaaaatcatcaatggttgtaacatctaagaggacagacatgttgatgaagaacagaatatttacatggtcttgaaatgttgtatgggagaagagaaaaacagcaacaatgcagtggagaaatcagacaacacattgacagggtgatcacaagtatcacctccagtgagagtcaaatgaacattgtttgcctccttatgtgtttatctgtccctgagaagtacacaacatcatctatgcagtttctggcccagaatgcatctcaactcaatcacaagagaatattatgcatacatacagaaaaagaaagaatacaactgaacatagatgataaagaaaatgaggtaaaaatgtgacaacagatgaaaatggataaaggtattttctgtgtttttatttttggaactttttgtacattgaaatgattgccaatggaaaagtttagataaattgtcctaaagttacagagaacttgcagggaaaaacatcttaaagtagactaatagtggagagtcataaaagacacttggcaaatcttcttagttgaatattattcaaactattcagtcagggaactgattttgtgctaattatgaaatgcattattgcattgactttatgtctcttacaacattaaattatgttacctaggatcaatttgagattcaacacatgatagtagtttaatacagtgaagtcataacttgcaacaaactatcccaattttaagaattaattctgagcaatttttatatgcatgaaaaagatggttagaattatttgcagacacttgcatattctttagtcaagtggtcttattaccataattcatatctgttgtgggagtagggaagaaagagatttaaaaaatatctatcagttctttcaatcaagttaggtataatattaatagactttgagctaagaaagttttcatgaccagaagaggagcaggaactgtctaacatagaaaatgtttatggtataccataatcagttatacaaatataaaaggaaaaaatgtttgactagtgatactctcaaacttggatatccagaagagtgattctgtcagtacactaaaagcaaattcatctatcaggagctttcatgttttcattcaacaaatatttatccagtgcctattatgtaccagatagtgttatactgtgaatcgggagcatatgttaaaatagacaatatagtagacattattctctaaaattattaacaatagtagctaatactcatatgatacttactctgggccacataccattctaagatctttacatatagtaattcctttacctcaaacaaccttattagattggtactattattacctctattttattgatgaagaaacagaggcacggaggtgttaactttctccaggtttcacagctaaaagtagcagacccaggattttgaatccatcagactggcttgtgtccaagctttttttaattaattttttttattttgacataatttgtagattcacatgcagttgtaatataatacagagagatctcatgtactttttactcagtttctcgaggtaacttcttacaaaactatagaaccatatcataaccatcatattgacactgatatagtcaaggctccaaatatatctgtcaccacaatgatccttcatgttgcccacccacttccctctgttcacctattgaaagacatcttggttgtttccagtttggagctattacagataaagctgctgtgaatatttgcacataagtttttgtatgaacaccaatttttggctgggcgtaatggctcacacctgtaatcccagcattttaggaggccgagatgagagaattgcttgaggccagaagttcatgaccagcctggtcaacgtagcaagaccccatctcattttataaaaataaaaaattattttttaaaaggaacatcaattttcattactttagactgcctctaagcttttaattcttacattctaccacctctcaatatatagtagggaataaatagtagagaatgacttgatggttaagttgacattcagaagaggcctgaaggaagtgaagaaaaaagccatacagctgtttggggaaagcacatttcaagcagagggaacaagcacagaggccttgagaaggaaatatgcctagagtgtttgagacagagcaaggcggctggaaggagatgagttctacaaggcagctatgagccaggtctataagatgtggctgctatatagaaaatagatggtggttgggcaagtgttgaagcatggggaactattaagaggctgcccatcggagcttgcagtgagccgagatcccgccactgcactccagcctgggcgacagagcgagactccgtctcaaaaaaaaaaaaaaaaaaaaaaaaagaggctgcccatgtgagagatgatggtagcttagacttatggtggaagtgttaaagatggttcagattctagatatgttttgaagaagagctcacaaaaatttttctgatgggctgacagttggatatgagaaaaggaaaggaggcaagaatgattccatttaccaggttccaagagaatgattacagaaaccaatagattgccttatttatttatagtaggaaatgtagttatcacatcggcccaaatgtttgtgtctgcttaatccgcatatctgtttctttaggcaaacttgcattggaatgtaatggcgactgcagaatcaggataaggggacttgaataaatcagtctttaaatgcatctgaggccgggcatggtggctcatgcctgtaatcccaacactttgggaggccgaggtgggcagatcacttgaggtcaggagtttgagaccagcatgcccaacatggtgaaatcttatctccactaaaactacgaaaattagccaggtgtggtagctggcacctgtaatctcagttgctcgggaggctgaggcacgataattgcttgaacctgggaggcggaggttgcagtgagcctagattgtgccactgtgctccagcctgggcaacagagcaagactctgtctccaatcaatcaatcaatcaatcagtaagatacatttcactccagcctggacaacagagcaagactctatctcagtcaatcaataagatacatttatctctttagtagggacctgaaaaaattaaattccatagacaaaaggctttctgagctcttctttaataagtagtgttggcagatgcagtggctcatgcttataattccagcactttaggaggccaaggcgggaggatccctgaggccaagaatttaagacgagcctggtcaacataacaagtccctgtctctaccaaaataataataataatatttagacatggtggcttgtgcctgaggtcccagctactcgagacgctgaggtgggaggatcccttgagcccaggaggtcaagcctgcagtgatccatggttgcaccactgcactccagcctgagcaacagaatttttatttttatttaaaataaaagtagcacaaacatttgcttttgtttctctttcataatgcaccaacactaccctaacccccaacataatccttttgtagatttgttaatatattcagacaggccatattccatatctgatcctacttagtggtttgatggttggctaaaaggcagtattaatatctgttatttccatgctattgagggatatctcacattgatcatccttgtattggcaatagaaataaatggtgatagtatttttttcatttagataaatttagcactgctcttagtattattgaaacttagtttaggaatgtatcatttatctataatcatttattgctgaagtgaacccttctttaaattttcctcttccaaatattgatgtagttctttctttcttcatcagttccatgcatacaattcaattttcttcatgacacgggatcatcatctataacgtctgttacttataggactattctatgagtctcttcaagtgtatacatgtatttgcttttattttaagttactcaaattgttatatattttgagtacttatatatacattttaataattttactagccctggagctggtggtgtgtcatcttcaacttcctttttaaattccttctaatttcttagggtgggaaaaatctaattcagtagattgaatttttagaaaagagtagataaactgatgtctaaatatttaggtatttgtctattctggaacctttttgcttcatgatttttcttttttactttgcattcctgagatttcctttcatgaactggaaggctttactttactaagtgactcagcagtagctctatgtatcttttagttggaaatgcctttggctctatgcatgcacacactgcccattaattagcaaaccaacatagaatcatctgttgatgacaaaattaccaaaatggatcatccataagtgtttatactgcaaacagtgtatcagaaatgtcataatctcattcattaagaaatttacatacacaccagattttagagtgctcattcatgatgaatgtctacttccacactgtttgtttggaaacattcaatagccagtcttgaatttaaaaaatttaattgaatgcttaaagaattacaagtgttcctttccttggctctaatgctaaccaaagtgcttttctaaactgctaagaatggactgaagattctgctgagggctgtagatacttatctgcctaattgagccatcatttgttgacatgaagaaaaccacgtgacctactttaatgcatttctcagtagcagcaggaggctagaatgtagttcatccaacagtaaaactagcagcagtattattagacatgtgaaaatagcattggttatgggattagttttgtaaagtaaggatagtaatataaaggtatatagtcataatataaacagtatagagtgatttttttattttcaaaattatttgaatccaataatcatttaagtcagtcattcagtaactatttaccaatgtttacagttgccagctatattaaaggaattgttgacttgtcaaagttgattcatatgagagtaacagtgttaaaatctgaaactggtatggattgctaaaacgaaatactttgagtacacagggaattactatgatcaaaactatgctggatacattaatttgaccatgtgtctttaaattggaggtgaggaagattagttacagatacattaattagaaaggtgttatattagtctaggttgaggctgatataagtaagaaagtaggaaaggatgcaaaagcccttggaaatgaatatttgtgtgtggtgaagtaaaatgaggtagaggttacccttttacatgacttgagagaatcatggctcatttagtaaatccagagggagaaatgattttctatatatataatgagtttggaatacaggaagaatgccaaaaataacatcttaaggaattcttcctaaatagtgaagaaagaaattagtatcaacagaagagacagaaaaggatggttatgaaagataggaggtcatcgctgtctaaaatgactgatggattttgattacaccactggtgatagaaaaaaaattattagagaaaagtgtagtctgagaactatttgatcttagtctgtaatgaatgaaatataaaatttgagactatttggaaactgtttaacaagtttacacccccttccagcaaatacaaaattacaacaaatttaaagatgttaattggtttttatttgcaattctaaaatcggacaacaacctcattctattaaatagaatgaatattccagtaagctgagcagaggaagttgactttatagacagaaaagggctgaggaaagcaaaaacagaaaacaaaatgtggattggtatttccaaaattacttttcttataaaggttaaagcagaggggacttccttataccagctaaaactggtctgtttggggatctggctattatctgtttctcctgatttcttggaaagtaagataaacaactatgttttagcttagtgatgtggaacttcagcttgagtgactccattttggtttggtctggtgggcctagtgcaggagcttagtccaaactaatgggatcctatacattttgtttaacactgccaacatcctggtgcacgatcatcagatttctcattgaacagggaatggatgactttgaatgttggagagcacctgtggtgagttgtttatatataatctgtaaactagttatgcacagtagcactatatatgggtctatgttggactagaggataaaaaataacttggccttcacctcagagagtttaagaatcactatgccaccagaaagatggtagtagtaggcacattacatcgagtgaagactgttgggtgagagggaaggtttgcttaaagatataagagatttgagtttgtatattgtctaaggaagatatgatagaacagaagactgataatgcagtgtggaagagtgataactgctagatggaattgagatcaaaggtttatagatgaagactttatccttggaaaaatacatttacatttatttaatgtttagtttttaaattagatattatgtaacttgagcctcacagtaatccaatgaattaggtgacatatggttggtataattcatccgcctttacatttaagaaaattgagacacaaaaaatgttgtgtgttatccacagtcatgtggttagtaaatggggagatattttcatgcccagttctatgctataactactattatgtctgaaaataaaggcagaaaaaaatacttgaagaaaaaatggcaaaaaaccgcccaaatttattgaaaaacatttgtttatacatctaggaagctctttgaacaccaagtacaataaatgcaaagagatgcacacctggcctcataatagcaaaatcttgactatttgacaaggacaaaaggaaaatcttaaactcagcaaatcacaacaggggaacacaaaattaacagcttacttctcaccggtaccaatgaagccagaaggtaatgagataacatatttaaagtgctgaaagaaaaaaatcatcagcaaataaccttatgtccagcaaaaatatgtcaaaaataaaatgaaatattttcctagataagcaagtctaagagtgttcattgctggaacatctgccttaccaagaaatactaaagaaaattctttaagctgaaattaaatgacaacagatagcaatttaaatctatacacaaaaaacaaagagcatcaataaaggtaattatgtaagtaattacaaaagacagtataatgacatatttcttcactattctctcaactcatttaaaagcaaatgcatacagcaatttgtgtataattgtatttaggccctatgacttattagaatgtaatgtatatgatgataacagcagaaaggaggtgcatggcaacaaagctctattggagtgagtaagaaaaggacaccagatggtaaactaaattcacaagatgaaatgaagaaaaccagaatggtaaataagaagattaatataataaactctttaaatgcttgtagtcctagctacttgggaggctgaggcaggagaatcgcttgaacctgggaggcggaggttgcagtgagccaagatcatgccactacgctccagcctggaaatcataaggaatagaaaatatatttactattcattaagtggaattgaatcatcataaaggtcttcatcctcttagtcttcatttactgtctccaaaaaaaaaaaaaagtttccatgactcttcagtagattatcataaattaagatgtatattgtaacccttagggcaactgatgagaaaataacaaaaaattctagttaaaaattattaaaatgcccctataatatgcttaactgatttttgacaaaggtataaagccaactaattggtgaaaagatagccttttcaaaatgttgctgtggcaacatgacgtcaaaagtgaaaagtggccaaaagaccaaaaagtgaaccttgacctgatacaaaaatcgagtaaatggatcacagccttaaatgtaaaacgatgaaacttttatgaaaaacataggagacaatctcagaatctaggggtaatcaaatttctactgaaaattttagtagccacagcaaataagcaataaatagaaagaaatgtcattaaggttggaaagaagtgaaactactcttatttgtagatgacattttgcatatagaaaatcttaaggaatccactaagaaaaataaaggaggacaggtagtgataaatgcaaaaacagaaagtaatgaaatagaaaacaagaaaatagaattaaatctaaagcctttttaaataaaattaacaaaataatcaaagtggtcataacactaagcaagtgaaaaaagaaaagatagaagcaatattataagtgaaaaacaatgtttaatcataaacaattctaagaaatttggaccaataaaagtttgacaaaaatctgaagttctctaatttgtttatatatttttggtatttatgtatttattgtcataggtttcttagttagattcatggccaaaagtaccatccaaaaaactatttccaaatgtatatttttagcacatacctcttttctgatctccaaacttaatgaccaactggttatttagattattatatgcaaatagacttcttaatatacagtgtcaatcctgtttctcttatgtttaatacatctctgtatatggtaccactgcagggtttgactcatgtgccctagccaaaccctaggagtcatccttgattttttcttttccttcaataagtccctatctttatatctggaacccatttactcttcttttatcagcaattaccattctattacagaccattagtatttttctcctgccctactgctatagtctcctgactgatctccttctactttttaaccctttcaaaccattctccacagaatagctggagtggccttttaaaaatgcaaaccagcataaaacattttgatgtttaaatccctctcatggctgccaatgattgctcatagaataaactccaaactttctgccatggtgtataaagccctacatgtcttacatggctttcctcctacctgtctaatatcatcttattctagttctttctcattgattattcctttaacaaccaagcccttttccttcaaaagtccttcactcttactcctccttcctggaatgctcttcactgttttctaagggctgactcatgtataaccttcaacattcaactcaaatgccatcctcttagagagtcattttctggttagctatctaaagtagctttccctgttcctccatgagctgttgtcataatatccctccaacccccaacccccaccttatataaccatgcttgtctcctttgttgcagttatctccatttgtaattaacttgtttaaatcctcctagaatgccagctaataagaaggtaaggtccttgcctctctctctctttttttttttttgagacagtctcccctgtcacccaggctggagtgcaatgacgccatctcggctcactgcaacctccacctcccgagttcaagcaattctcctgcctcagcctcccaagtagctgggattacaggtgcctgtcaccacatccggctaattttttttttttttatctttagtagagatggggttttaccgtgttagccagagtggtctcgaactcctgacctcgtgatccctccgcctcagcctcccaaagtactgggattacaggcatgagccactgcccccggccttgcctctcttaataaccatattacctctggcaaccagcatagtgcctggtatttattgtgctcagtatgcatctgttgaatattattattttgtatactctatagtgatgagcatgttgtaagcaacccgatatgtataaattcattgatggtgttctctctctaaattttctttattgttttcatggtgggttcatttcctcctttaccccctctttttaggttgtataatcattagttttattttcatctctgattttatatggacatgtttcaatgcatacagacagttaatattcttttcctcctaattatctattatatatatcatcttcagtatcatcaccattcaaaaaactcttttatatgttctagataatgtggcctattttttacgttagactacctgataaggtgtcaactgaattggctgcctttatctacattctgaaccaaaatttaattctagagtttgtagtcagcgtttttccaaatgtgtaaaactgtaatccttcataaaatgtcatatgtaaaagagtaagcaattctgtgtgtactaaaaggtgagaaagttattactttagctttcactgggaagacttaaagtttatcaaaaaggattatagaaagaacagatttatagcaactgtctgatatatgaccagaacccttatgttccactgaaagagacttgccctaggctttctagagcataatgcccttagcaagtagctttcaacatctttttcaggaagcaatattttccttcagtaaaagggtcactgtactgtttttctttttccttccctgtcttatcttttgagttcaggaagtactttaaatttacaggcagctttgaagacatgaagcaagttcagccccagaagtatttcctgttatggcattaatctaattccatgaaagtagaactgatttttcatctgtaaagtagataaagtgcctagagcagccgaccattattctgggttatcatgataaagaggcttagttttgacacaaaagagtttatcagcctacccagtggaagatttcatcctttttgttgaaagatatattaatggattataatctgtcttggcttccaaaagaaagttcacctttatattgaaaatgattagttaaatcagcaaatattttcctgaatatacattttataatatacgataaatcaagcaaacattctagggatatcacatataattaaatatctaatgttaaatcattttatgttattttaatgtttaaattattgtctcaatttgaaataatcacagattttccttataaaccaacttggtttaattttaacatatagactaacataatttctagtaggcatatatgcttcattttagaagcccctgttattaggttatataatttctccttacaacttataatgtagaaatagttttcttataataaggtatttctcttaatagttaataattaaacttagttgattattttaagtatatagtacatacaaataatatataattcaaaagctataatatatttttcctatccctatttcctggttcctctctaagctaaggcatttagactaatcctagtggcttagtattgtttaaataattttttatttgaaaattgattccatattggacatatttacaatatttccttgaataataatagcttaccacatagtaatacattacatatttagttctctcagtagccttctgagttaaattctgttatccatttgaaaaatgcaggaactcaaggttagagaggttaaataattggctaaaattcacctggctgataagtgacagatttgggctggaactcaggtcctctaataccagagcctatattcatagcccatactgtaggattatagaaataaggttattcccagttgtgccttttatacttgaaaagaacaaaagattccactgaatgcttattttacaattaataaattaagttaggctttatcataccctaatgagatatcttattatttgtttaaaataaatgatctaccattatgttcataaataaaaataaagatattgttttattatagatgttaatgttttaaaacttagatcatctaaacatgaaaaatctctggcctagtcaaaggcacactgagaactaaacttgggattggaaaatttggagttttcaaatggccctaccaattcagcgcataattgtatatgcttatcatttttccaaagagggttgaatagtattcttccattgtatatcttagggaggcattataaaggtaatatgacatcagatgttaaacttacttatttaaccagcattcattgaggctgcctactatacgtatcctgtgaagcaatgtgaccaatacaaagatgaagaaaacatgggtgctgtctttagtgaactacccatcttctaggaagaataagatctattgtaatataaacaagagtgatgagtccttagtatatgtgaaggtctcctcagctaagttccaaaaagtaacaagctaactgtaatttcaccaccttagtattttatgaacaccaccttagtttttatgaactcaggaccttacctccactttatgaaaacacatatacacaaagcaaggagttttaataagcacttgaaaagatgctaatcttagccatcagacagtggcataaccatgtgagctttatcttaacacccactaggatgtctataatcaagaagacataataccaagtgttgacaaggatgtggagaacttggaaccctcatgcaccactggtggaaatattggcagttcctcaaaaggctaaacacagagttaccatatgacccagcaattccacttttagatatataccaaagaaaaatgaaaacctgtgtttacacaaaaatgtgtatatgaatgtttatggcagcattaattataatagtcaaaaggtagaaatgactgaaatgttcatcaactgctgaatggataaataaaattagattgttattttacatgagacacaaaaatgaactcaaaacagattaaagatttaaacataaaacctgagaccttaaaactcagaagaaaacatattagaaaagctccgtgacactggtcttgcaatgactttttatgtatgacactaaaagcacaggcagcaaaagcaaaattaaacaaaattgtatctatatcaaaccaaaaagtttctgcacagcaaaggagacaacaaaagaaaaggcaactcacagaatgggagaaaatatttgtaaaccccatatatgataaaaggttaattatccaaaatatgtaaggaactcatacaactcaatagcagaaaacccgattaaaaaatgagcccaggacctgaatagacattttccatagaagacatacaaatgacccaggtatatgaaaacatgtgcagtgtccctaatcatcaaagaaatacaaatcaaaagaccacagtgaagctgggttcagtggtggtggtgcgtacctatagtgccagctacttaggagactgagataggaggatcagttgagcccaggggttcaaggccagcctaggcaacataggaagaccctatctctttaaaaaaagaaaaaaaaaattactcccccacccccactttcctctccctcacaatgagatactaccttaaatttgtgactgttatcaaaaagtcaaaatcatgtggaaaaaagggatcccttgttagcgggaatgtaaattggcacagagattatgaaaaacaatacgaaagttcctttaaaaacagaactactatataatccaacaatctcatttttggatataaatctaaaggagatcggccgggcatggtggctcatgcccgtaatcccagcactgtggaaggccgaagtgggcggatcacttgaggacaggagttggagactggcctggccaacatgatgaaaccccatctgtactaaaaatataaaaattagctgggcgtggtagcacatgcctgtaatcccagctacttgggaagctgcggcaggagaatcgctcaaacccaggaggtggaggttgcagcgagctgagaacatgccactgcactccagcctgggcgacagagtgagactctatctctaaagaaataaataaataattaaataaacggaaatgaaatcagtatgttgaagagatatttgtactcccgtgttcagctgcattattcacaatagtcaaaatagggaaataccctaggagtctgtcaacagatgaatggataaagaaagtatatgtatatataaacagtggagtactgttcaaccttaaaaaagaaggaaatcctgccatttgcaacaacataggtgaacctgcaggacattatgctaagtgaaataggccagacacaaaaatatagatactgtgtgatctcatttatatatgaaatcttaaaaagtcaacctcatagaaacagggtagaaagtgtggttgggggagggaagaagggtagtggaatgatggggagattttggtcgtggggtgtaaacttttagttataggatgaatacgttctggagacctaatgtaaaacatggtaactatagtttataattatgtattgtatacttgaaatttgttaagaaagtagctcttaagtcttctaccacacacaaaaaaagataaatttgtaagttcatggatatgttaattggcttgatagtggtgtcatttcacaacatacacatatatcaaaacatcatattttatactgtgaataaatgtaatttttgtcagttataactcaagaaaattgaaagaaaaatgtattatatccacacagtgaaatattatttagtaataagcaggatgaagtactttcatccatgctgcaacatagataaacctttaaaacattgtgctaagtgaaagaagccatttataaaaggctgtctattgtatgatctcattcatgaaaagtcttaaataggtaaatcaataaagacagaaggtatattggtggttgtcttaggctgaaagtgttgtgggacaatgctacactcctaatagatacaggatttctttgggagttagacaactaatctaaaattgactgtggtgatggttacacatctccgtcaatatactaaaaatcacgaattgtatgctttaaatgcaatttatatgtgaattagatctcaataaagcttttattttaaaaaatagatggtattaacaaaacttttagactactgtgaccacttggcacacctaacaacaaagcatccaaggagattaatatttaaacgtacattataatatgaaaggcatgaatttagatgggggcatgtaacctcttgaagaaatatataatgtaaaagtgttattattgctattttatttcttattttaatcaaacactgtgatagtattattcattccactgtaacccctattggataaatacattatagtatttagaataaaactcatgtgttagtaagccagtgagaaagaatcataccagagctttatagatcaccagttctatctcctgtccctccatttcaggtatatgcaactggcctacctgttcagagtattaactctatggtgcttcatcagtcagaccatccactatgcccaaatgagtaatatgtccaaactgtatttgcaaaatgcatttcttcacagaaattaatatcctgtgcaaatgctggctaattgattattactctttcataaaggcttaattaggtaggaaacccagtacctgcagcgagagaggaagaaaagtctttcctagggctagatcctgacccaaggttttggattttaatggggcagagttgtctgttttctattaaacacatacttgggagtaagtagacttgcccatctcctgttttatactgatcttttcacgaatgtgaacctttttcttgaaagagtaaatatctttaaatttttctgtagccttccctgttacaagttaaatgttcctacttctctagagtatttcgaagtgtttatttaaataagtaaacatggatagacactattttgtagcaaggggttgggggagtatactctaaggcagcttctctctgacagcttatctttcttataagtatagtgtaaacatataatttataatgtgggaaaagagggtttgatcttttaataaagccatttctttttatttcagagttaaggagtttaaattctttttctttagcatctagcagtgagttcaggggtgatggtcattaatatcttgatccattacttttcctaaaagataagattttttttcccataatggttcatttgtctgactgctttatttcccaccagaaatcacaaaatccatttttcctgtgacagtataataattttcacaacatctgattttagtggcacatacatgcagaagattaaaggtgtaggttagaaaagaagcagtaagaaggcattgagaataaaaacatggtagaatttatttctttaatgtcataataactaatttagaaaaacaaatataaacaatgggttgtaaatagtttattcaatattttaataaagaattaattcattacatgcacacttatttttacatacttgcccagatttcttaccaaaaaaaattttctcgccctattctcaaacaaaatttatagacattatatacagcctctgttgaaaagaccttctgttaaaatcagctgcccttagcttgacatatcttgagttcttagtgattaacatgttaataacaagtgtgaatgtcattaatgttcctataattaatttcagtattaacaccttatgtttcttattattcattcctcaaatgaaggatttttccatttataactaagtggcaattattatatcatttttatataatggagcaataaattgtatctgatgttattaatagtaattcctacattccttataacatacttttatactcattcctttatatattcctttactgttatataatactttttaagtgcctttaagtgaagagaagtggttgaaatgtaaaagaagctacttggaatgtctgtaataacaaatgtgttagtatatttacacctgcttgaaggaaagagtaaagtatttcctgaaaaccccacaattatataggtagttcaacctctgatctgcactgaggcatttaacctctcttaaccttggcttccttatttaaaggaagtggctgttgagccttacctaaatcataaagtgagtgcaagtaattgtttactgagaaatctaagaaaggctaatggaaaacatcaagtatgaatgaaacagttataactgttttcccctttgaaaagaattgctgttccacattgaatttctgtcatgaatctaactctttttaaatgagctatttaaatttaaatacataaatggatgttatattttgattttaattacttcagtagtaattcagaattaattgaagctacagcttaaacatattttattacatttaaatagttgggaaaaaataaacagttggttagctaaaacccaataaataaattgggaatagattctgctagttgaatgctgaaatgaatagtatatactttaaagggctttaattttttctttcatactgatttaagactgataatttatctctttacttattctaattatttgaccctttttgttggaggagagggggcaatcttgtcactaattgtgtaacccttgtttaatttactctttcaggaacccttccaaccttccccctctccaccttaatacactgatgttcattttggatttccaagagggagatatgatatgcaactttaaaaaacctattttccagtcaagccatttttcaaagagagcttattaacctctcctatggatcaaattgtgaaatactaaactaggttgcctgtggaagtatagtgagagacgacgataggaaagaagataggatggggtcagaagaaccttacattccatgcttaggagtataaactgtatacgataagcagctgggaaccataaaatccttttaagaagtattgtgatataagactaatttgaaagaatagtgagaaggtggataattgtacatttgattttattcctttatgctaataattcccatgtacatacagtgaatgaaatataggagacaaacatcttcaactattctcatttcttattggttttagagcttggaaatatgttaaaaagacatgtaaactagttccatcaattgtatttcctcctatttagatagtacagtgattttgagcaaactgttaacattgattttaaaatccaaaatatattattagtctataaatcactgcatggttctcattcattgattttcacttaggaggctttggggggttgttttgtttttataatgctttacccaaagcattttaaatcttctactctccagtaatagtttttgtcaaatatattttgatatctgctgtactatttgctatatttacttaaacatctctccactacgtagagcaggtactataggaggaaaaacttttcctctaccctcttatgttcagtagttggtgcttgcaaattaaactgacaaaaaattaggaggataaaaggattattttgtatgcacgtgagaagcctcacagaaaagaattgaaaaccccaaaaaaccaatgagaccaaggggcttacatatcattttaagaaagagtgataaagtatggagaagagactagacaaaatgggggtttagacttctggtggggtgagggtgggcattaatgataggtgactaaggaatgagtggtaaataagggttgtttagtaaggtttattaggcagagtcaagtgagaagagtctgcttcttctcttcctggtactggagaggaggacgccattacaaatatgaatttcctttacaaaagggaaatttatgccctatttttaggaagtaaaggggagggcagagagctcctcctatgtttgctgttttaattgcctgtagttcaaaataatccttatgctgaagtggcatatttgagggtgtcatactctgatccccttcactatagactactctctaataccagggtactgagttaagataattctgaaggcttcgctaataatctactactctttgtcaatttcctatcttagttttctcatctgtaaaatggagatcatgatagcacttacctcaaaaaatgataagaagtcaattaaaaaagcaccaaaaaatgcttaataaagtggtctgacacatagtaaattctcaatgaataatgtatatactgttaaggagtcatttccctctaagagtacaaagtacaaaagaaaaagttggagcttaagatttaggtttggctgggtgtggtgtatcacgcctgtaatcccagcattttgggaggctgaggggggtggatcacctgaggtcaggagttcgagaccagtctggccaatgtggtgaaaccgcatctctactaaaaatacaaaaaatggcagacgtggtgatgcatgcctgtaatctcagctatttggaaggttgaggcaggagaattgcttgaaccctggaggcagaggctgcagtgagtcgagatcacgccactgcactccagcctaggcaacagagtgagactctgtctcaaaaaaataaataagagttaggtttaatcccagctacttgggagggtgaagtgggagggtctcttgagcccaggagttcaagtccagccggggcaacctagtgaacacttccctccactccatctcttaaaaaggatgggagtgttcccagtgctgattatgccacctattagccgtatgaccttggacaactgtaagcctcaactttcccatctatgcaataagaatcatttttacctcattagattgttatgaggattaaatgaagcagcatgtatatatgtgtatatatatacgcatatatacatatagtatcttgtatataataagtatttattacatgcaatttcatcttttatgtagactttctagactctaaccttgccccaggaagataagtgacttttacattaagccatgttctctttttcctttatgacactcctcaatgcttaatgaagaactctggctacacaaaaaactaaagtaaaatgttgacagactgcttttttctacatctgggcttctttaattgaaagctgacatttaggccaagaattgttaggaattcctatttaggtttataccagttctcgcttatatacaagatgtatacttgtgtatacatgttatttacacacatacaataatatatactggctttctttttttccctctcatcccataacagatagtatactgccttttttaaaaaaaaaaatgcccacttttcaaattaaaaagcagaggcacacattctttccaaatgtattagtataatttgaaataatgagattgtattaataggattcagccacagaaacagacccattagggaagatagagtgagaataagatttatttgttggttgatcgattttgaggaattggcctatgtcattgtggagactggctaagtagtccaaaaccatagggcaggcaaccaggaaggggagaaagccttgaacttcttaggcatgggcagaagctgtcattcataggtggaatttattctctctgtcaaggaaacttaagccatgcttttctttttaaattttattattattatactttaagttttagggtacatgtgcacaacgtgcaggcttttactttcaactgattgaatcaggcccctccagattatccaggatactccagtaatagaagtcaactgactgggagttttaattacatctgaaaaatacctgtatagcaacacctagattggaatttgattgaataactagagtctgtagcctagtcaagttgtcacctcaaaaaaaccatcttgggataaagttttttgaaaaaagaaatagaaagttcagggcattttggtcattatttttgtgtattgtgcctattatatctttttattttaaatttttgagaatctgtttagtgcctagtattttgccaagattataaaggaaacaaaggtatcttaatgtttttttcaaatcttaacatcttaaagttgtttcaagcattttccctgaattcattgattaagtattgttagaagaagtggaacatggatgatgcatatgctttagattgaggcaggagtatgtgtggtgactaagagagtaagaaatgatgatctcgagaatactagactgtgagctttctaaaagctggtatcgtgtgttatttatccttgtattgccatggcctggcacagtaattgaaaaagttcaacaatggtttgttgtttaggttgattaaggaatgagcaaaaacgtaacttaaaagctatctgtattgaagtgtgatctgttatatgtattcagatctgattatacttggagtcgaaatcactgtatctaaattaatattaagactcagggccaggcacattgtctcacatctgtaatcccagcacttcaggaggctgaggtgggaggtcagttgaggccaggagtttgagaccagcctgggcaacatagcgaaaaactctgtctccacaaaaaattaaaaaaataaaaattagccggacatggtggcatgtgcctgtagtcctagctacttgggaagctcaggtggaggatcacttgaatctagaggtggaagctgcagtgatctgtgatcgtatctctgcacttcagcctgtgtgacagagtgagactttttctcaaataaaagaatcaatacagcaatacagccccaatttctaaattggagaaagtcattttctatttcgtctctctctgttcctccactagattgtaaactctttgagagtaagaattatgcagttttgtctgctcttcaatgttttattgccttgcattaaaaagataataaatactgcttgatgaattaattaaaaacagcatacagaagagatccaaatttaattttgtaataaatcacctctgagaataataagaaaaccagaatatttgaaatacatcatttaattgaataaggaacagtaaactgatttttaatgttcctgtttttatgtatttgaagttaatgtttagttattttgttttaaaatctttataaaaattctctgctttatcttccagtgaacaagacatattaatagcttttctgtagagcaaggcatattaatagcttttctgttgaatatgaaagaaagcagctgtagttttatcctactgagtacaaatatttgttggggaattaaagatttattagataaatggcttaaagattaattaattaactatactatctttttactttcctatcttatctgtaggccattggtctgttaatatatataaattgctctgtttcctgctatctttccatttcttaattaaatattagaaaaatgcccaaggaaaaacaatacaactgagcttcctttctggttttcatgcttttaaaatttataaaaattgtggctctgctgcctttttttttttttttttttttttttgtagttagatgaatttggcctgagattctatgaaaaaaataaaacaatagtttttatttcatgatttttttttcaagttgttctgattttataatatctagtcaagtgatgacatgcagagattttgctgtgaggagagggagagagcaaaaagtattctgccctgattgctttttagtgattttattactagaaagataaacattgccttgttattttagccagtaaaattgtctgcaaagtaggtaacaaaatgcaaagcagtgtatttacttttccactttttcccaaaggtatgataaaagcagggttccagtggaacaatttgctgagttctttcctagggagcactggtagcccgtattaaatgattatattttggaaaatgctaatgatgaaagatgagaataatttatattctttgaaatgtgactaaaaagttggaaatgaaacctatctttctgaagtgacatccacatttgtggttcattttcatcacacctgattcacttctgccagcaattcagaaagaaaggtggaggtgggaaagcatatatgtagctaagctactaaagtgactatttgagtatttcattccatctgtcaaaagattcagtgggataaagaatttggcataaatggatgtaattcattctctttttacaaagaagtaaatgatagaacaaaatcatcctaaaatgaaggaacaaaataccagaaagtgaaagaaaacaaaatttgtattttttgatagaatagtagcagaactcaatgtaaaaataatgattacattaataattatttgctcactttttcctgtatttggtattttgggaaagtgggcttgaaaaacagtggatacattgatgaaacatttcaattttcacttgcctgttgtgtttgctcatgttagacaaactataacttctcggtgtatagatatgatgtacacaaaattacacagaaattaagccatgtataataatgcatgactagaagaaagatatatctcccttgaacaaataacagttattttagtaaatttgtaacagagaaaataggcttgattaacaaaaatatgaaagatcttttaaataaatgaattttgaattttcagagtagcccagaattttatctaaactcggattatttcattagctagaacatgaaaataggcatttattctactcacctacagcttctgtagtactaaatttatggaatgaggctttgtggtgctgccttcagagctcaatgatttgctttttctgaattttggaagtctgtctctaattgattgacacatatgaatgtagtgggaagaaatgagattaagcatacaagctttctttttcatttaaacatcattgaagccatgaatttgtaaattgatataaaaacacaatcctttggatctgtattaggaaatttataaatgggagctttattttgctccagaaatgtgataattagaaatatattcaggtgattttttccctttggtttttgttgttttttaatttatttttctttcttatttttaccaaaggttcaagtcatctgtaatattcaggtgtttttaagaatttctcatggcaagttaattgtgggtgaacatttccctattggactaccagatgtactttgtggttataacttgcatagctccaggatttttcgtgaacaagtaataaaacacatttctggtttgctttctgccatagagtattaagagtttaacactttttaaatgttactttaatctctgaaattttcaacaatgattagtggcagtatactcaaaaaaggaaatgtgtaggctttactataataaaaataagaacaacttatataagctccacactttatagatttgtatggatatacaatcaaatgtactaatttttaaattatcctcattttgcagtaattttacattttgctcatttgtgcaaaccgtggtgatagtaaaatatttaacagaaattcaagcacattcttttaactctttctgaaaaatctcacaaatgagatttttttaaaacagttaagaatttactaaatttaaaatgtatatatacctgatgccatccagatgttttattgaatttctaaaataaaagtccacctaatgaatggctaatttactcaacacgtaagacaaagatgtatttctgtgttactaagaacatgcatcctatctccttgacaatggctctaattacctcagcttggactgatcaatatttgatctttttcccaccatgcaaacatgttactttgactttgtctcttcctcttcttttcagataatttgcagccatgtgagaatggttcattttgtttgttctccctggcttgaggccaggggtctcttattagtataatgcagttcattgatgtgaatttgttgatctcctgggtaggttttcacaaatttaaggcaattaaaagcttttatatggcatttcacttgaagttattagtggcctttcagtgattttgcttttaaaaattacttcatcattttatgattatttcctttccttctcttttctctactctccccatgctataaaattctatagtaaaggattgaaacaactatttcattgatttcattaaaagtaataatttataaacttataattcaatagcttaatattttaattaccacaatttttaaaggactaatgaaatttttggttttgtgttttcaaaagctgctttgttttaagcatataaatattcatgatagaagccataatttggagaataataagaattgaatctaaaaattattagtaattgctaaaaaattcaaaaagcacatagtgtaaactttgtgtatatgagacagaactttttctaaattgcagtttcattaacatcttaaagttttctcgtagctaacagatgtccatgatatttttgcttccttaacttttacagtcaatggaccattctccagcaggtcataagtaagaatgttaaataacggccactaaatcttaaggaatgtgacaacattgattagattaaaatcctttgacttcattgacatatcttttttctttccccatttaaaaaattgtttcagttgttttcctactgtttgttggtggcatactttgttacagtacttgatccagtttgtttcattggtgtgcttggtaaatttgaagaaatgatcactggagaggatttgaaataactagcaaaagttttgaagtattgcagtgagtatatggaatgtgttactcatttatgcaaaaaatattggtgtttttatactttttattttaaaaaatatataacaataatagcaaatatttagtaagaatgtaactttatgccatactaaggcaagaatagtatattgaataagaggatataccctgaaggcagggtataaatccaagttgcgctgcttactagttcacttcttaagcagttaacttctgaatctctctttatgtgcaaaatggtataggagaggaaaaaaaatatctttccctcctgatatgtacatgactggggcctctataacaaaaacagattaacaagagaaaagtatactataatttaagtgtaagttttacatgacatgggagccttcataaggaaatgaagacccaaagaaacagctaaatctgagtgttttttatattaggttcaatggtgaaatgatagggtatgaagtaaatgtagtaaactgggtgaaacttggcaaggcctttttgtttggattcccctctgtctctttgtctttggagaaaagatgctcctttatagagagggtaccattcacataagggtcttgtgacctacttaagggaaaggtcaaaaaacagttaccaggttttatgatctgtttctagagaaaagggcaggggacagtcagagagaccttcctgcttctgccattttctcacattccttcaccttaaaattttcaatatatcaaggtgctatattttggggtagtatatcctgaaccgtgcctataggaatgatgataataatatctactttataaggataaaatgagacaatatgtataaattgtatggaacagtgcatgaaccacaataaacactcacaaaatgtttgctataaagatattttcgaccttccatggtggttcatgcctataatcccaacactttacgaggctgaggtgggaggatcacttggagccaggagttcaagaccagcttgggcaacatagcaagaccccatctcttaaaaaaaataaaaaataaaaattacccatgcctatagtcctaattacttgggaggccaaggcaggaggatcacaattgatcctcaggaagatcatgcttgtctgtaaaggattttatatccccttgacttatgaagcttagtttggctggatatgaaattctgggttgaaaattcttttctttttttttgagacagagtctcactccgtcaccaggctgaagtgcagtggcatgatctcggctcagtgcaacctctgcttccctggttcaagcaattctcctgcctcagctgccctagtagctgggactacaggtgtgcgccaccacgcccagctaatttttgtatttttattagagacagggtttcaccatgttggccaggatggtcttgatctcttgacctcgtgatcctcccgccctcggcctcccaaagtgctaggattacaggcgtgaaaattcttttctttaagaatattgaatattggctcccactctcttctggcttatagggtttctgcagagagatctgctgttagtcccatgggcttcactttgtgggtaacccaacctttctctttggctgcgcttaacattttttccttcatttcaacctttgtgaatctgacgattacattgtgtctgggggttgttcttctcgatatgtatgcacccaatacaggagcacccagattcataaagcaagttcttagagacctacaaagagtcttagcctcccacacaataatagtgggagactttaacaccccactgttaatattagacagatcaacgagacagaaaattaacaaggatattcaggacttgaactcagctctggaccaagcagatctaatagacatctacagaactctccaccccaaatcaacagaatatacattcttctccgcaccacatcgcccttactctaaaattgaccacataattggaagtaaaacactcctcagcacaagcaaaataatagaaatcataaaaaacactttctcagaccacagtgcgatcaaattagaactcaggattaagaaagtcactcaaggctgggcgcggtggttcacgcctgtaatcccagcactttgagaggccgaggcgggcggatcacaaggtcaggagatcgagaccatcctggctaacatggtgaaactctactaaaaatagaaaaattagccgggcgtgatggcgggtgcctgtagtcccagctactcgggaggctgaggcaggagaatggcgtgaacccgggaggcggagcttgcagtgagccgagatcgcgccactgcactccagcttgggcgacagagcgagactccatctcaaaaaaaaaaaaaaaaaaaaaaaacctcactgaaaaccacccaaccactgctcctgaatgaatattaggtaaataatgaaattaagacagaaataaagcagttctttggaaccattgagaacaaagacacaatataccagaatctcttggacacagctaaagcagtgtttagaaggaaatttatagcactaaatgccctcaggagaaaactggaaagatctaaaatggacacactaacatcacgatgaaaagatctagagaagcaagagcaaacaaattcaaaagctagcagaagacaagaaataactaagatcagagcagaagtgaaggagatagagacacgaaaaacccttccaaaaatcagtgaatccaggagctggttttttgaaaagattaacaaaatagatagactgctagacagactacttaagaagaaaagagaaaagaatcaaatagacacaataaaaaatgataaaggggatatcactactgatcccacagaagtacaaactaccatcagagaatactatagacacctctacgcaaataaactagaaaatctagaagaaatggatacattgctggtcagataccccctcccaagactaaaccaggaggaagtgaatccctgaatagaccaataacaagttctgaaattgaggcagtaattaatagcctaccaaccaaaaaaagcccaggaccagatggattcacaactgaattctatcagaggtacaaagaggagctgttggtgggagtgtaaattagttcaatcattgtggaagacagtgtggcgattcctcaaggaactagaaccagaaataccatttggcccagcaatcccattactgggtatatacccaaaggattataaatcatggtgctatgaagacacatgcacacatgtttattacagcactgttcacaatagcaaagacttggaaccaacccaaatgcccatcagtgatagacgggataaagaaaatgtggcacataaccaccatggaatactatgcagccataaaaaaggatgagttcatgtcctttgcagggacatggataaatctggaaaccatcattctcagtaaactaacacaagaacagaaaaccaaacactgcatgttctcactcataagtgggggttgaacaatgagaacacatgaacacagggaggggagcatcacatactggggcctgtcagggggtaggggactaggtgagagatagcattaggagaaatacctaatgtagatgacgggttgatgggtacagcaaaccaccatggcatgtgtatacctatgtaacaaacctgcgtgttctgcacatgtatcccagaacttaaagtacaattaaaaaataataataaaattttaaaaagaaaaagattgggtatttcacatcttcttgaatgtaaaactgggggaaaataatcttttttaatgtgcattaaaactttttttttttttttttttttttttttggggggagaaggtctcactctgttgccctggctggagtgcagcggtatgatcaccgctcactgtggcctcagcctcacaggcccaagtgatcctctcacttcaggctccaagtatctggactcaaaggcgtgcaccaccactcccaggttttgtttttttttttttttttttgcagagacagggggttttctatgttactcaggctgttttctaactcccagcctcaagcaatcctcttgcctcaggttgccaacgtgttgggattacaggcatgagccactgtgcctgacccagtgaaacattttagtgcagaatagttgtgaatttttgaaatagataaccaagaaaatttaacttcagatatcacctagttgtaagttatctctccgttttgtcattcaggaatgggttttctgagactttctaaagaaatatatattatcgttcagtttggctttggaaattttattattgccctatatttctagtaaagtaatgtagatctagtttgatacaaaccattctatacactacaccggtactatcagctttcacttttcacagctcccaaaacaaataaataaaagaaaatagctttcttttctatgccgtttctttctgaaatagtactaatctgccttacctttaatactatcccatagacccacctagtagctcttcccttacgagagagttcttttgatcagataaggtttaatatggaaaataaaaagaaataatcatttaaaacttgaccaaaatattttaaaaacatacacatatatactctaccttaacatatggtgaaaagcaatttttcctaaaatatattctatgaaaaaaaaattttggccaggcacggtgacttatgcctataatcccagcactttggaggctgaggcgggtggatcacctgatgtcaggagcttgagaccagcctggccaacatggcaaaaccccgtctctactaaaaatacaaaaaattagctgggcacggtggtgggtgcctgtaatcctagctacttgggaggctgaggcagggagaatcgcttgaacccaggaggcagaggttgcagtgagctgagatcacaccattgcactccagcctgggcaacagaacgagacctcatctcaaaaaaaaaaaaaatttatttccaatcagttggaaaatgtaagaatatgcaaaaatttaacagatttctttaatgtgggtttttcctagaacacctttttacatttcagaggacattagagttcagcaggacacagtttggtaaatattagtataaaaagttaggctcagccgggtgcggtggctcatgtctgtaatcccagcactttgggaggctgaggtgggcagatcacgaggtcaagagatcgagaccatcctggccaacatggtgaaacctcgtctctactaaaaatacaaaaattacctgggcgtggtagcacacgcctgtagtcccacctgctcgggaggctgaggcaggaaaatcgcttgaaccagggaggcagagattgcagtaagcctagatggtgccactgcactccagcctggcaatagagcaagactccatctcaaaaaaaaaaaaaaagaaaaaaaagaaaggagaaaaaagaaaaaaatcaggctctctgtagtcaaaagtcaaacatttttactgctaaaataaggcattattttttttccttgcttaattgccatgccaacttttattggttctttcctgtctcccaatgagttaaaaaagaaaaaagtatccaaatgtgttcccaccccaacccaagcctgtgatcacttctttgtttttttgcttccctgtaagggtatttctccctataattatactcacactttaagaagtaggagccattatactttattttcaaatttcaaattagaaagtgatttgggtttggaagcttgtttctgtctctggctatccaactgtttctcggctccaagatgtgaaactgtttcttcaccctaacggcaaaagggcacctgctattgagcgtgctttgagcgttattctcccaatagtaccctagataggtaagacatttttgaaatcaaaaataaacaaaaacttcttgttgtgatttctctgtataccaaaacatcctcttgacataaactgtgttatcctaatgacacagacaaacacaaattatcttcatttgggttgcagagttgggggtcatttcttgtgcttatgagcctgctattctgcaactgtgagatttcagacatgttcaatttgtggattttattttttattacacacacatgtgtagtattattgcttgtaataccttgtatgaatataaaaagattgtcatttttcaggtgtatattaacttcattaattttttacaattcaaatgatggagagattcctattgaaggatacttagctttttctaataattcagttatgattttatattcaatgtaaatgattttgtctctctggggccagattatcctatttaccttgaccccctaccatgacaatttaaatactgcatttaactgtagtatatgtaagattgtccttaacaaatatgagacttgaaaggttgtttttgtttgtgtcctctcctctgaagttttccttttaggatgacagcatacgatagatgtgttctagtaaagtgcttcttttattcatgaattacaaatagcttaagaaaatgtttaaagtaaagctataatgattagtcctggtagtctccattttattcagaatgtctctgtcagaaattatgtcatcactatggactgttagccaggaagttctgtctagcagatgaatgaatagggagtactgagttttctaataaaagacactgttgtaatattgaaatactgctaatggaggttgccagttttctgttcttaaatttacaggacatcttctgtgattaaagtaaggaatacttagagcaagtccttagagtaaaccaactataaacttaagaaaccggaaatagaattttttttttttaaacaatgccatttaagtccctaacttgtcttggttcagctgctagacatttgttcctttgtctcaaaaacgttagcagaaagcaataaatatagttcttgctttactcagctaacatctgattttatctgcacattgcttccatcttaaaactttcttaccttactagtctgaatggcttgtgtagcctaatactgttataattgtcagaacaaagggtttgattattttggcaaggaaaaaagcctggtaatagtatttgcatttcaattaattgtttcattctgatttgaaatgtgacttatgttagatacatctctgatccttccctatctcagtactaatactaatatgttgtatttccactacaatagcattacatcttacaaacatttatttcctttataactgacgtagagctttccacatagtagatatttaatataattgatggtttggaattcatacattttgtaggctaagtataactctcctactgtttcacctacttcctaagctagatttatctttacaggtactagactttatagaactaatggtaaattcagtatgcatatcttctgtagtaaacatagaaaaacatttttgtaatagtgctccccaaattttagtttcttgactagtaatgaaatatcttatctgtactagagttttgttatacaataatgacagcattttcatgtgctatgttatggccagttaactaaaaataagtggatatttaaaatggaaaatgaaattatcctgttgcctgaaatatcttgactcaggttctattacaggttgcatatggtatctgttagagctttgaatctatgttggttgttgagttattatgtgcattaactattgcattcaaaagttctttaaaagcatatgtctgttttaaatcttatacaaattccttgcaggttttgagagcagtctttttgtatgtctttcttgtttgttgttttgtttttataccagagcaccatgtcctaagcagcagtaaatttaaaacattgcttaggatagttttataatatcattaatagatttttatattagatagtttctctgaattattgacctattatagggaacatggaaaaatttagaaaaattagaagttatacggagtattaagaaaaaaactttatattttggtactcccaggaaaactaaaacctctttctaagagtatattttaggaaattttctaaaattttgtaaatcaacctacagagaaaaaaagtatagaaagtattttgaaatatttgtgtgtatatgtgtgtgtgtgtacacaagccacattttctcctagaactcactactgaaatttctgaaagtgattcaataagatatatatttcatatctggtttttaaaatccatagaatttttgtgttttgaccatcaggtagagtcttacagtttagtcacagtggaatcatcagcttcaaaatgaaagaacaagatagtctcttggcattcaaaaatttagcatactttaactcatatttgctgtgatgttaggtagtgaattattcttgttaactatctagcgtccaatgtgacatgtgtttgttgttacctacaacttatcaaataaacagttaccctctggaatgataagaacttgggctttttatgaaaaataccctctaaatgaggacagaaatctatattaaggataggctattgattaaatttagagatacacataaagatgactctcatataaaatttagaataaacatgaaagttttagcatgtccagactttagggatttaggctttatgaaggtctcaagcctgtctcctggaattccaacattgtgatgactcaaattttatcagtaaatatggaaaaataagctaaagttcttgagaaattgctatctaataagtgattattttattttttttctagttttaaaataaaaaatctttactatttattagattcaccagtgttttatactgggggtccccaacctttttggcaccaaggactgtttcgtggaagatcattttccacagggcagggtgggggaggggtggtttcaggattattcaagtgcattgcatttgtcgtgcactttatttctgttattattacagtataatatataatgaaataattatacaactcaccataatgtagaatcagtgggagctctgaacttgttttcctgcaactagacagtcccatctgggggtgatgggagtcagtgacagatcatcaggcactagattctcataaggagcacataagctagatccctcacatgcacaattcacaatagggttcgcactctaatgagaatctaatgccgccagttatctgacaggaggtggaggtcagacagtaatttgagcaatgaggagtggctgtaaatacagatgaagcttcacttgcacatctggcactcacctcctgctgtgtggcccagttcctaacaggccatggatttgtatccgtccatgtctgaggggttggggacccttgttttatacaattctaattgtgtcattgaatttcttttttcttttttctcattgttaggaggctaaaaacaaacttgtcttgtgcagattcgtcgtctttaccaccaaatttttgtcatggtatcttgtcttttttttacgtctttctaaactgccttaatccttgtaagggaataggtaaggtgtaaatataattaataaggtgcaaggaaatgttattagaaagaaattagattgttatttgaaaacatacagagcctaaatgtaagagaaatgtcctaagcaaaacttattaacaggaaatttactgaattggaaagtactcttgattttatgactaatatgaattgaggtattcttatagacactcagagattcctgtacacatgttacttgtgtttttccaaaactatatacgtatagtctttttacaaataaacagtggccaccaagaaaaattacagcagtacacataagacataccgtatacatgatactcaactttgtctatatcctttgtgttcaagtttctagaaattttcatctttgtaaggatatcatgtgagtgtgctcaaggtttgttctaagaatctagctgagcacagtggctcatgcctgtaatcacaataccttgagagtctgaggcaaaaggaacatttgagcccaggagttcaagaccagcctgggcaacatagggagacccccatctctattaatttaaaaaaaaaaattacctggacatggtggcatgcatctttggtcccagctacttgggaggctgaagcaagaggatcaagaggatcacttgagcctggaaggtcgaggttgcagggagccacagtcatgactctgcactccagccttggtgatacagcgagaccatgtctttaaaaaaataaaataagaatctatacacaattcatggaatgatgttgttttatagttttactgtatatttgtttctgtcataacttccaatatcccaaaaactttttaattatttttattcaagacatacatacagaagcaggccaggcacagtggctgatgcctgtaatcccaacatttttggaagccacgatgggtgggttacttgagctcaacagtttgatgctacagtgagctatgatcatgccactgcactgcagcctgggcaactatttaagaaaaaaagagagagagagagaagcagaaattcaaaggacactttttgaaatgcacttaatgtaaaggctgctttgcatggttaatttattcctattaaaggaatactacattcctgccacttttctaggtggtgaatttatagcagcgaccaggtaaatattgctgtcctcagggtgcttacctttcagtgggtaatgctttaaacaaaatatctagtatattagatggtaataagaaccttggagaaaaataaaacagaaaagagtgttcaggtctagcatgaaaggttacactttcaaatctgatcattagggaaagtctcacccaagacagtgatgtttaaaaatatttcaagaagcaagttgtgcacatattagggagaaaaacaatcagtgaataaatagcaagtataaagtctctatgccaggagcatagcatgtttaaggaatagccaggagattaatatggctagagtaaaatgagcaatgggaaaagtaagtaggagatataattacactgggaaagagtctaggggcatattaaataagactttataggtcattataaagactttgttgtttttgttttgttttgactctgaatgagatcaaaagcctttagagggttttgtgcagacgagaaacataacatgacttatattttagtagggttattctcactgttatatggacaaaactgaatggggcaaagatagaaatagggagatcactttggaggtcattgcaataatccagtgggagatatgatgacttggactagagaattagcaatggaggtgttaagatacaatcaggctctggatatagtgtgtaggtagatttaatagaaattgctgttgaattgaagaatagtttacgagagaaatgagtcaagggtggaagcttcattaactaagagagggtaaatggggataatttggtctagttttgtataaattatggggaaagtcttggtctcatagtttagcattccatagtacgttctccatagtgtataagtgataggttttactaatttaataatttttttgtctcaaacttgtgacttagactttgataaacttctgtttatgatagatggatttttaattgattttattgtttgtattttataatggattttaaggcatattagtgaaaacacaacttaaaatttattttcttaccttactaacattccaaaaaaggaacatatactgtataatgtttttttgtctcactaatatattcgtatccctcttcccccttcttggcaaacttgtctgaaagtatactgttgcatgttatgtcatggatgtaccggagcatgtgtgtaaaatacatgtcataaatggaagcagctggtttcctatgcagttaagagaagaaatgcatacagctgagctcttcaaacttcagaactcattggattcagtttctatcctgtgtaagcatgctatgatttcaaatagtacaaatgtataacaagttaccttaatagcttaaaaaattattttgtttcgatagttgaactactaaatctgttttattctctttccctctgccttcagtccctacttacctatcctacctcttgaaaagaacattacacctatagtcttagttttaaattcgaatctgaaaaggccttggcaagagttgggaaaaagttatcatctcaaagggaaaagctgaattcatacacaggaactgcaggattactctggcgttttactagtcccttgcagcactcgcaagtcccataaatacctaatggaaaaacagcagaaaatgagatctgcagcagccttttgagatcaaatttatgttgctgaacatttttttgaggttgagtgtaaaggtcaaaagaaagtgggtagattaaagttgctgatttttgcaaacttaaggccatttttaaaggtttctctttctgtagcaagaaaatttcaagataaatggctttgcttcattagctgaaatgtcatgtcttcctttaatatctgttacctgagacatttagtgatttagtggtatttatatacaacaaataaaaatctcaatccactttaacaaatctagataaatttatgaaattgcagatctttccaagaacagcatgatgataaattaatgtatatatacatgtttgtattgccatgtatatatgtatcttaaatgacatattttagatgtttttgtatgatacagaaggaaaagataataatcaaagttttgtatttttaaagtataggttattgatccagcagtgtaattataaccatctttttttaaaattatttcttatattaaactattacaatgaagataaatgacctcaaagaaaagatcgtgcatgtaatagcattaaaacaaaattcatggatgcttttaatggtctcttaccttttgaacaacattttaacacgttgttactggtgcaagcctatatctaagaaactgtgagttactagggtactgcagacttgatgcaatgaagaacaataaactgccatttctggacatctctatcctgagttgatagtacagaaagccaccacatatgttaacgtgaagttatagattatttatatctccagggcttgcttcgtgtctttgatttcgtagttcagattgcccagttattagtacttagaattcaaaagaataagataaaaaatttttacttaatacattcatttctgcatcacaataaagagttttcatggaaattatccagataatttcatagtagaataatatatgaaatgaaatcttttcttttttatggtagttgataattaatagtaaatctattcagtttatctctaagaagtcagattatgggagacttgtctctatttttctctatttaattttcccaaaaaaattcataaggaaaatattaattttcatttaaatctctatattaaacattaagtgatctttttatgccttggaatcacaatgaatataaatgttatttttattgtagttgattttgcagtttcaattcatttctattaaatattttaataaacatttttatgaaactaggtagaggtcacaaatctcattagtcactgacagccaattctcaaacccaggtcttttcctgtataccacatttcctcattagttctcactacactgtatggctatttccgcctcttaactttttatattttattacactcttaaagtacaactgtacttctcttctcaagtgcccttttctattcagtaagggtcccaggtgagcaatgattctgactggggaagagggagaagatggtgttgtagcaagtagtattaaaaggcccttaggaaggtagatagatgtataattttgtctctttcttctcactgttttcgtaaagacaaaggctatgccttaacttttttgccattcttatttttgagactacccattagggattgtttttgatgttgttgagatgaagtatttggtgaagccaaaacctccttgacttttatagttttaataagtttgtgctctccaaaccttcataaagtaatgtctagtgatcctttcagatatggcatgctgtcatgtcagctttaaataattgttaatggcatgatttttaacattttacctagttagaatcagtaaaatttattatatatactctttgctgatcagtagagcctcttatgaaggagtcagtatgatgtgctggatagagcattagatggcaaattgggcctcagatattattaggcatagttttgccactaatttgtataatgtgcaagtttaataacctttctgggcctacagttctcctcttctgaaatggaaagatgaataggttatctctaaagtctatccagatctaaagatctattttattatagaaaacttttaatcatacacacaaagatagaataaaaataaatggcattatgaatccctgtgtattcattacctgtcctcatatgttatcaatagtaaccccttagtatcttctaatacctagttcatattaaaatttcaattaaagtatctagtccatattaaaatatcatctcagtaataatagtttctagttgctttgttttgttcaaattataatctagacaaggggtgtgtgtgtatgtgcatgtgtgggtgtgtgtgtgtgagagagagagatctagttgtgtttttaagacttatggtcaaaaatacatatcataaaatttcccactttaggctgtacatggtggctcacacctgtaatcccagcactctgggagaccaaggcaggaggattgcttgagcccaggaatttgagaacagcctgagcaatgttgcaaaaccccatccctacaaaaaattatgaaaattagccgggcatgatagtgcgcacttgtagtctgagctactcgggaggctaaggtgagaaaatcacctgagcccaggagtttgatgctgcggtgaactgtgattgcaccactgcactccagcctgggtgatagagtgagcccttgtctcaaaagaaaaatattttttaaccttttaatttattttttagagatagggtctcactgtgtcacccagaactggagtgtagtagtgcatagcatagctcactgtaaccttgaactcctggggctcgagtgatcctcctacttcagcctccagagtagctaggactacaggcacacaccacctcacccagctcattttaaaaattttttgtagagctggggttttgccatgttgcccaggctgttctcaaactcctggcctcaagtgatcctcctatcttggcctcccaaaatgctgggattataggcataagccaccgtgcccagtctatcttaaccatttttaagtgtaaagtacagtaatgttaattgtatgcacattgtgtgcaatagatttcttgtacaaacaccttgcaaaacggaaactctgtagccattgaacagtaattcccctttgcccccttcatacagccccaggcaaccaccattccactctgattccgtgaatttgactattttagatatttcatgtaagtaggatcatggtttatggctggctttttatggctggcttatttcacttcccttaccatgatgtcctcaaggttcatccatcttgtagcatatgacaggatttccttctctcttttttttaggccaagtaatattccattttgtatatataccaccttttttttttttttttttgagatggagtcttgctgtgtcacccaggctggaatgcaatggcgcaatctgagctcactgcaacctctgcctcctggatttgagcaattctcctgcctcagcctccggagtagctgggactacaggtgcgcgcaaccacacctgactaatttttatatctttagtggagacagggtttcaccacattggccaggctggtctcgaactcctgacctcaggtgatccgccttccttggcctcccaaagttctaggattacaggtgtgagccaccgcgcccagccacattttctttatacattcatctgctgatggacatttagattgcttccacttctttgctattttgaataattctgcgatgaatatgggtgtgcaaatatctcatcaacatcttgttttcagatcttttggatatatttccagaagtgagattgctggcatttttaattttttgaggatacttcatagtgttttcatagtggctttgtcatctaacattgtcagcaatagtgcacaagcgtttcaatttctccacattctgtatcttctttgaaaaatatctattcaagccctttgacaatttttcatttggattctttcgggggtgaggtgttgtggagttccttatatattctgaatattgatcccttattggatatatggtttgtaactattttctctcacttcataagttgcctttttactctgttgtttcctttgctgtgcaatagtttgtaagtttggtagtcccatttgtcttatttttccttttgttgcccatgcttttggtgtcttatctaagaaattattaccaaattcattgctgtgaaacttttttctccagtgttttcttcttggagttgtgtagttttaggttttaaatttaattgtttaattcattttgagtttatttttatatacacaataaggtaagggtctaactttattcttttgcatgtggatatcctgtttttcccaccaccatttctcaaagaaactatcctgtatgcattatcagtactatactttttctttttttttttttttttgagatagattctcactctgttgcccaggctggagtgcagtggtatgatctctgctcactgcaagctccgcctcccaggttcacgccattctcctgcctcagcctcccaagtagctgggactacaagcacctgccaccacgcctggctaattttttcagtttttagtagagactgggtttcaccatgttagccaggatggtctcgatctcctgacctcgtgatccacctgcctcagcctcccaaagttctgggattacaggcttgagccaccatgcctggcctatcagtactatactgttttgattgctgttgctttgtgtaatatgttttgaaatcaggaactctgaggcctctatctttgtttttctttcttgagattgttatggtatttgggggcctttgcagttttatatgaattttagaatttttttctatatctgcaaaaaaatgtcattgggatttgtataggaattgcatgtgcaaaggaatctgtacattcctttcagtagtatggatattttaacagtattaagttccaatccatgaacacaggacgtcttttcatttattggtgtcttctttaatttctttcatcaatgttttgtggttttcaatgtaaaaatcttgtgcctccttggttactcataagtattttattcatttttaatgctattattaatatatttgttttcttaattttctttttgggttgttcattgttagtattttcaaacacaattaattgttttatgtttattttgtgtcctgcaactttgctgaatttatttattcctcctaataggtttttttgtatgtgcagtctctaggctttttatacatacaagattgtgttatctaaagaaataattctacttctctgtttccaacttgtatgcctcctatttcctctttcctttctttctttctttagctgactgctctggatacaacttccagcactactgtgttgggcctggtggtatgctcctgtagtcctacatacttggaaggctaaggcaggagaatcacgagttcaggagttcaaggttacagtgagctgtggtcataccactgcactccagtctgggtgatagagcaagatcccgtcggtaaaaaaaagtggcaaggggggcatccttgctttattcattgtctttgagggaaagctttctgttttttaccatcgagtattatattacccatcggcttttcatatacagtctttattgggttgaggtgatttcctctgtgccttttttttatttaattataaaaagatgttgaattttgccaaatagtttttctgcatcaatagagatgtcatctagttgtgatgtctgataagattcttctttctgtaagtcattttcctcccctccactccattttttagctttcctttggtttgtcagagaagccaggtcttacatttgtctcatataatgttctacaaggttcagtgcttccttttgtagtgttgttcctctatcacctaatttcctaataagacctagaaatgcattgtcgtctggtagctactagctacatgtggctctttacctgtacatttttaaaaattaaagtttaaaattttcagccattgtagccacttatcaagtgctcatatagccaaataggggtagtggctaccatattggatagtgaaaaggaacatttccatcatcgcagaaagtggtctcatataaagaactgatatgacagtgttttttccatactctattttgtctttttccacatgccagctatctcaacaccatttggggctatttttagatgtcataattttagccaatactaatgggtatttattgatatctcattgtggctattttttcatcaatagttttttgtttgttttggggggcagattttgtttgtttgttttcatttttttgagatagggtctcactctgccacccaggctggaagacagtgatgtgatcatggctcaccgcaaccttgaactactgggctcaggtgattctcccacttcaacctcctgagtagctgggactgcaggtgtgcaccaccatgcctaatataaatatatatatatacacacacatacatatacacacagacacacacacacacacacacacacatatagagagagagccactgtgcctggcctaaatagttttattttgaaataattttagatttatagaaatgttctaagatagtaaaaataagttccatgtactcttcacctagcttctcctaatattaacaccttaaataactgtaggatcttcatcaaagctaaattaacattggtacaataccattaactaaactacaggtttattttcccagtttcttaagtaatgtcctttttctgttccaggatctgttggaggatactacttgacatttcattgtcatgttgctctgtcttgccttctcttttgtggccttgacacttatgaagagtagaggtcagatagtttgtaggatatctttcaatttgagtttatctgttgtttccttgtaattagactgaaattatggggttttgagaataccaccactgaggtgattttgctttcccaatgtatcacatcaaggtgtacgtagtatcaatctgttactgttagtgtgaaccttgaacatcaagttaaggtggtgtccattgggtttctccattgtctatttgttcctttccatatacagttcattagaaatgaatcactaaatccaccccacacttgggggtgggggggtaaatacaaaatgaatagtgtttagaaacctcatagaggaaggatatagccaccacagtaattaataaatattagtggagagatattatgaaattatgcaaatattctagttttttaaagttttacccactgatttatagcatttattagtggatattgcctataccaattacaactatggtgttctaatggtgattttctatttccctcatttattctatatttaataattcaaattctttaaggaagatttgtctctttgcttccatttttaatattctttaatttttttttcgagatgggttctcactctatatctcaggttggagtgcagtggtgtgatcgtgactcactgctgcctcaaccttctgggctcaagtgatctacctgagtagctaggactataggcatgtgccaccacgcccaattaactaattctttttttaagaggcagggcctcactgtgttaccgagcctagtctcaaatgcctgaactcaagtgatcttccctcctcagcctcccaaagtgctgagatcacatgtgtgacccaccacacctactctgtattcgttttttacaaattcagtagtcttttcttttctttctttcttttcttttcctttattttctttctttctttttctctccccctttcctctcctttccttcccttcccttccctttctttcctttctttcctttctctcctttctccctcccctcccctcattctctctgtgtcatccaggctggagtgcagtggcgagatcatggctcgctgaaacctcagcatcctgggcttaattgatctcccaccttaggctcccatgtgtgtgggggtgtgtgtgtgtgtttgcatgtgtatgtagatggaatttcactgtgttgcccaggctggtcttgaaccttctaggctcaagcaatcctcacaactcgcccttccaaagtgctggaattacaggcctgagccactacacctggtttgtttccatttttcataaattctgcctggtgcggaggctcacgcctgtaatcccagcactttgggaggctgaggtaggcagatcatgaggtcaggagatcgagaccattctgaccaacatggtgaaaccccgtctctactaaaaatacaaaattaactgggcgtggtggcacgcacctgtaatcccagctacttgggaggctgaagcaggagaatcgcttgaacccgggaggcagaggtttcagtgagccgagttcacgccactgcactccagcttgacaacagagcaagactccatctcaaaaaaacaaaaaacaaagcaaacaaaaaaaaacaaaacaaaaaacccttaattgtcatttatatcaatagggctcatggatatttatttagttctttgggttataatctaaaactgtgtcacttttactactcaaattcgagatttaactattgagagctttgtcacattggcttctgtatcattgtgacagacctgtcatctttttattactttcttactttctggcactacaagatcatctagactttctgtaccccagcttgtttctccaaggatcactggttcactttatcaaagagaaggaccaggcatggtgactcaattctctaatcctaacactttgggatgctgagacagaaggatcacatgaggccaggagtttgagaccagcctggacaatgtagtaagacccccatctcttaaaaaaaaaaattagccaggcatagtgacatgtgcctgagacctagctacttgggaggtttaggcaggagaattgcatgagcccaggaggttgagcctgtgtgagccatgatcatgacactgcactccagcctaggtgacagagcaaggccctgtctctaaacagagaaagagagagaaagagagagcgaagagagaaagagagaaataaaagaagaaaagagagagagggagaaagagaaagaaaagaaagaagagaagagagaaaaaggagggagagggagggagggagggaaggtaggtgggaaggtgtttcaaaaccagcatctgagcactgttttctcgtaagctactggcagtaattgcttctaggttctctcagcagatagaattaggaaatatgcttatgtctgctaactcatgtatacatagacacacattgtatttaatcctgttacctatgtgtgtttataatatatataaaatcgtgagtttataatggtatctcttactctaattcagtaccacagagttcatgctagcatttccctttgacttattttaacttccttctctgatagtgagaaagctggctctgattatttgacatgtatttacttatttatgcaaacctagtatacatataaagtcgtttaaaaattgctggctgggtacagtggctcatgcctgtaatctcagcactttgggaggctgaggcgggcagatcacctgaagtcgggagttcgagagcagccttaccaacatggagaaactgcgtctctaacaaaaatacaaaattagccgggcgtagtgacacatgctgtaatcccagctactcgggaggctgaggcaagagaattgcttgaacctgggaggcagaggttgcagtgagtcaagatcgtgccactgcactccagcctgcgtaacaagagcaaaactccatctcaaaaaaaaaaaaaattgctgaatcatacctctgtgataaaccaatttaccagaatacaatgcttatatatagttctttttgtctttagcactatagtatgtaaaggaaatactgttggctacagttatttagggtcttttcattcccaccactttcagtaagtttatttcatacatatttaatacatttagactaatttatcacagtttgcattccatcttgggttcccttaacatcctaattgatatttttaaattagtatttgctgaaagaaacctaaaatattgctcctttacggtagttggtcccttccacctgccaaccatgggaaaagttaatctgtttttcatctctgtagtttggcattttctagaatgtcacatacatgaaattataaaatatgtagactagtggttctggcttttttttacttagcaaaattcatttaagattcattcttattgtgtgaatcaagtttgtgtttagtatgtaaaatatatagtttaaaccagatattttggggctgatttctgttattgtatggtatgctttctgtactatgaggattttttaatttgtttctatcttttgccatatcctcccactttggtttgtgtgtatgtttcttccaataatttgtgagacttgtatttttattcaagtgaccacatttagatctgtaacttcatgtaacatgattaagatttttttatttaaaaaaaggtcttttgagacatggtctcactttgttgcctaggctggagtacagtggcatgatctcagcttactgcagctgcaacttcccaggcacaagcgatcctcccacctcagcctcccgagtagctgggtttacgggtgcatgccaccaggactggctgttgttttacaatatgtttttagagatagggtttttccatgttgcccaggctggtctcaaactcctaggctcacgtgatctacctgccttagcctcccaaagtactgagattacagtagtgcaccactgcacctagccaagattttttaaaagataataagtattctttttcggggaattcttcattctcttttcctagaagatttttctttcccttagtgtttttaagaatacttagacctcaattacatgatttatcagcttttcaggatctccttgacccctggctataaaagatgaggaaatctttcttaccctcatagtctcacaccttccctctcccaattactctattttgtatatttgttcccgagatttataacatttatattgttctgtaaccaaacatattctcctccctcctgcaaatttttgatcttattcataacagttaaaaggcaataaacagaatcaatgtttatagctaagcctttcataatagtcattttatctcttggtttgctgaggtttgttctggtggtttcttcagaaagtcacatagaaactatatttcccaaattattttatgttctaaattttgtctcttcatttatacttacatggtagtttgaccagatacaaaattaactaggctatctttccttgaggaggtaatagacattgctcttttattatagggttttttggtttgtttgctttaatgagatagggtctcactttgttgtctatgctgatctccaactcctggcttcaaccaattctactgcctcagcctcccaaagcactgggattataggcattagccactatacccagcctatcttagaactgtatttatttatttctagagacagtgtttcattatcactcccaggctagagtgcagtggagccatcacagctcattgcagcctcaacctcctaggattaaatgatcctcctgcctcagcctcctgagtgtcagggactccaggcatgtgccaccacacctagctaatttttaaaaaaaattttcatagagatgagtgtcagtctgttgcccaggcttgtcttgaagtcctggccccaagcagtcctcccaccttggcctcccataatgctgggattaaagacatgagtgaccacacccagcaattctttaaatgatactttgaagaacctgagcacgcacatatatttcttccctctttgttagtaactctcagttccttatctagctttatttttctgtcacctggtgtatatattccttggattatttgtttgctgtcatctccatctatagaatgcaactatcaatagtaaagggatttggtctgatttgttctctgttgaattccaaatagcttgttagtgtttaatacttagcatatagctaatacacatttattgaattaataaggtcagaattcatgattctgccccattctccatccttataagtactttgatgggtttgattgcttacaaaaggattcgtttcacattttgaattcccgtgcctttactcagatatgtcttggtcttcactactgtgtgtcagtgttgtgctctttccaactatatttttctgtgctatttctagaaagttcttccacatgtatctttttttaaaaaatatttttttgagacagggtcttactctgtctcccaggctggagtgcagtggcatgatctctgcccactgcgacctctgcctcctggtctcaagtgatcctcccacctcaacttcccaagtagctggaaccacaggcacgtaccaccacacctatctagtttttgtattttttgtaaagacgtggtttcaccagttgcccaggctggtctcaacacccgggactaagcagagctcacctcggcctccaaaagtgctaggattacaggcatgacccatcgtgcccagcctcacatatctttatattaggattgcagcttctgttttctactattcccactggcctggtttatcattctctatctcttttagccactttgttttttgttggtttttttttttttttcattttttttctccctacccctctcttttagccactttgaattggtttgttttagtgtctctttgccatacagcagagaattttcttttgcttcctgaggcaatctgaatatactttcatgtcaataagctgctgatatatttggcctcaaacctgtcatgttattctataattactaaatatatatgtatactgtttttctgtgtgatttattatctctgctgtttttaaattttttattctggcattttggaaaggtttatatttcttttctagccattagcttttcttttaagtgtgctttttatggtggccttaatccccatttttcttataacattctactctccaatcagttttaaatgatatcctttgattctcacctattatctatacaacagtgattttattctgcatttttctctcacttctttgttttaaaattgtattacttctactttgtcagaatatgcagtgcttacaaactatgttctttccatcctttttaatttataattataattatcttattaaatgtaatgaggtttaccaacaacagtcctgtgtttgagttttcccccaatcatgcttggatgaagcttatcttctaatacatttctcaggaaaggcgtatgtgtacagtatcctctgtgttcttttttttctattactttatactttttcctacacaaagacagcttggctgcatataaaatccttgactttatttcttggaaataatgttctagttttgtcttgctttgtgttttgctcttgaagtctaaggcagcctaattttctttctttctttctttctttttttttttttttaaagagacagagtctcactctgtcacccaggctggagtgcagtgtggtatgatcatactttactacagccttgatctcctcagctcaaacaatcatccaaccacagcctcctgagtagctgggactacaggcatgtgccaccatacctggctaatttgttgttttttgttgtttatttgtttggttggttggttggttttgtttttgtttgttttttgtagagacagggatcctgctatgttgcccaggctgttctcaaactccaagcctcaaatgatcctcccacctcagcctcccaaagttttaggattataggcatgagccaccacacccagtccctagcctaattttcttattcttatttttctaatttcttactcttaattttatctttttgcctgtaggcctgaaaatactgtttcatcattaaggtctaataattttaccaggatgtgtcttagacctttcttgtttggggtcagtttttccaggtatgcaataataagctggaaatatagtttctagcttatagagtaatatggtagctcatgccttgcacatgcttttacaccagcagcacatcttttaaatgtgtagatttaaattttcatctatttctggaaagttttcttagactatattttaaatatactattccattgcgttattttttcctcaaggattctgtgtttatgttggatcttcttttcctgtcttccatttcatctactttctctctttgttatgtctttcttctctcattttcattcttttggttgtttgccttcattttttcagtgtacctttttagattttcactttattaatgtattcagcatggtgcactttgtaatttatttctgggattgttttttccttttattgcatttcttccctgattactttgtcctagtaatgttgaagacatggtcatatattgttttatttgtacttcttgtggcttattgagagaatacgaagataaatttggtttcagattattgccattatcctgaaatagattttgaactgtttttctgtgctactactttgttactctaatttaggaatgccatttatattatcttagattcacttttcctcttgttctgtccttttctcaccaatttattttattacctttgttagttcctatttcattttgcttgctttacacagtcctgacctccattttatttactatatttttatcagtgtttttttctccatttctttgatggttgcatttttctttcacactctcttgagcccagccagtttgtgtttcaccatctgttaatatgtttaattataacttctctatactttagtgtctctgcttaatagggataattgcttcatgaattttgtccatgcatttgcttataattgatgtgtgttccattactatatatttctgttaaatgtcttgtatgtgtcatttactttgctactttttttttcttctgtcctcatacaaattctgttctggttcctttttcatttctcatcttcgaatatggtattttcctacattagctattttacatgaggtttaattaaggaaggggttacacatgtatttcatactatgaagaattgtccatatgatgcacatatgccagttcaattaatggtcttaactcaggacaatacaaatagtacctattgtttcctaccactattcctaagcaccttatatcagattttcttttccttaacccttggagacatctagggaagattcatcgtagtttttagtcactttcagctgttaaggaaattgccctgcttttggttatttaaacaaattttaagtctgttgttaaaaatgtcagtcttaaactgtgtttgtattagtcctttcttgcactactatgaagaaatacctgagactgggtaatttataaagaaaagaagtttagttggtttatggttctgcaggctctacaggaaatgtggctggggaggcctcaggaaactttcaatcatggcagaaggggaagcaggcacatcttacatggctggagcagaaggaagtgagacaagggggagacgctacacactgttaaacaactatagctcattgaaaactcatgcactatcacaagaacagcaaggggaaaaatccaccctcatgatccaatcatctcccaccaggcctctcttgcaacattggggattacaatttgacatgcagcttgggtggggacacagaactaaaccatatcattctgcccctggcttctcccaaatctcatgtctttcctacagtgcaaaatagaatcatcccttcccaacagtcccccaagacttaactcatctcagcattaactcaaaagtccacaatctgaagtctaatcagagacaaggcaatctcttccacctctgagcctgtaaaatacagttagttacttccatgatacaatggagatacaggcattgggtaaatccctgttccaaaagggataaatcagccaaaagagaggggctacaggccccatgcaagtccgaaacccagcagggcagtcattaaatctttaaactccagaataatctttgactctatgtctcacattcaagccacactgatgcaacgagtaggctcccaagggcttgggcagttctgcgtctgttgctctgcagggctcagctcccatgtcagctctcaagggctggcgttgaatgcctgcagcttttccaggtgcatgatgcaagctgtcggtggacctaccattttgaggtctggaggacagtggccctcttctcaccattccaataggcagtttcccagtggggactctgtatgaggactccaaccccacatttctcctttgcattgccctagtagaggttctccatgagggttcacccctgcagcaaacttctgcctggacatcaggtgtttccatacgtcctccgaaatctaggcagaggctcccaagcctcatctcttgccctctgcatacccacaggctaaacactaggtagaagctgccaaggcttacagcttgcaccctctggagcagtggcctgagatgtatctggggctcttttttccatggctgggacgcagggagcagtatcaaggttgcacagggcagctggtccctgagcctggcctaggaaagcactcttcgcttttatgactctgggctggtgatgggaggggctgctgcaaatgtctctgaaataccttagcagcattttccccactgtctcggctattaacatttggctcatttttacttatgcaaatttctacagccaacttaaattcctgcccagaaaatttctcttttctaccacacggtcaggctgtacattttccaaactttccaaattctgtttcccttttaaatataagttccagtttcagatcatctctttgctcacatatatgagcatatgctgttagaagcagacaggatacatcttgaatgttttgctgcttagatatttcttctcccagataccataaatcatctctctcaagttcaaagttccacatttccctaaagaaggagcacaatgctgctagtctctttgctaaagcatagcaagagtgaccttcactccatttgccaagaagttcctcatctccatctgagacctcctcagtctggacttgactgtccatagcactatcagcatttaggttacaaccatttaacaagtctctaggaagttccaaacttacccgtatcttactatattcttatgagccctccaaactgtttcaacctctgtgtgttacactgttccaacgttgcttccacattttcagtcatctttatagccatgccccagtcgtaggtaccatttttccgtattagtttgttctcgtactgctataaagaactacctgagactgggtaccttagaaagaaaagaggtttaattggctcatagttccgcaggctctacaggacatatggcttgggaggcctcaggaaacttacaatcatggcagaaggggaagcaggcacatcttaaatggctggagcagaaggaagagagacaagagggaggtgctacacactgtttaacatccagatctcattgagaactcgctcattatcacaagaacagcaagagggatatctgccccactaggcccctcttctaacactggggattaaaataaacacgtgattcggatgggaacacaaatctaaacctatcagtgtttacattttttatttttattatttttattacaaagctcagctttccaatatactctgcttataaactgaaatttttaatattatttaaaatgtcaattctccctacagtgagccatagaatcaatgcctttccaaccaaaaaacaagatttttgtgaaactttaccatacatttctatggaaaagcaaaacggcaagaatattcaaactactcctgaagagggacaacaaagtgggatgtagcctaccatatatctgaacattctgtgatttttgtaatatagcagttcgctattaggacagtggtagaccagtgtaatgggacagagaggacagagacagatgccttcatttccataaggaaatggttgattattcaataaatggtgctgcgataattattttttcataacaaaaaagtgaaatcaaatttctgttttatactatacacaaaaatcaatttcaggtgaattatagatctaaatatgaaggtaaaatgacagagcttttggaaggtaacttttgagaatatctgtatgatctcggggtgtggaaaaatttcttaagcaggacacaaaagcataaaggcaaagactaataagttgtaccacattaaaattaagagcctttgtttatcaataggtacctttaaaagattaaaaggcaagccactgagtaggagaagacatgtgtgacacaaataacccagaaagaattaatatccataatatattttcaaaattttagtaatcaatatggaaaagacaacacagaagaaaaatagtcaaaagataccaacaggaaatttaccttagaagaaaatcacatgtgtattgaaggaatgaaaaattgttctacctcatcattaattagggaaatgcattagccgggcatggtggcacatgcctgtattcccagcaattcaggaggctgagacgggagtattgcttgagcccaggatgtcaaggttgcagtgtggtatgatcttaccactgcactccagcctgggtgacagagtgagaccctgtctcaaaataaataaataaataaataaataaataaataaataaataaataatcctttgaaaaataagggaaattcaaatgtaatccacaatgaggtatcattttataccagttgataaaaattttaaagtctaaaaatttcaaatgctgcataaaattagaattactgactcttacacacttgaagatacaaattccctactatccccagaaaatgttattgcttttagacactaattatatccaatatctagaacttagtctaataaactatgaacaaggcctctaccaagaacacttaaaacataattgtgagaacttaaaatgtaaatggaggtgtgttttaaagatgtttatttattagaagactcaatactgtaaagatgcaatatttgtccattttagtctgtaatttcaatgcaattctgattaaaatcctaacaagtaggggtgtatatgagtgtaaattgacaaactcatttttatatgtttttggaaagtcaaaggataataatagccaagaccatcttcaagacaaataagatgggagaatttactggtgatatggttaggctttttctcccatatccccaaatctcatcttgaattgtaatccctataatccccacgtgtcaaaggagagacctggtgggaggtgattggatcatgggggcggtatccttcaggctggtctcatgatagtaagtgagttctcatgagatctgatgatattataagtgtagttgtcttttccacacttgcacgctctctctctctctcgcctgccaccatgtaagacgtgtgtcttccccttctgccataattgtaagtttcctgaggtcactctagccatgtggaactgtgaatcaattaactcttttttctttagaaaatacccagtcttgggcagtactttataaccgtgtgagaacagactaatacaactggatattgagtcatcttataaagttaaaataataagacattgtgacattggtgcagtgataaataatggaacagaataggaaacccaaaaacacaccaacaggtatagttttccattttgattgttcctttcattagatgtttaaaactttataatgaatatgtacttttagtcaaaatttatttacttgagaagcaaagtgatgtatggattatggcctctgaggctataatgtgagtttgacccaaataatgatccaaatgtgagttccagtcccagttttgtcctatactactagctgtttgagcgtattcaactggtctgtggttcttagtttttttatctttaacacaagataataaaattacctctcagaattatggtgagaatttgacataacaagtataatcctgctggcacatgctgttcccttgatgaggggaatttgttattatgtttcttaggaacacaaaacttctgtttattcttggtaagaattcatgtttcccagatctatgtgtactatttgttatatttaaggttatcaaattgtatccttggtaatggttgccactggatcttttttggaatatgtacaactccttattcaaagtggctttctaatcatgattagttttttgtagttttggaagagccatattactgccctgcattcataaagcagtcttgtaaacactgattatgatagtgttttgaaaaattaaaagcctccaaaatcactaatttttaaaaaataatgcagttaaatatagaaaaggattagccatagatattttgtagttaaccctattatcattaacctaagtgaatagaacctaatttttgtacttgctaataattgctattaagaattttgttaatcgtgtgtggattggtgcttgagttcagaatgaatgattgataggggacaactctaagaaatacagcacttacattaatgttttattaaacagaaaaagctttaatgttttattaaacagattttaagagttacagtcttaaaatctttattatttattttatgaaatatttcattttgttttttttctgggcactttaaaattgagatgaggatggtagaatttgccagtttattttttggctattttttttttaacccatcttattttgagaacgaatttagtaatatttttctcaacatcctgaaattgtgtaacctgtagaaacttcccactgtctttttaaacttattcttaaataccacatttaatataggataaataagtcacaaagcttgcttatcaaaacagaatattgtattcagctttccatcggagcttttggggaagacatcacagtattgtactgtctcccaagatgcaaagtatcaggctttaaataatgaaaataagggaaatgccaatagaaaattagaaaaaatgttagaacagttaaaaacagcatactgaagcctgcattatttggcttatctaaaaatcatatgttttcaaccaatcagtacttatagtcattctatttaatcttttaagaaggagacataatccaccctcaccaagtgattcagtgtagcatcctaactaataatgacttaatgtgtgtccaaatggcatgtaatgagaagtatgaaacattgtctgtatactttcttgcctaagatacttaactgagtctaatcataaagttcagacatatcttcactgtggaacatttctacaagacaacggcctggactcttcaaaaatgccactgtcatgaaagacagtaaggagaatggaaggagactttcagattaagggagactaaagagacttaagcaaatgtagtattagatccttgactatatattagataatactacatcactgccacattttgtgcttatataggaaaatctccttggtcagtatgtatcataatagggtcataatgtctgcaacttattttccagtggtttgaggggaaaaaagacgtgtgtgtgtgtgtgtgtgtgtgtgtgtgtgtaaagaatatgttctaattgatacatatacgtaaatagcataggagtgttcatttgtactactctcaattttttctataggcttggtttcaagatgaaatttgaaaaaccttaagggaaaatatgtttaaagtatgataataacaaattagcacactagataaactttttatagcttttgtgagtttttttccttcagaaaatcatatttatgtagatagcaggattaaagaaaacttttctaaatttcagatgtcagaaatggagacatctaaattgtttttccatttcatctctaaatgctaatgaaaactggacttttacgacattaaagacatttaattgatctctgtgggatttcatgtttagcttttttcaacagctatatattgaacatttaggtgatgagattgagtagctaatcttagaggcgctctattgagattgtccagattccaaccctgatcccacaacttaccacctttgtgatcttggacaagtaatttgagatatctgtgcctcattctcctcaaatattcaacaggataataataatacataccagtttcttaggattgtagtaatgcttaaatgaattaatatatttggagcacttaggaaagagccaagtacatagtaattttctaaaaattatacctacttattatgtggatctttgctgaggaaatatgagtaagcatacaagactggacaggctttgagtagtgaagatgttttactcacaagcaaggtaattatgccttttatattaaaagaaagttcatatggaacactctgcttatatgcttcatcttcttttcaatcagataataagttctccaatgtagaagggaaatgtcagcctcacacataaaaatatacctgtcagagattatataagtgtcaaaataatactatctagagaaattcaggacatttggataaataaaggaatgtcatgtagtttggatagaacatagagaagtgaggaaaggagacattcccagatagaataacagctcaatgacttgaacaaggatacagatgcatgtagtatacacagtggactagaccatttatgtgtgtatgtacatatgtgaaaaaaagtctttgaaatgtttgcatttcaattaaattctgattttaagaacttattttccccctgtatcctgtgtgtgctagcattctgtttcctaaggcattctttcagacagacatacctagtcctgaaaatgctgctattattgttccagatacaaagcaggatgtcataattttttttttttactattccaactggaataatatggctcaacttaagttctgtacaaaactacttaatgataactcacaaaattaaaccaatttatattttctgcagttaaaatagaatgcacagatttttaaagacctaggacacattattatatctagttcctgaaatcattaaatgtccatggggaagaaaaaaacttgtgtaagtaggaataatataattggatttgcaatgctctcttaagagattctttaaaatcatgtgaaataagtagagtttctatgattttttaaaaatcacaaatagcatatatccgttttatctttaatagtgtttgagcccatcatttgaaagcattggagcatgtaaccaatatttctgaaaatgaaccatggttccagtcataatctatatgctttaaaattccttccctttattctttcttcccaaatccatgacatctgaatttcaataaggaagaaaataagcatgtttttaaaatgttttagaaaagattttcaaaattagattaaaatgtttgaggaaataaaaacttctttatgtattcattgtgatactgatttttatcaatgtctttttgtaaaaatacctatatactaactttgaataggtccaacatatggtaatgtgttatgcaattaatgataatgtagaacgatgttaaacccacagaatattgccaaggatttaccaacaaccaaaaatgtaattatatagaagaaaagtgtagttacaaatgcagtcttttgtctttttacattctctatatgtagagggtaacagaaatactgtatcactttttagtatatgttctcccagaataagttgccacaattagaacagagtttaggagcctatattaagctttactagttatggttatttccatagtgctagtaaataagagaaaaaaactttttgaacccatgtctcattgtaggtctcctaaaggaaagtggcccaaagtccaaatacttcaataccgttcgtctctgcctgataacaaagtgttttgtttttgtttttaccctcggacaagccagtcagctgatctttgtcctaatttgttcctggtagaattgaacaagatgtttgcagaagcttcctctagtttgaaaattgtattgattttttttccccatagtaactcacagatggcttctcaggttggaaataatggtgtccatgtttaggtaccacgtgttagatcagatttgtactcatggatctgtgattattttaactttttcttgttatttataaaaataattatgtacttctctctggggtttaatgtgtctttttattctcaaaaaatgtagtacattgatcagccacctaaaatactagccctatagaattctaatagttaggttttatatacagccatttgtcgattaaatattaaataccggatcagcttaaaatggacacacaaaaaaacactaccacataagctatacagtgccttttttcacagtgtcttataggtggaagatactcagtgagtgtttgttgagtgaataaaggatcttcacttggtgcatcccatttccttacaatttattattttttattttactttactttgagtcaggatctcactaggttgcccaagctggacttgaacttttagatccaagcaatcctcctgcgtcagcctctcaagcagctgggactacagggatatgtcactatgttcggctttaatttttattttattatgaaagttttcaagtagcaaaagcgatgtaatgaaccccatctacccattactgagattcaataattactaagattttgccacacttgctttatctagtctttaaagaaatttctccactgaatgatttactttaaaatacttgacctcctggccttttactctgtattttaaagaaagctgtagtaatttgtgacataaaccaatagagagcagctaaattttgttatatcttcatagcaattgactatattttggtttgtcttaccaataatttgatgaatgacctttcattttcaatttatctttggtaactaagtagataagtgggagtgtaggtttacttatttaaattctttgaatttgtgtgtgtgtgttgctttcccccccgatagaaactataaatggtagtgttattgtggttaggagtatggggctatggagttggggaaaacatgtatgaatctcagttctactactttaccttttgaatgtgggcaagacaagtctcagagttgttttagtttttttaattttaactttgaaataattgtagaaaaatagcaaaactagtttaatgaattcccatatgttaatatttaccacagctattgtatgtatgtatgtagagtttttttcctgagtcgtttgagagtaagttgcaaaaataatgcctctttaacctctaaatacttgaggtgtggttagtaaaaattcacgttttgttacataaccacagtatatttatccaaaacaggaaattaacatggataaagtattactgtcttatctagagatcttattcaaattttttcagttataccactaatacccttcatggcaaaagaaaaattattttattcttaggttgaatccaagatcacatgttacatttagttgtcatctctagaaactgctggtagtcctagctatttgggaggctgaggagggaggatcacttgagcccaagagttcgagtctgacctgggcaacataataagactctgtctcttaaaaaaaagaaagaaaagaaaagagacagaagaagaaaacagaataagctcatggactgttataaaggcaataaatgtgacataaaggatgctaaccaaaacagataaatagtaaaaggttaaataacagaggacttagctatttgcaagtactgacaaattttcatgattgggcaatgaatgatgtgacgttaacacatctgactttatctttcatgactttgatatttttgaaaagtataggctgcttattttgtagaatgtaccttaagttttttttatgtttccttatgattagatttaggttatgccttttcataaaatactatggatatgacctatccttcatgtaccatattaggaggtacatgatacctgttttatcctattgctgatgatgttaccctttgatcataacattatattttcaaatttctctaccataaagttaccattttccttttgtaatggatctcttgtgggaagatactctgagagtacctaactatcctatttctcattacatgttcacatgctagttttgacatccattcttcctagagacagttattactatggagattgccaaataatgatttgtttttcattccatcattttttctgcatttgttagttggctttcagcttcaatttttatatctgtaaaatgaacctaattgatgtaaaattggttaataacacccaaatcatgtagggtataagataatgcattttattttattttattttactttactgagacagagtctcagtctgtcacccaggctggagtgcagtgagtgacatgattatggctcattgcagccttgaactcctgggatcaagtgatcctcccacctcaggcctccctagtagttgagaccacaggtgtgcaccaacacacccagcatgtatgtgtgtgtgtgtgtatatacatatatatgtatatccacacatacatacatacacacatctttacatatatagacctcatctatatatatatatatatctcatctatatagaagagatatatatagagagatatatagatatagagagagatatagatatatagatatagatatagatatagatagacatagatatatatctcatctgtatatatatagatgaggtctccatatgttgcccaggttggtctcgaaatcctgggctcaagtgatccacccacctcagcctcccaaataatacattgatttgggacaattcttagcacataactctttaaaatattagatattataatttttattatgctagtatctacttttcagttgaagaaatagatcattttaaagatctttgaaaggtcataggaaatgttaaaaatatcaggtattttatgtgtacctaccatgaatgttttacctcatctttggtaaggtcagaagtgagatgatgtaacagccatcatatgtatgtgtattttttttattgacctgagacagtttttggttatttaatgcagaaaatatatttgcagtgtacttcatatgatatgcagtactttaaatacttgttgtaatgtggtcatttaataggagagaaacttagagacatggtaaattaagttttgatttagtatactgaatgatgaaatagaattatttatggtcattttaattctttaaaagtttttaaattagtattttaaaataatatatgtacacagtttactgattttgtccttaagggtatactgtggaaaagagcaataccctgccctgtactttgacagcccttttagctatttcttcttttacctacctccatatttttaatcacctcacctatccaggttagatattatgtacttaccaacttcctactatgataagataaatatttgtctctcttatatacatacattctgtcctctcctcctctccagttctccagtagagtttttgataaatcagttttcagcataaataatattatacagatgtatgtattatttatttctgagacaaattatattctatggtgttttacaacttttagtttctcctagagtttagaattcccttatctttttgtttccttaggtttctttatacctgtggtgacttccatacacatatcttccaatagcttctcacatttattttgtgcatagttaaaaatgtgagttttaatttgtaaaggtaattataaatcatgtgctctgaaagctttgtttttcttatttttttctttctctctctttttttgtttttgagatatagtctcactctgttgcccaggctggagtgcagtggcatgatctcagctcactgcaacctctgcctcccgggctcaagcgattctcctgcctcagcctcccaaatagctaggattacaggggtgagccaccacacccggccaagttcttttgatggctcacatccttcattaactttctgagaaaaaatacaagggagataaatattttgagaaccaaagtgtctcaaagtatctctgtttactcactctggattaatatatgggctccatgtggaattctagtgagaaaatttattttctttagactcttgaaaccattgctctattatattctaaacttacatattgtttttgagaggtctggttcttttttttcctaagcctttatatatgatctgccttttctctagaagcatttatgatctgtctctggttttctaaagtttcatgataaataataatgatgtagatctcttcattaattcattatattaatacattattccctataaatttagacaataagtcagttctgtgaatttttaaatgaaattttacttcctgggttgatcctctatttttcattttttctttctttttgatttttttttccttttttttctctttcattgaagttgagctttttgcatactcttctcaagtgtctggtaatgctggtagtgcatttatatttaagagtgatgcactagacaatgtacaaaatgagacctttcaacttccttagggtatttgagtaaaagacagctttttcataggggaagtaatttacatgcaccttctccagggctatttaatttctccaaggaaaaatggattctctaattttctttttgggtgaacttaagcctaagtactggtcaggaaaagggtcagaagggctatttggtatgtaagtgttcacataaccagcccagcctgttcttagttcagcacttcacccatttccctatcttcctttgtgcttggagttcctgagtctgaagcctttccagttctttcctagcctaccttccctccattattctgcagaggtaggaaaaggacacttgtcaggctatatgaggtgggaatggggtctgaaagttctgctgttaattatctccctattttcagctctactagttacctggtaccaccattttctgaattttccaaggtttggagggtgaatcagcttgatttttgttggaatctcctcttagtaggcttttatactttagctttcttccccctgctaatctaattaccttttctccatatactgtctgacctcagaaattgtaatccaggattatcagtatcttctagtttttttactaatatggttagttgtaatttttcattattgtcttgagatgatttttgataggagaatgtgcagaaatgtttatattttggcatcagaaatatcacctttggagggggcgagggggtcttacctaggctggagtgcagtaatgcagtcacagctcacttcagcctctacctcctgggctcaagcaatcctcctgcctcagcctttcaagtaacttggactacaggcatgtgccactgctatggttttgctctgtgtccccacccaaatctcaccttgaattgtaataatctccacatgtcaagggtgggaccaggtggaggtaattgaatcatgggggtggtttcctccatgctgttctcatgataattaatgaatctcacaagatcagatggtttaataagcatctggcatttccgctgcttgcattcattctctctcctgccaccttgtgaagaggtaccttccgccatgattgtaagtttcctgaggcttccagccatgctgaaccatgagttgattaaacttcttttctttataaattacccagtctcaggtattccttcacagcagtgtgagaatggacgaatacagccaccatgccacactatgtttttaatttttttgtagacacagaatcttgctgtgttgcccaggctggtctcaaactccttggctcaagtgatcctcttgcttccacctcccatagtgctaggattataggcgtgaaccaccatgcctagccagaaatactatcttaaaatcaactctgcataattcactgacccatcattaaaatttgtcagtacttaaaaatagctaagtcctctattattttatttaaccttttactgtgtagtttatttgttttggttggtatcatttaagcctcatttattgcctttacagcagtccaaacagaacctattctgttttctttctcctcctctctcattttttttctcttttttaagagacagagtcttacagtgttgcccaggttggactcaaatgcttgggctaaagtgatcctccctgctcagcctcccaagtagcagagactacagggactacgggcgccaccttgcctagctccccctctctcttatcttctttaccctagttaaattatttctgctttgtcccaaaaaataatatttgtacattactctccacatggctttatggtggagtaagggtgatgcttgagtgtaagaagttttacactgggatgtggtacttttccttttttcacttatagttgttttgaagtttgggcattctttttgtcttcaaattgtgctgaaggcatggtgtttttgtagatttatttttctgtccttgttctatattcttttggagagaaacagggcttaggtggcaaccattgcttcagctgtctggaattcctcaatttattttaactttatataccatcttttctcccacctctctcttcattataagcagactcattcattcacagtatgtttagtgagtgctatgtgccaggcatggttctagggatatggtaatgaacaaatgtctttgccctcataaatattatattctggtggtagagacaaagaataaaacaaaaaagtgaatatatactataatgttaggtagtgattaatgctatgttttaaaaaaataaacaagatgagtgcagtggtacactcctgtagtcccagctgcttgggaggcagagacaggatggtcacttgagcccaggagtttgagtagccactgcacgtcagcctgagcaataaaacaagactgtgtctctaaaagtatagatatatcaatcaagaacctggggaagttctagtgctacctacaagagttgaggaagaccttttcttttttttttttcttttttttgagacggagtctcactctgtcacccaggccggagtgcaatggcccgatctcggctcactgcaagctccgcctcccgggttcatgccattctcctgcctcagcctccccagtagctgggactacaggcacctgccaccacgcccggctaattttttgtatttttagtagggatgggatttcaccgtgttagccaggatggtgttgatctcctgacctcatgatccacttgcctcagcctcccaaagtgctggaattacaggcatgagccactgcgcctggccaaggaagacctctttgaaaaagtgttacattagcaaattttgttttgttatagaatagtaagtacatctttttatattagcatttaccttatgtaaatcattaagattttaccactgatcaggtttccatgataaattgtttaattttaaaacttctgtagtagaatgggcatgtggtgttatggaattcataccaaataagaagaattttacagaaagtaaaaccataagctgtctactattcaactcttctcattctgctttagagaactgctattgataaaagattatttgagaaacatataatctatccttttctctaataactctacactttattttttatttttattatactttaagttttagggtacatgtgcacaacgtgcaggttagttacatatgtatacatgtgccatattggtgtgctgcacccattaacttgtcatttaacattaggtttatctcctaatgctatccctctccccttcccccagcccacaacaggccttgtgtgtgttgttccccttcctgtgtccatgtgttctcattgttcaattcccacctatgagtgagaacatgtacactattcacaatagcaaagacttggaaccaacccaaatgtccaacaatgatagactggattaagaaaatgtggcacatatacaccatggaatactatgcagccataaaaaatgatgtgttcatgtcctttgtagggacatggatgaagctggaaaccatcattctcagtaaactatcacaaggacaaaaaactctacattttatgcttggactatcagaaaaactgtttacttgaaaacagtttacagaaaaactctttaccctgacatgtattgatttgttgctttgtgttttttgagacagggtcccactctgtcacccaggctggattgcagtggtatgatcatagctcactgcaacctcaaactctggggctcaagcaatcctcctacctcagcctccctagtagttgggactacaggcgtgtgccatcacacctggctaaattctgagttgttttttatattgaagccttaatctttcattgaggaataccacaataaacagactgagcttgctgttgagaagttgttgaggacaacatagtcttctgtattaatgtttaacatattaaagaccctatgaaaagtttattttagaatcacgtgtttcttataagaaagtgacatttttggccgggcacaatggctcacgcctgtaatcccagcactttgggaggccgaggcgggtggatcacgaggtcaggagatcgagaccatcctggctgaagcggtgaaaccccatctctactaaaaatacaaaaaattagccaggcgtggtggcgggcgcctgtagtcccagctgctcaggaggctgaggcaggagaatggcgtgaacccgggaggcggagcttgcagtgagcagagatcgcgccactgcactccagcctgggcgacagagcgagactccatctcaaaaaaaaaaaagtgacatttttatctcttcaagcatgaaaagtagataactaggcatgtcttactttttgctttcactgtcaagaaattggaaacaaattcagagctaattcaagacgcctctgccatgtatttctttttctccccaatcttatactgttctgttttctctgatcattttttttaggttgtctcactaattatggaacaatggcagggatgtgtatgaaagagtgagcaggtagataagtcaatagatgaatgctgttgcctcctcaaatcattagttgtatgagcttgggtgagttaaacaacctttctgcactgttaatttcatctgcaaaatgagaggattaatagatcaaatatttgtagctgcagaactctgttttcatgggaaataatttggaagcccgaaatagaagccaagtagtagcagaactgttgtgtcaggccagtgccatagtggccgggaaactaagcctcattttttatccagatcatattagaactgcctcttggaacaaagaaacactacctctagtgtttctgcaatacagtgttctgtattacagccttgactactctactttttcccccactccagtcaagttttacattttgtagtaggcctcctttttgccatcttcgtgaagattctgaattttcctggatggataaaaatcataaggataataaatggatatttcagtgtttttttagtcagtggtttgcaaaaccacctggagggcttgggaaaacacaggttgctgtgtcctacccacacaggtttctgattcagtaagtctggggtatgaccaagatattgcattttgagcaactttccgagtgattcagaaattatactttgagaactactatcctatgtgagtattaaaaatgtattttagtcacttttcttattttaaaaattacatcaaatcatataacttcataaagctcagaaaacaatgtctgagtaatatatggtttttgaaaaataacatttaagtgacatattccgatgtcatggagcaagtgagaaactggtttgaaatgtttgctatctagtgtcaagggctatctatccctttttgacttcttgtgctactggtgcaaatggatagatattaatcctgcagcaatcaggatttgcttcagcaataaagaaattattgatgtctgaaagcaatcctttccttttgacatgttggcagcacctaagaagaaaatgtcagggtcaatataagtgcatttactgacagtttggctctttcctatgttacagaaaatgatttcacatttagcttttatcaaaaacagaaacactgaccactctgaaggatataaacaatagctttcagcttagtcattttccacttataaagtgatactttcatagaaataaacaatgcaaacttcagagagccaaaacaattacacagaaaaaaatcattgcatttttgccatttttaactcagatttaaaacaactgtgtctggtagtaactggagaaaaatcactgttttgtgttctgttaagttaaaacagttaaaatcactttatgataaaatatggccaaaaagaagaatcatcttcaattaggtacttcaagatcacttgtattctctgcttctctttcagagcctgatccatgtatttcttaaacttcttcatcatatataaaatttcgtgtttataaaatttccactaaaacctcaattattagtttcatgaatcagaagttacaattagtttcatttctggctcaccaagatttgtcaatttctggataaaagggactccctattcagaatatccctttaaatcttttttaaaagtgcacctttgatgtgtacatgtttttatgttatttatggcttctgaaaatattatgcaaaaaaattgttatggaaacaacccaaatgtccacaagcaggaagatacattgtgatagatccatacaatggaatatcattcgttcataaaaaagaataaagtactgatgcatgatagaatgtgagtgaacctcaatatcaagaaaatggacgaagccagacataaaggatcacatattgtatgattccatttatatgaagtatccataataggtaaatccacagaaacaaaagcagattggtagttgccagggacttgtggggagtgaggaatggggaataactttttaatgggaagatagggtttcttcttggggtgctaaaaatgttgagaagtagatagaggtcatggttgcacaacactgtgaatataattttatgtgaattttacctcaattttttaaagaaatcagttgatttaagacttaactgaattctagaatttttgaaatgaaggtgtttctcaaggtcatccaacccaatctcctgtttttcacaaatgaaaaaactaaaactcatcaagattaaatactatatatcactaagattgcctagtagctagtccaaacccaggccagaatttgagtatctggatttttagcccagtgatttctttttaaactactgcatgctgctttattatcaattgctattttttttaaatttttttctgggaacatactacaagtgttagtttaaaagtaaactaacataaaagtaaatacaaaaagaagcatagcttcctttgtgccacatataagaaatgtagacatagagagtgtttattgcagtaatttgccaaaaagcaagccatagtttaaattagaagaggtttattccctgcagcactttcacaatcacagaaggcacctatattttaaatgtagtctacattggcctggcttatgaactgcaaccttctatgattgcaattcacttttttaaattaaaaaaaatttcaaaataatttttgcataattattagcacattctaccacttgataattttttgtttctttcaatagacgaaagcactcacattgtaaaaaaattatataaatgaccttgtcttgtgatgaagctagaagatctgttttcaacgaaactattctcagaggcatctagggagaaacatttgagtcaggttgggagttagagatagaaagcagcagcaattaaagcaagataatgtattaccccctggaaattgggtgttatactcaaatgtaaaggacttgtattgatttagtgctagcctcagaaaatagtcagatgtcctcattttaagggaaaactttaggaaatgtaattatatcgtttctttctctctaaatctgccttagttttcaatttctttatgtagttcgttactaagaggaagctacactctcattaccacactaaatggattttctattaatatttatctccaatgttatttttatctgggttgttgttttcatttctacttagtatgtattttcttctttccttttagttcagaggtcaacaaagtatggcctatgagccatacgctacaatagcagagttgagtggttgcaacagataccatgtggcctgcaaacctaaaatatttattggggcattttacagaaaacacttgccagtccttgctttagttgaccaagtagaaaaggaagagcagattctacagagtgaataaatatcaccagcaaaggaaaggatatagaaaggtacaggatttatacttaggctagctagaaactccatatggtcaaagtaagagttttgtggatgtgagtcatcagagattatataggaaagatagattactgtcagatttagaggatttttaatgccacttcaggaacttgagctactattgtttaggaaatgagtcatttaaggttttttgaacaaaggagctttgccagagcaggaaagtgttgcagtagggtttacaaagtaatgagagttatcaactaaagttatattaataggaaggatgacatagttccaggagttgctgtataattaaaattgataggaccttagacactgcattttgagacaaagagataatagtttaaagattaaaacttcattgggcagaaaaattattatttatacacatattagggaagtaaagagctaatttttgtggaaggtttaagttgatggagaaggattataacactacataggataagaaacaaaactgattactagttatcagcattactgaagttgttcactcatcccaggcacaggcaattttttactcgccatattttatctccagggcacccagctgccatcatcttgtcagggtccatctctttataaaatcctcttactttgctctccagaatcccaccctgatacacagatttacttacgctacctcatacagaataaagtacttccattttccaagtactctgaaccatgctcaagaagggctttagctctctcaaataaaaagacttatctcaaggtgtttaattcaagtagagccacagttccgaaactgtgcactgacaccccagggtactgcagcagactcacaagagtgctacaggatattttatatcggtttcaaaattaaattttgctacattccttttggatgatgtctttttaaaaaataattactgttgttgttttttttttaatatgtacctcctgaaaaatcaatgcagaatgggaaatgaaggtagcagtatccacttggaatacaaggcttgaagagtgtgcagtattccataagcatacatattcatttagtaaatacagttaacccttgaacagtgccgggggttagaggcactcccctcccccgggtagttgaaaatccatgtataacttttgactccccagaaactttactaagagcctactgttgaccagaagccttacctgtaacattaatcattgatgaacatgtattttgtatattatatgtattatacagtgtatttttgtaacacagtaagctagagaaaagaaaatcataaggaaaatatattcattgatatggtttggctctgcttccccactcaaatctcatctcgaattttaatccccataatctccacatgttaagggagggacctgttaggaggtcattagatcatgggggccatttcccccatgctgttcttgtgatagtgagttctcgtggaacctgttagttttataagtgtttgacagttcctctctcatgtgccctctctcgcctgctgccatgtatgacatgcctgcttccccttctgccatgattgtgtttcctgaggcctccccagccatgcagaactgtgagtcaattaaacctcttttctttataaattagtcagtcttgggcagttctttataggagtgtgaaaacggactaatacatttattgttcattaagtggaggtggatcatcataaacatcttcatcctagtagtcttcacactgagcaggctgaagaggagggtggggaagagctggtcttcctgtctcaggggtagcaggggtggaaatgatgaaggaggtggaaaggatggcagaagaggtaggcatactcagtgtaactttacagaaatacgttgtaatttctgtcttatttttcatttccctaaaaatgttactctaaaaatgtttctatatggcacctatccttccaccttttgcttttggttcagtgcccatatcatagaagggtccatgttgtaaaagaagtcaaaagcagtcttttgaataactggaatcattctgttatatggtctaatatgaatttgtttctggcactacttattctacatcttctttctcatcatctggcactgatttggaagcactcatctccatcaagtcatcttctgttaattcctgtgatatggtgtctgttagctcttgaattactccaagatccgtatcttgaaactcttcaacttccccccacttttttttttttttttttgccatatccacagtctcttttatgatatccttgattgactctgttgtaaatcctatgaagtcatatacaccattggacacagtttttctctagcatcaatttatttttttgggcttgatggctttcatggctacttttgtaacaatggcgttttccatgatttgattctttcagatatccttggtgttctctaagttgaggtctacttccatagcattgacaatcttttctatagattaccatgtgtaatgatctttaaaggtccttatgaccccctaatctagatctgaattagagatattgtgtttgatggcaagtagaccactttgacacctttgttgttgaactcctggtgtgggtgacccggggcattgttcaatatctaaagaaatttaaaagacagttccttactgacaaggtacttctttgtcagcagaagttacttctcctcttatccattttttgaagccaaacctctttctaaaaatgtcaagccatcctttgctgacattaaattctccagctttaaatccttcaccttccttttgctttaagttgtcatataatgacttcaagtcttactagagtatgcctttcttatagcaattctgtactcacattgtattttaaatataagataaaaagatattttacagaaacttcaaggttttcatgcctgctgtcgtagctgcagtgatggctccacaaagtcctcccccaaccacaatggtccttacactggattcatctatcttgaaatggtgggcaaccacagctgcagacctcaatctacggtacatatcaagcaagtcagcttttttttgtaatgatttttctctgcttcttgggagcacttccagcatcactagtgacatttcatatgggtcccatggtgatgttcaagatttacagtattgcactaaacatgatgaaaaataattcaagaaccatgagagatcactttttattgcaatatgcaatttactgtaagatgtagggttcactcagagatgattagcatcagatgtcattttcaatggatacaacacttgagctcactgcaaaagcaacaggtggtagttacaacgttgttacaatagtacagtatttactgcagttcattttatgcagttaggatttaatactgaatttttacatttgtttacatttctcttgactcaaatgctgccgtgtatggtctgtaagtgtttgcctgtgtaagttttgatagattttaactttttataatacatttttatagttttatgatagtgataaaatagtatctacatatactttatgagttcatgacatacttaacaatttttatcaatatttctaggctacacagtttgtctgtagagtatttcaaactatcacaaatttccaaaaaattttctgatatacttcttgaaaaaatttttacacacaagtggatccatgcagttcaaacccaagttgtacaagggtcaactgtattgtagttattttttaatgagattttaaaaacttttttcaatttatatgtatttttcttaactgagtattaaattctgaagctagtacttattaaattgtttggacttaacattaaacaggactgttaggcatttgttagcataccatgaaaaaatgaaaaaaataacaaaaacactaaaaacactgtaaactgggaaagtttcagattctctgaatttgagagagttgttcaactctaaaatgaatgcattcttccataagcatgtgaaaaggcagcagtctttcttttttctctttttttcaaaattgctttctagactgggcacagtggctcacacttgtaatcccagcattttgggaggctgaggtggacagatcgcttgagcccaggagtttgagaccagcctgggcaacatggtaaaaccccatctctacaaaacatccaaaaattaaccaggtgtggtggtgcacacctgtagtctcagcttctgtggaggctgtgaggtgggagaatcgcttgagcccaggaggcagaggttgcagtgagccgagatcgtgccactccactccagcctggtgacagtgaaatcccctctcaaaaaaaaacaaaaaaacaaatttgaaaacacattctagtgacatgggattttgtgtagcatcttaacaaaaatgtaatcacatatttaaaaattttctgtgctttttgctgtatcaaacaaaaaaagtaagaagtgctcttccctttaaggttatggtcaggtcagagtggtaagacaaatacaagttgcttatatcattaagtaaaataaaataattaccctcatttatttcataatatcacatattatgggcattcaaagaagaatgtgtacatctgttagtgggaatgaagaaagaatttgttagattttaaatgggcattgacatgttggtaaattctaacatgtagaggtagtggacatttcagatagaaggaaaaacataaaaactcaagatttattttgggagaagcaaattattctatatgactgaagcaaggacatatgttatgaagtaatgtagattacagctggtttactataagttggagtactatcgtggagcactttgaatgctggggtgtgaggcatttggattcaatttactaggaaaagaagagtgattagggtgattaatctgtcagcaagatataggatgattaaatcaaggagagaaaggaggcagggatagctttttaaaagggaatgatggattttgctttatgtatatgtatttcaaaggaaacaccaaactgttgatctttaaagagcatacttttgttcagcactgtaactaacagttgtaacataaaactcacttttctgatgggaggcagaagactttctaactttcttgttatttctagaggaataatatcaatacaatgtaaatatgtatggaatgcatactataggccaagaactatattaagcatttatttaattctcacaacccttgagagacattattattcccattttacaggtgagaacagtaaagcctagtaaagttaatgttgtccagagtcacatagttaataagtagacagattagcaaaaatttttaaaataagtttactagttggtttaaactaaggagaattgagttaattctccttgggtcttatcaaattatcttcatctgacttaggcatagtttctctctttttttatttttcatatcactcctgatctcttcccaccatgggtactcttaatgtgtttgatatggctcttacatttggatgtgtcctttaagactgtattgtgttattttagatgcatgcatatgtgtttaaattatacataatatataaaagggtaaattatagcttgtctgatttgatatatatgtttctactctattgcttttatatttttattttataagaaacacacatttttattttataagaaacaaggtcttgctattaatatgttaccaagaccagaatgcagtagttattcacaggtgtgatcattgtgcagatagccttgaactcctggcctcaccctatcctcccacttgagcctcctaaatagctggaactacaggtgcatgcagctgggcctggcttagtttactgcttttttaaaaataatttacaaataataattgtacatattcatggaatacattatgatttttttttttttttgagacggagtctcactctgtcgccaggttggagtgcagtggcgcgatctcgcctcactgcaacctccaccccctgggttcaagcgattctcctgcctcagcttcctgagtagctgggactacaggtgtgcaccaccatacctagctaatgtttgtatttttagtagagatggggtttcaccatgttggccgggatgatctcgatctcttgacctcttcatatgcctgcctcagcctcccaaagtgctgggattacaggcgtaagccaccgtgcccggcccataatgatgttttgatacctgtaatgtatagtaatcagacagggataaatagcatatccatcatctcaaacatttatcatttctttgtgttaagaacatttaatatcctccatctacctatttaaactatttaatatatttttgttaactaaatagtcatcctgcagaggtatagaattctataacttactcttatctagttgtaattttggtatcctttaacaaatttttccctatccttcctttccccctactttcccagcctccaatatcctctgttctaccttttacttctataagatcaacttttttttatcttctacttatgagtgaaaacataccatgtttaactttctgttcctaacatttcacttaacataatgtcctccagttttatctatgttgccatgaaccacaggattttatgcttttttatggctgaatggtttttctttgtgtatacattacacattttctttatccattcatttgttgttggacacctaggtttgttccatatcttggctattgtggatagtgctgcaataagcataggggtacacatgtcccttaaatataatgatttccattcctttggataaattcctagtagtaggattgctggatcatgtagtagttctacttgtggtttttaggaaactccaactattctccatagtggctattcccaccaacaatgtattaagagttcccttttctccatcctcaccaacatttttttttctttttgataatagccatcctaactggggtgagatgatacctcattgtggttttgatctgcatttctctgatgattagtgatgttgggcactttttcatatatttgttggccatttgtatctcttttgagaaatgtctgttcagatcatttacctattttttaataagattggttttttgctattgagatgtttgagttccttgtatattcttagtattaatcccctatctgatgttatgaatagtttgcaaatattttttcccattctgtaggttgtcttttcactctattgattgtttcctttgctgtgctaaagattttcagtttgatataatctcatttgtttatttttacttttgttgcttgtgcttttgaagttgtattcataaaatatttttccagatcaatgtcctaaagcatttcacctgtgttttcttctaggagggttatccttttaggtcatatatttagttctttgatcatttttttgagacagggtcttgctgtgtcacccaggctgcagtgcagtggtgcgataatgactcactgcagccttgacctcctaggctaaggcagttctcccgcctcagccagctgagtagctgggactacaagcatatgccaccatgcctggctaatttttatattttttgtagagatagggtttcaccatgttgtcgaggctgatctcaaactcctgggctcaagagatccacctgccttgacctcccaagatgttgggatcacaggtgtgagccaccatgcccagcctctttgatccactttgagttgatttttgcatgcagtgagaggtagaagtgtagtttcattcttctgcatatggctatccagtttgctcaggaccatttattgaacagactattcattccccaatgacaattcttggcacttttgtcaaaaatcattttgctgtagataatgtggataaatttctgggttctctatgcctttccattggtctatatgtctgtttttatgctggtaccatgctgtttgtgttattatagctttgtgatatattttgaggtctgatagtgtggtacctccagctttgttctttttactcaggattgcttcagctattcagggttttctatgtttccatacaaattttagaatttttttccatttctgtgaaaagtgtcattggtagtttgatagggattgcactgaatctatagatgtctttccatttatttgtatgcacttcaatttctttcatcagtgttttgtaatcttccttgtagaggtcttttatcaccttggttcagtttgttcccaagattttattttcttttctagctattgtaaatgaggttgcctttttgaattcttgttcaactactttgttgtttatgtacagaaacactactgatttttgtgtgttgattttatatcctgcaactttatggaattcatttatcagttctaagagttttttggtagagtctttaggctttttaatatgtagaatcattacatatgcaaatagggacaatttaacttccttcttctcaattttgatatggtttatttctttctcttgcctaattgctgtggctagtacttccagtactatgttgaataagagtggtgagagagggcatcattgtctgttccagttcttagaggaaatgctttcaggtttcagtaagatgctagctgtgagtttgtcatgttgaggtaatttcaacatgttattatgttgaggtactttccttctatacctaatttattaagagtttttatgaaggaatattaaattttatcaaaagcattttctgcttttcattgagatgatcatatgatttttgtccttcattctattgataggatataagacattcattcagtgacatatggtggaccatctttgcattcttgggataatcctcacttgctcataatctttttgagacactgttgggttcagtttgctagtattttgttgtggacttttgcatgtatgttcatcagggatattggcctatcattttctttttttgttttgtccttatctgtttttggtatcacggttatgttggcttcatagaatcaattaggaagtatttcctctgcttcatttttggaataatttgggacaaattggttttaattcaacagtgaagccatccagttctggactttttttttttttttttggtgttggaagactttttgttattaaatcaatcttgtttcttgtcattggtctgtttaggctttctatttcttctttcagtcttggtaggttttacgtatccaggaatgtgtccatttcctctaggttttcaaatttgttggcatatagttgttcacggtagtctctagtgatcctttgtatttctgtagtatcttttgtgatgtctccttttttgtttcctattttaattatttagatcttctctcttttttcttattctagctaatggtttgtcaattttgtttagaagccagctttttgttttgttgatcttttgtattttttttgtcttatttttgtttatttctacactgatcattattatttctttccttccattaattttgggtttagtttattcttttctagttctttgaggtttatcatcaagttgtttacttgaaatctttcttgttttttgatataagcatttattcctataaacttgactctgaatactgtttttgctgtgtcccataggttttggtatgttgtgtttctgttttcctttgtgtcaaagaatttttaaattttattcttaatttctttctttatccattggtcattcaggagcatattgtttaattttcatgtaatggtatatttctaaatgattctcttgttatagatatctaagtttacgccattgtgttcagataagtacttgatattttgatcctttaagaatattttgagacttctattgtgtccttacacacgattgatcctgagactgttgaatgggctgatgaaaagaatgtgtattctgccactgttggctgaaatgttctataaatatctgttgtatttagtctatggtgcagtttaactctgatgtttctttgttgactttttgtctacataatctgcccagtgttgagagtgggatgttgaagtccccaactgttatttcactttagatctaataatatttgctttacatatctgggtgcttcagtattgggtgcatatatatttacagttgttatattctcttgttggatcaatccttttataattatatagtagccctctgtcttcttttacagcttttgacttgaagagtgttttacctcgtataattatagctattcctgtttgcttttagtttccatttgcactgaatattttttccatccacttccagtctgtgtgtgtatacaggtgatacaagtttcttgtagatagcatataattgggtcttgtttttttaaaatccattcagctagtatgtatcttttaaatgtggaacttaatctatttacaatcgtgttattattgataggtgaggacttactcctgtcattttattgattgttttctggtggtttgtatatcctttgttcattactttctctcagtgttatttttgcagttgaatggttttctctagtgaaaaggtttgattcctttctccttctcctttgtacagcagctctatcagtgtgttttatagtttcacatattttcatgatggtgattattgtttttcatttccacatgtaagacccccttgagcatttcttgcaaggccagactagtggtgatggattcccttagttttgctagtctgtgaaatattttatttgtcctttatttctgaaggttagctttgctgggcgtattcttgggctaataatttttttcttctagtactttgactatattatcctgtcctctcctggactataggatttctgctgagaaattcactgttagtctaatggggattcccttatatgacttgatgcttttatcttgctgcttttagaattctttctttgtctttgacttttgacaatttaactgtaatgtgccttgcagaggtcctgtttgaggtgaatatatttgagctttctcgacttggatgtctctctgtctttctgttattatttcattaaatatgtttttctcacctttcccttcaccttctggagatatttatttgcttaatggtatcccataaatcctttaggctttttcattctctttttttttttaaagttagtctgcctgtgttatttcaaaagatcattcttcaagttcagaaattcttcttcttggtctagtctgttgtttagctctttattgtattttttatttcattcattaaattcttcagctctaggatttctgcttcattcttttttatgatatctgtctttgttgaatttctctttcaaatcataaactcttctcctgactttgttgagttatctatcggtattctcttgtatcttattggatttctttaagattattattttgatttttttcccacatttcatatatttccttatagtttggagtctgttactagataattattgttttccttttgacattacatgttttcttgctttttttccttcttcttcttttaagacaagttctcattctgttgcccaggctggagtgcagtggcacaatctcggctcactgcagcctctacctcgtatgctcgagtgatcctcccacctcaactccccaagtagctggaactacagacactcaccaatatgccctgctaatttttgtggtttttagtagagacagggtttcaccatgttgcccaggctttttcttgctttttcacggttgatgtgtccctgtgttgatttctatgcatctggtggaaaagtcacctcttttaattttatggaatagatttcataagaaagaatacgaatgagtcttgggttgttggtttggtggggtacattagccttatttctagatacagttttgtagtctctgagtaatttcttcagctgtaatccactctagtggcatttgtgagtttctcagtggcatgggctgagagagtttgtggcaatggtgatgccactttgccaggggtgggctcactagactgtttctcaggtctggggtatgtatgtgcacatagtaggtcagccaacttggttggtgagattggcttactgagactggggccacaaggctgttactctgaccagaaatacaagtataaggttgcttgggcaacctggggacatgcctgccaggagcagctttcaggtcggggacgtgggcttttggccacttggctggcttggagatattccctgtggcacgggggcagtctgcgggactatctctcaggccattattgggggtaaaggactgttgggcaggccaagggcgtgcctatgggggacctgtgtgtctgtttctcaggttctgattgcttgcaggtagccctactctgctggccctgggccatatcaccttctcagaggctcagggaggtctcctgcttagagaagggagcccagcagtttggccagcttaagagcaggcttgctgtgggtaggactggcagactggtttctctgttggtggtatggccatggttcttggttttcttgctgtgcaagaccagaataacagccagtccagggtccagccttcaccagcttggatcatggtgttcagaaacttgtttggagttggcataatgaagatggagccccagttctggagaggtgcagtggccactttccccccagaggagggcatactacacaggtggctattctcaagatgacgccatgttacagcagtttggctcacagtggtgggatggggagtacacaccttgtgctcttaatccaggtcagtgcgtctgcatgaattcctggcagctctccaaaatgggctcagggcttgtgaggactatgggattcttgtgtagtaaggccttcatgtgtttgtggtggcaaagaggctggtagggatcttctgctgacttttttccctgcaatagcaattccctcccgtctccaggcagatctgatctaggtggggaagatgggaccacgagtttgagtgcctctatgctgccttcctagatttccaatcaccacaggtgcatcttcattctatcagtgcaccccactactcttccttcacactccagtcaaatcttagctgtttgtttgttgccttgatcctttttttgtgtgtgggttagacaagcaccaggtatccctactcagccatcttgctgatgttactcctttattgcttttcttttcttttcttttctttttttttttttgagatggagtcgcgccctgttgcccaggctggagtgcaatggtgtgatctcagatcactgcaacctccacctccttggttcaagcgaccaagtagcctcagcctcccaagtagctgggactacaggcacccaccaccacacccaactaatttttgtatttttggtagagacgggagctcaccatgttggccaggctggttttgaactcctgacctcaagtgatccgcctgcctcagcctcccaaagtgctgggattataggctggagccactgtgcccaactcctttattgcttttaatctctgcatagtagtgtgtgtattagtctgttttcatgctgctgataaaggcatacctgagactgggaagaaaaagaggtttaattggacttacaggtccacatggcttgggaggcctcagaatcatggtgggaggcaaaaacagaaacccctgagaaaaccgtcagatctcgtgagatttattcactaccacgagaacagcatgagggaaaccaccctcatgattcaaattatctcccaccagtctctcccacaacacgtgggagcacaattaaagatgagatttgggtgggaacacagagccaaaccatatcagtgtgcattcaccacattctcatcttttcccctagaaatagacttctaggatttctcacactttatgttcaacagagctatataaatatgctcctatgtattcccttaaagcccatcttctttctactatatctttttcctcattttacttccttttttgagggagttatgtgggatagaagaaaaatggacttcttcatttataacatacctgaagttgggagtattttaatccttaaacagattaaaatgagctgggtgtggtggctcacacctgtaaccccagcactttaggaggctgagggaggcgtatggcttgagctcagtagttggaaaccagactgggcaacatgacaaaatcctgtttctactaaaaatacaaaaactagctgggcgtcgtggtgcatgcctgtagtcccagctacttaggaggcagaggtgggaggatcacctgagcccaggaggtcgagggtgcactgagctgtgattgcaccactgcactctagtctaggcaactgggcgagtctctgtctcaaaaaaaaaaaaaaaagagtaaaagatatgcagactatgtgattttctgcttccaaaaggaaccacatagacaggaagaagatccaagtgaattattctcttctatttctttacattgccttctgtcattggtaacataacctttatggcattcacaagtatatttgttctagctttcttcttttagtaattctgttgctgtcgtttgtgtgaaatactgcatattataacattgtaattataaatgatttatacattatcttaatcgttgtcagggccaacgtttttcttacaagcagataggaactatgctttgttgtaactcatatttgatcgactctgagaacaaaatgtattttatactttcttggagtagtcccacaaaacatgtaggacccattaagaggaagaaagcatgctatatggttgttatatttgttatttttgacttgtaatttattcattctctcagccctgttctctgactagtgttactatggcacctaagttatggcatggaaaacaagctaattatgttcttcagaacagacgacagtgatacatcttgagacacaagcatctggtagtcttagccctttcctcatcagtgctagtctaggcttggttgggctctctggttgtccaaatatttttctgttacaacacatccttctttattttatttttcttctataaatagtggtttatgctttctaaagcctctagtctcatatttagtttgttcctttttgagccttctgtctactcaaagaagtaatatagacttactcccagctgtgtatgatctactcttactcctgtttattgagttaagctttttactatttgtaaacatctcttggttgtgtagacacaaatacaccaaaactaaaaatggttaaattggggtgaaaacttacggatatttcttacaatttatttttcaaaattcagtgatgtagttagatggctctcctgataaaaattgtttaagagatatgagtaatcaatacttttttatcagaagtgacatctaaccatattaccaaattttgaaaaacaaagaaaatattagaattatccacaatttttgtacctaaacttaaccagttttacttttgtttattcccttataatcttttttactattgatttaatgtaggttataatcatactgtgtacacactatttgtatgtcttctatttaattgaatatttatgtgccataagcattttctactttactacttagttttcatcatcatcatcatttgtaatatctttaaaatattctctggagtggtgctattcaatagaaatataatttaaaattttccaggacccatatgaaaaatgtaaaaagaaacagcttaataatggattttatttaatctaatatatctaaaatatttattgtttcaacatgtaaaaattatataccgtattagacataaaaattattagattttaaccttcttttcatagtacatctttgaaatgtacctattttacatatataccagtgaattacgtcactaaactttcaatgtcaaaataaaatgtagtcctaccaaaacaataaagctccagcagaaaaatatgaaatgcttcaatttttacatttaaattaatgaaagtaaattaaaaatttagtttcacgatcatactagccacgttacttatgctcatcatgtacatgtagcttcttcatttaaatttaaattacatttaaaattcaagcctctctttgcactagtcacattttaagtgatcagtagtgagctttagagtatatagccaattcttgactgttcctctgtcatttttttacattgatttcaatgaaataagtacactgataagtttatgaatgtatattttcccatgttttggattactttcttaaagtagactctcagaagtagaattactgggtcaaagagtataatcaacccttcttcatcattgttaccatattgtttctttagttactagagaggaatatttctctacatatttatttactatgtatttctctttcaatggaatactttttaatgttatggtttatttatctattggtgtcctaatgtttgtttaatttttagtctacttttaaatttctttgtggactaaagatactaacgctttgtcttgtttttcctcatcttttgtttatttgtttgtttttttccttctgggagtaccaactgaaccctttacttttactatagcaaatatttagataatacttcctctgtaagcttcaaagtttttcccactctagaagtttgatatttacttctcttttatcatagattttctatgtatttttaaaaaatgtttttatcaaactggaatatatgattatgtaattgtgagaaaataaactaaattacaagttcttaaccttcagttgaatccagtgcttacccattatttttagataaagcctcattatatatagttgctgaccaccactgcatagttttacgcatatgtgtagttaatcaggaagtagatggacccaaatagattaaaatctactgtttcaaatatttcaaaataatatcatatattcttccctattatattctgatcagaatattgttctcagtaaaaacaaagtcttttttttttctatatcaccatgtatccacagttgattaattatagtcatggttattttacataggtttatttccttttgaattaatatagacttatacttccaagagttataaataactgaaatttacatagttgtgtatgcacacatacacatacacatacccctattcctcacataattggtaatagaaataatgaaaagaggttgtgttcttaggcaaggacaatttaaaagaaccccaaatgattaccttgaattaaggtaaacactggtaaaaaaaaaaagagcaaaaagggcaattttttcctttagtatattaaacaatgttgtttctaacattccctcacgtttagactactctgaaaaatccttagagtggttgtgtaatgtgtttaagttttttcgatttccaagcattaagtctggctccactaaaacggttgtttggttctattttagtctgtccctatctgtcctactgctaccactttgtgttgttttgttttctgttataatgaatacaacagtcccacttcattctcagttctaattaacgttatccagcctctaagtgttagcatctactttgcttttggttataggatcaacgataaacagctaactgttgtgcagactgaaatccctaattagtaaagcacaagattttattggttatatatttttctaaactatagacttgattttgttgcaaaccttacatgtagaaaaaaaattttgtaatggcactgtttttatttttggtgatactatagtctggaacatgtggcccagcaaaggttataaatctagcaagaaaaattatggatggcatcaattttaacagtctttgcgatctaacagagcataaaccccaaattgtttaaatactaaatatttacttaaagaaaaacaagagatcattcaaaaatagaatttaaatagtgaatttgccttttatttaaaagttgacaagttttgtatatttataaaattaacaaaattgacatcatactatccatatcacaagactcttgtgttgtattttaaaggaaaacacacacacagcatacatacatttggattggggccagatttagactccaggggcacagtgttctgtaccttaaattacaatcagatgtattttagcacagatcaaattttcagtctgaagttggtgagaagcctaattatttgaccaggttactatttatgtagaccattctgtggctggctgtggttaatccacagctggcagaatgctagctatgggaggtttttatttgatgctggaacagtttggggagaaatagagggggaaagctttaaaatcttctcattaaatgaaagactaaaaagcaagacagtacatccatattactatggagacaagatgctgtataaactgttcgttttaattctccaagtgacagaaatagcaaagcagcagcttggatgctcatagtttgcaagtgataggatacttggttaaaaaagaaagataaaaacatttaaaaataataactaagactaagatttgttgcctcttagaacacttgaatattggtaaagaattaatggattcaatttttaaatgatgagaaatattgttattatacaaaaacattttgtatttcactaaacatactaaaacatttagaatttcactagcagtactttaaagtgataagaggcagttgtaggggagaaaaagtaacatattttcctcatccatcgcaagggtcatgactgaaccctctgtaacgaaacagattaacaagagaaaagcataatttatttaacaaagttttacatgacacaggagccttcagaaattaagacccaaagaccagcaaaaactgtatttttatgcgaagtctgatgaaagacatggatagttgtagagaaacattagacaaaaggggtatgatctaatggtaataaacctagggttgaaggatgtggaagccagcaagtcctgtctgttagattattcttggccaccaggtataggacaggacccctttggaaaagggttttatggccagctttcacacagaaaggtgggagaaggtcagagtgaccttgcttctgcgggttttctcaattgctagggggccatattttggggtattgtattctgggccctgacacaattatagtagacgattctctcttaacgtctcagaatatgtataaaggcaataaacccttccttaaaagatggaccccaatacacatggctcctgccactaaattaatttttttagtcttcttattgtagtctatttgaaatttgaaagtaatattttaaaagatttttttttctttttaaacttttcagagtttgcattatggaaatcgttggtccctcagttataagtgaatatctcagtagcatttttgtaacttttaacagaagtttcttttatattttcaaggttatttcttccatttataagccagttcttctccccttctagtttccagtgctcccacttcctctagttctttgctctaattatcctctctcccttgcctcttcattcttctatttctccaatagatccttttctttgaaaagcaaaatctttccaactttccctgcccttaaaagcaaatctcttctttcctcccttccctgcccacccttccccgcaaaaaagcgtttgtgccttttcctcctcttattatctgctcaaattagcaacatatctggagtcatatgaatccaggcttcatcacatgtaagctgtgtgtcctaagaaacatctcttaacttctctatcttgctttatttatcaaaagaaactaatatgtccacctcataggtttgatgtaaggaaaaaacaataactgagttgctgtatagtatagtgcctgggacacaataattactcattacatttcagatggttttattatcattactgatgaagctttgaaaataattattcttaccttactttctcaccattccttttttaacaactacttctaccatcatactaagtgctttctgttaatcatcaaatcttatgacttttactcattcctttctttctctacttccccatagcaccttcttaaaatttcccttgcttagtttctccaccatcacttctcctctcctcatttggcctcctcttgttttctccttttccttttttatttcctctaatttttgttctccattttttccttcgtcgtcttttgttctgtgttctctgccttgggaattacaccacctctttgacctcacctctttcatgacctttcctctaagtccaactttctggtagatacttagagatcccttagaacctcaactgtagtatgaccacaactaaacactctttaccatctaagccagatcttattctggaattttccacttttattaatggtagaaccagattcaaaaatctcaatcatcttttgactcttttcttctttgccttccacatcttaaacaattgccaagtcctgtatgtagtactcctaatatggttttcttttacacagccaaatgtagacatttattaactgttgctgaattgttgctgcccaggttaactttgctttaaattttcccataagcttgttattccttcctttcacggaaatattcattacccatgatccacccctacccctcttgcacattgcccaccaaatagattcctaccctgccatccaaggccctttgtattcttaacttcgccgaccttttcaagtctctattattgccctttgtgtattcctttacttgtttgtgcaccatccaaactaatttcctgtatatacatgtatgtctttgcttatgctttcctctagaaagcatgaatatgttttaataagactttcattaatattaaagctgtacataaatagcattttaaatgcagctttcctgacatgaaattttaaagaaatttaaagaaaattttaaagaaaaattaaatatttttcttttgcattactgcattcttttctcattatttgaaaattctaattcagaatcttcctcaaaaatcaatttagatatttcttaaggtaacaagttatgattgattgattgattgatatagagacaaggtctccgtgtatttcccaggctggagtgcagtggtgtcatctcggctcacttcaacctccaccacctgggctatagcaatcctcccgtctcagtctcatgagtagctgggaccacaggcacacaccaacacacccagctaatttttgaaatttttgtagagacagagttccgccatgttgcccaagctggtttggaactcctagactcaagtgattggcccaccttggcctcccaaagtgctggaattccaggtgtgattcattgtacccagccagaagttatgatcttaattaacagattattttaaagtcacttataagaatacaaactcagccaggctcagtggtgtgcacctgtaatcccagctacttggagggctgaggtaggaggattgctttatcccaggagttcaggaccagcctgggcaatatagtgaaaccttatctcaaaaaatatatattccaaactgtttgtaagaagctaaaaggattcagtttgccttcatagtacaatttccctaattcgaatgtaattattgtcttgaatgagacctttcaaacattttttctttcatgaatttccagaattctttagtattgagcatataaacctagtatgaaataagtaatgctttattctctgaagtaatggcatgtatcaagcatatggtactcatatgatcaaatatccttccagtcaaatgttgctattttctgccttgcatcttataattgtattttatatacttttgtattttgtataggtttcttttattctcactgagagtgactgtggagatggtatttctaattttccctccttttttcttcatccagggcttttttcttacagtttccccagagtcagtattaaaggtggctcaccatgcttctgaaaacaacaggattttcactttgaatctatctgcaccgtttattagccagttctacaaggaatcattgatgaaagttatgccttatgttgatatactttttggaaatgagacagtgagttacctttcctttttcaaaagaacctgggggttttttgtttgtttatttctgatgtgtgtatatatgtttagaaatatataaattaaatcctaaatttttgtgtaaatgtccttgagaattgtgcaacaaaattgcctcaatgtcaactgctctcagtattttcaatatttccttcagtatatactaacttctttcttagtgaagcatttatttatttatttttatatttttatttttttgaggtggagtttccctcttttcatccaggctggagtataatggcatgatcttggctcactacaacctctccttcccgggttcaagcagttctcctgcctcagcctcctaagtagctggggttataggcgcatgccaccatgcccagctaaattttgtgtttttagtagagacagggtttcaccatgttggccaggctggtcacgaactcctgacctcaggtgatctgatcgcctcagcctcccaaagtgctaggattacaggtatgagccactgtgcccggcccaacatttatttttttaaggtgtttgacgtttgatttacttatagtaagagtcatcctttttactgtaatttctgtgagtttttacagatggatacctgtcctgttactatgaccacaatcaggataaaaaagcacattcatcacttttttaagtctcttcagagtctaagtccatttgatatttgtttaataaattatgagtaaattttgatatattacatttatatttctttattaataatatttttaaaatattgtctgttatagttgaaggtgataaaatggaatttcatctcaacaagtacagttttttctttctaccaagaatgtattttcttccattctaaattatggaaatgcttatttacttaaatgcttatttactttgattgcttgtttactgtttatacctcttatttactgtttatacctctttaaaaatccatgaaagaggaaaaaatccttcagtgtgtcttcctatgacttggccatgtcacttgatggtttaatgtatacaatgaaggtattgtattaatcatcccagaagttcattctgattctaattccatagttctaacatagtttgaatatattcatcaattttatatctaataactgccatctgcctagaataacataaaaattgacctggaagtttacgagatcacctgggtaaagattaaaggatgatccatagaaataatatcacagtgtatctgcaaaggtgatggttacattggttataaatggtgacattggaaggaaatgctatattcttgataattcacaaattgagatactggcaagaaatagtggtaatagccaagtgccatataactgctagaagcctaatttgactaagatctaccatttagtttttccttattaacagttttattttgtaaagggtaaaagaagtaaatgggaaaagtgctattcaagccttttgaataacattaaagcattggtctcagtagtcttgagaatcattgggagaagttaacatttggtctcagagttctaaatagtcaagaaagatcagactggcagcacttaaataagttctctagagtttaagagacaaatcttaaaacttttaaaaaagataaatatgattccaaagaggccgggcacggtggctcacgcctgtgatcccagcactttgggaggcagaggcgggtggatcacgaggtcaggagattgagaccatcctggctaacacggtgaaagcccgtctctacttaaaatacaaaaaatgagccaggcgtggtggcgagtgcctgtagtcccagctactcgggaggctgagacaggagaatggcgtgaacccaggaggcggagcttgcagtgagccgagatcgcgccactgcactccagcctggacagagcgagactccgtctcaaaaaacaaacaaacaaaaaaaaaaaaacataaatatgattccaaagaatgaaactttggaagtaaagaaagcttagggagattgaatgccataaaaaatgctatttggactttatagtcacaaatgatcttaattaaggagagaatgtggagggaccttttgaaaaaatatagcagagcacgcagaaaactctttaataagagctcaaatttggaggataacgagatagctgcctctgcctttgccggtgcagtgagagcagcttcaggaatcttatggcctctgaatattttggcatcttcagcctaccaaaactgtgtcaaaaatgcctctcttatttctgcattgtccactggacgttttagtcatattcagacaccagttgtttcctccactcccagacttaccacatctgagagaaacctgacatgtgggcatacttcagcgatccttaatagagtggccctcttgcttccaagtgtcttgaagctgccagccagatctctaacatacgtcagtacaggaaaaggcaagagaaggattgtgaaagctgtcatctataggtttcttcgacttcattgtggcctttggatgagaagggctggttataagaaaaaattatggaaaaaggcacctgcaagaaaaaagcgattgagggaatttgtattcggcaataaaacccagagtaaactcttaagataaaatgacgacgtccttctggaagaggtgaaactggtatgtccatgatccttatcagaagtgtcatgatcgaacaaacctgaaagtatagatcagaagtttcacttgtttctcagttattgaatatgtatctttgtgtacatatctgcaaaaatggataagtaaaaatctcgatgtaaattgtatcaatgaatatgtaaacatacagtgacaacactgaacttataaaagttttaaaacttaaaaaaaaagctcaaatttgtaaaagacatgtaaaaagaaggtggaaaatgtatttagaatcagggaatgatgctaaaagtttggtagagacaaaagagaaaagaaagtcccaaaagtggtttaagtttgcagcagatgctgatgatatcaaaacaatcttcacttaaaaaaaaaaaaaagactccaaagtacaagcaacaaatggaaaaaatagataaattagacatcatcaaaattaacaatttttgggcatcgaaggacactaacaagaatgtgaaaagacaactagtggaatgggagttaatatttgcaaatcatatatctgataaaggattcatattcagaatatttaacacagtaacaactcaacaataagcaaactaacaacataattcaataatgatcaaaggaatttaataaacatttattcgaagaagatatacagatggccagtaaacacatgaaaagatgctcaacataaccattcaagaagtgcaaatcaaaaccaaaattagataccacttcacacccatcagaatgacaattgttttaaaaaatggaaattaacaagtattggtgaagatgtggagaaattggaaacacttgtgtattgctggtgggaatgtaaaatgggaatgtagaagacaatttggtggttcctcaaaatgttaaacatagaattattaccatatgatctagcagttctacttctaggtatattacccaaaataactgaaagcagggactcagataattgtacaccaatgtccatagcagcattattcacaatagctaagatagaagcaaatcaaatattcatcaacagatgaataaacaaaatttcatgtatatatacaatggagtattatttagccttaaataaaattttgatacatgctacaacatgaatgaattttggaaatactatgttaagtaaaataagccagacacatcagacaattattggattttctaagaagaattccacttacaagaagtatctagaataggcaaattcatagagacacatagtaggatagtgattacctgggagtggggtggggaggaatgaggcattattgtgtaataagtacagagcttctgtttgggatgatgaaaaagttctggaaatggatagtggtgatagttgcgccacactgtgaatgtatttagtgccaatgaattgcatacttaaaatggaaaattttatcatatgtatagtttaccacaatttttttgaaaaagttttattctacaaatcagtaaacttaaaagttggatcacagcttagcatagattattaaaggaattatttttccccacctagaagaggaagtggtaaaactgtaagctgctacgtggctgtaagtcatggggcaagaaaatcttttctcttttggtatgattattgttcatttgaattcgcttcaagaggtatttatatagtacctaagtacctattatggcagaccaataagcagtggatacatagtatattttagaacatctgtcattacgtggactatagaataataaagattggctataagacaattagaggtatttggtattttattgaagcagtctcaaaaggtctgttgataaataaattgatttctaggggtacgcctcagtgtttaccctgcctttgcttaagtaaacagtgatttagataaagctatatttgcatataattcaaatgcaaataatacaacaccttaatacatactaggtaagttgaaggtcaaaatcagatttttttaaatgttagtagactctaaatatcagttgagtgatgaaatttaatagggataataaaaattatatcgtatttgattataaaaagcaagtagagtaaaatgctttatccctttaatctcatcatccattgtttttctccttgaatactatagtgataatgttatcttcagttttccaggaaaaaagagacattttacttctaaaatgtgacgaaggataaaatatagttatcagagaatatacgtaggattctttaatatttcccccctcaaaaaaataaagtatactgtgtttagtataaatttttaaaatgtcaaaactcagctaaaatcaaacacacttggcccttattttctacatgtcaccttcctcttgtcagaggattgtacagtagtaatgatgatttaaaacttctgatagcctcaatatttaaaaaaaataataccttgtccacaaagattatttcttcacaggcaatgatcaatgatccctgtgagacaagaaataaataagataaacctgatgattaccccagctaactccttggagataatttccaggcaacagaagaaaggtaactaaggccaagcacagtggctcacgcctgtaataccagcactttgggaggctgaagcgagtggatcctttgaggtcaggagttcaagaccagcctggccaacatggtgaaaccccctctctactaaaaatacaaaaaagcctggcagggtggttgtgcgcctgtaatcccagctactcgggtggctgaggcatgagaattacttgaacctgggaagcagaggttgcagcgagccaaaattgcaccactgcactccagccagtgtgattgagactctgtctcaaaaagaaaaaagaagggtatctcaagtagacccttgcagtctcttttaatgaggagttggagccggaagttcaaggagtctaagacagctagtgtttgtaagttaaaagtaccagagaagaaatagctgaatagagggagaacacaggacatttgcagaatcccaacaagtcttcagctgagtatgaatcagtgcatttttgtgaagaaattaaggaagaccacaaaaagaaccacctaaaaagattgtagaagacaatcctcagtgcacacatgaggacctataaccattcctatcctactagtcagagtggataacctcgtaattcacgaggcttcaagtagagtattaaaaggaattttgtctcattagcaggttaaaatcagctctagactagatgttctggtccctcctgtcaatattattacaatatatttgacaacctttatgaaatggacaaatttgttaaaagacacaaagtactaaatcatactcaagaagaaatagaaaaagtctgtttagattattaaagaaattgaatttgtagttaaaacccttgctacaaagaaacttcaaaggctgaattgcttcagtgtttaattcttttctgtttgtttgtttgtttgttttgagacaaggtctcactctctcacccaggctataatacaatggcacaatcatgtctcactgcaagctcaaactcctgggttcaaatgatcctcctacctcaacctcccgagaagctaggacgacaggtgcaaaccaccacagctggctaatttttaatttttgtagagaggaggtctcgttttgttgcccaggctggtttcaacctcctgcactgaagcgagtccttctacctcagcctcccaaagtgctgggattacaagcatgagccactgcacttggcagtgttgaattttaacacagatttcagaaagatgtagtaccaattgtatacaaactgtcccagaaaattgaagagggagaaatatacctatcttatttcatgaggtcagcattaccttcataccaaaaacaaagtattgcaagaaaactacagaccaatatccctcataaacacagatgtaaaaattcttcaaataattttagcacatcaaaccgaacaatatattaaaagagtaattcatcatgactaggagtgtagaattggtttagcattttgaaatccatcaatgtaattaaatatgttaagactaaaaagaaaaatcacatgattatcctaaaagcttttgaaaaatccagacatctatttctgttaaaagccctcggaggctgggcatggtggctcatgcctgcaatcccaatagggattggtgagggtcaggagtttgagaccagcctggccaacattgcaaaacctcatctctactaataatacacaaaatagcagggcatgttggtgggcacctgtaattccagctacttgggaggctgaggcaggagaatcgcttgaactggggaggcagaggttgcagtgagccaagatcatgccaccacacgccagcctgggcaacagggtgaaactgtgtcaaaaaaaaaaaaaaaacccttggaatagtagaagcatgaaaaaatccagatttagaaagaaggaagtaaaactgtctctattatcaaaagcatgatcatcttcatacaaaatctgatgtcatcttcaaaaagctattagaactggctgggcatagtgcatcacgcctgtaatcccagcactttgggaggccgaggctggtggatcatttgaggtcaagagttctagaccagtgtggccaacatggcaaaaccgcgtctctactaaaaatacaaaaattagctgggcatggtggcacacgcctgtaattccagctacttgggaggctgaggcaggagaacccgggaggctgacctgaggcaggagaacccaggaggcggaggttgcgatgagccgagatcatgccactgcactccagtctgggcgacagagcaagactctgtctcaaaaaaaaaaaaaaaaaaaaagctattagaactaagtgacgtagcaagattgtagcatacagaataaaaaatttaaatctcaaatgtatttttctatattagcaagaaacaaccagaaatttaaaaatacgatttccaataccatcaaaaagtataacaaagtatttactttgggataaaccagaccaaagatgtatacactgaacactacaaaacattgttgaaaaaatttaagaagacccaaatgggagatatatcatgttcatagattagaagactctgtattgttaaatataaattctactcaaaataatctatagtttagtgtaattcagtcagaatttcagaagttttttttaaagtcaagttgattctaatatttatatggaaaagcactggactagagtagccaaaccaacgtggattttaaaaaccaaatcagaagacctttacatgatttgaagacttattacaaagctacagtaatccagacaatgtggcattggtgtaatgatagacaaatagtcaatggaacagaagggaacgtccagaaatagacctaaatttatttttcaacaatgtttcagaggctttttcatggaggaagaaaacagtctttttgacaagtcgttctggagcaattaaatatccatatctaaaaacgcaaacttcaacccacgtaacaaacaactgcacggctattagaatgtctgaaagtgtgaccataccaaatattggtaaggatatatggagcagctagaatgtaaaatggtacaactactttggagaatggtgttcttgtttcttacaaagttaaatatacatcctccaaatgacctagctatcccactcctagatattcacccaggacagatgaaagcatctgtccatgtaaagacatacacaggtgtttatagcagctttatttgtaatggccaaagtctggaaaacaaaccaaacatccacaactagtaactggttaaacaaattgtgatatttccatagaatagaatactactcaactataaaagaattgtactattgataagaaatgaaccaacagcatagaagaattttagaatacctatgctgagtgtaagatactgtaaagtacattctatatgattctatttatattctagaaagtgctaacaaatttatggtgatggcagatccattgttgtctggggacagggttatgctatgaggcagtgatcacaaacgggcatgaggaaacttttaggagtaatagatgtgttcccattgaggttgtggttgcagtactttatacatacgtcaagttttatctaattaaacacttttagtttgtgcagataattgtatgtcagttatacctcagtaaagctattaaaatgaatatatactttgattccatttatatgtttaaaagtaggaaacattattctaaagccattaagttccaaaaatacactgctaaaatgaagaagtgccaatttgttattttttgatcaccatatatgaaacttctgttatttccatggaagatccccttatatttaagtagcaatgtcaagccagaggaagagtgttttgatagtcctgggttctaatcatgacaactaaaaattatcataacctaccattgaataatgctttaaagttaaaaagggtattcacaaaaaccgtcatttaatctacaaggcaattccatgtgtttttctaatgcatgtaaagtttcagcttggctcatggaatatattctcaatttttgttaggtaatgttggtagtagttttaggagtattgatcatgttatctattaagtttcacttcactttaacttgctttgataactcacactcttcattcattcctgttaaaacataatgaatatagtaccaagtgcatgagggaaaactcacagctattgggctgctctctgctataccaccttacttctgttccaacaaagttatttgcttacaaaagttaattatgtttttcctaaacttggtgaaatttgtgttcattatttaattatttaacattatatattctgatgaaatatgaatgcaagtagaatgagaattagtttaatgagttaaggttggttccaaaactaaatacatatgagttatttttaatgttgctattgaattggatgtgggcatgaaaagtataaaagattaaaggcagtaaaaagctgtaaacatctgtattcaggagtgcttcataggtgtttttatgttttctctctgctttaaagaagttgaaactaggccaggaaccatagcgcacacctgtaatcctagcactttgggaggttgaagtgggaggattgcttgagcagaggtgttggaaaccagcctgggcaacatagttggaccccatctctccaattattttcttaaaattagccaggcatggtggcacacacttgtattcccagctattcgggaggctaaggtgggaggatcgcttgcacctgggaggttgaggctgcagtgagctacgatcatgcaactgcactccggtctgggtaacagagtaagaccctgtctaaaaataaaatttttaagaaagtaaaatgagaattcataaactatgaattctagatgtggttctacaagaaaaactctagaatgtcagtctgtaggcatgctcaaaggttttgaccctatttttttttttttttttttgagacagagtcttgctcttattgcctaggctggagtgcagtggcaccatcacagctcactgcaacctccacttcccaggttcaagcaattctcgtgtctcagcttcccgagtagctgagactacaggcgtgcacaaccatgcctggctaatttttgtatttttagtagagatggggttttgccatgttggccaggctgattttgaactcctggcctcaagtgattttgaactgcccacctctgcctcccaaagtgctgagattacaggtgtgagccccccacccagctgaccctattttaaatattagcaaatgatgtatctttatatattaaaataaaatgtttagattatgaaagctattttttgttcccttaatttaatcatcactctgatttatttatcaactactattccttttcctcatctgtaaattgaggggatttgcatagaaatactagataatcttttaaattttttcttaaagcttaaacatgttataaaactgatgattcattttttttccacattctaagattaatactgttagattttattataaattaataaagttcctcttttaacatgtaaaataatgcctgacatttcttttaggtagttctgattttttattatgagtgtagccttaactgtagtgcctttgaagctgaattctccccatttgtgaccccagtattccttttttgtttagtgaacctaggggaaatgatatttctctccaaaaaatacctgaaaatatttggttagacacgtgctgggacaaaaagtgaagtatccacagtaataccattgctatgttcttgtgatataaccagattataattactaaatgatacaatttactttctttttttaattctggtaaaaaaaaaatacacaatataaaatttagaccattttaactatttttaagtgtacaaatcagtggcattaagtacatttgcaatgttgtacagccatcaccactattcctctccagaactttttttttttttaatcaacccaagcagaagctctgtacccattaaacaataactcactatttcctgtttcctccttcctcctcacccttggtaactgttttactgtctatctatgaatttgcctattttaggtacctcatacaagtaggatcatacaaaagttgtctgacttaatttcacttagcataatctttttaaacttcatccatgttatagcatgttatcagaatttcatcttttttaaggctgaataatatttcattgtatgtgtgaaattttgttttttgcttcattttgttgatagacatttaatttgtttccacctttgattattatgaacaatgctactgtgaatgttaatgaacaagtatctgtttgagttcctgcttttaactcttttggatatatacctagatgtggaactgttggatccacaacaggtacaccattttacattcctaccatcaatacacaagggttccaatttctccacctcctcaccaacacttattttgcatttaaaaaataatagccatcctgctgggcacgaggtggcatctcactttggttttgatttgtgtggtttactttcagccaaggttcagaaatacatagtgacaaatttctgtttctttaatttaaaatctttggtaacctgttacattgcattttgtacttttaaattacacatctgaattgattggttatccttgttaaagtagttccaaaattactgtagtttaaaaactctttaaatattacattgtagttttaatttgtttctgacatcttcaaagtttgaaattttcccttcagcaacaaccatttgttagctacattcacacgaaagcagcttaataaaggacattctacacaaaggtaattataatccattgatgccccttaatgcaagctgctttgtagtcattatctagcagtagatgactaaagaacttgattattcttgtttttcatttttattaaattaagaaggtttttttaaattatgtcattttgcaaatggttcttaggagtaatgcctttcaaggctccataatcactagataattaacctgcaaggattaagtacactcaactttgcctcaggatgcttaactctcaaatacagtcaattatctcatgataataactgctttgtcaagagttaccacttaactccacagtgaaaagtcaaatcacccataccatgcactttaagatagtttcaataataaaataacagtttgaaatggggcagaagaattcagttaaattttttcatagggataagaatgatatgctttagataaagctccccctcatatctagtattttgaatttcacaaatgacttcaatttataaagataatataggccaggtgcagtggctcatgcctgtaatcccagcactttgggagaccaaggtgggcagatcacctgaggtcaggagttccagaacagcctggccaacatggtgaaaccccatctctaataaacacaaaaattagctgggtgtggtggcacgcgcctatagtcccagctgctcaggaggctgaggcaggagaatcctgagaaccctggaggcggaggttgcagctagccaagatcacaccactgccctccagcctggcaacagagcgagactccgtctcacaaaaaaaaaaaaaaaggtaatgtattgctctgcttcatcagtccttttgctggcagtgttcctgcattgcaaattttcttataggaaagccattttgtctgttaacctcacagaggattcaatatattaaaaatctctaatatacaccaagaaaatggaaattactttctttacatattgatttaacttttaaaaaatctcgtttatcaacaaacgaattacaaaacagtgagcaaaattctgcagtttgttgtggttgttttttgttgttgagtagcttcactcatatttggacaggatatgccaaaaacagaaagactgctagatagatcaggacattttgaaagaaaatataaaaatgtctttaggtttgttatccatgtcctctaagcctgaatgatgcttgtatctctttataagtaaactatcattatctttttactaaaccagatgggatacattggctttttcttctgttatatattttactgccatggggatgggaagagactttattgatattttgtttacacttttaaaccctttttaatgtttctaatagttaattaataatttgaaaccatcaattctttaaattgtaaataactttgatacaggttatcttatttttcagtttctatacttctgtaaaatagaagtcatttgctcttttaagataaaaaatctgtgtgaatctatgtgtaattatgtacaccaaatagtgctatacatgcatacaacttctttcagatattcttcttttggttaagagcctttttttctttgtaaaggtattattttaatttttagaactatttttctgtgcactggagcacatgtttgggaggaaaaaagaaactttctgtcaagtccctatacacagagaattcttgtttgaatttttaaaaaattttgtcaagtctagttcttttatttatttatttattatcagttagagacagggtctcactgtgttgtccaggctgttctcaaactcctggcctcaagcagtcttcccgccttggcctccctaaggttctgggattacaggcatgagcgaccaagcctggccaagtctaattctttaaaggatgtgatttccaagtatttccaggaattcaagactgttacctagatccgtattctgacaaaagagatgatcttttctttcttcatatcagaatatttcccccatgaattgagggaaatggggctgtatctaaaaatggtaactctgccctttaaagtatacagaagtgccctgtttcttcctaagagaggtggaagtcccctttctgagactgtgcatatagatctctttattcccctttttctgctataagtgataagaggggctatgtagacaaaatgtaaggttgttataaaatcatcaaggaattgggaaagaaactttatcggaggatatacataaccccttcagaaaaaaaaacaaaaacttatggtgctttttggaagaaattctgacatagttgtattttctgagaaggataatgaaatttcagttaacatggaactgtaacttcgtaaaattgctgctcagctcctagatttaactttctccctagggtttttctaatatatttactcatctgaaaaaagtgagattgactgtagcacaagggagacttctgatgtcagtggcatgttgtaaagatgtgctatgggaaagattcagaaaatgcaaaggctatttaactatatgctctgcatctctcttcctttctacatagctctctcctttctttcttactccttcgtctccctctttacgccaactacattgcctctctgaagatgaaatgcttttaaatcatccccaatctaacatccatcactggtaaaaagccatctaattattatgtgttgatttttaaaaattaaaaaaaattattagaaaattaagaagagcatttaaatgtttttaattgcaaggagaaaataaatacactcaagtaaagaaaaacactgtgtaatttgaaatagtttgaattactacggagataatcatattttatgcagtaatgcctttctattttattcactatttctattaatctttatttgtttcagttactgtactataaatttgtaagtgattattttggtattatttgtatagtatgccataatataaaaataatgaaaaatattaaatatatatttaatgttcttatttaatgcctttaattttttttttctttgagacaaggtctcactctgttacccaggctggagtacagtgatgcaatctcggctcactgcaaactccacctcccaggttcaagcgattctcaagtctcagctttccacatagctgggattacaggaatgcgccatcacactcagctaatgtttgtatttttagtagagatggggttttgccatgttggccaggctgatcttgaactccaggcctcaagtgatccacctgcctcggcctcccatgtgctggggttacaggagtgagacacctcacccagccaaaaattattgtttattaaaaatcatttaatgacattgacatccttataaataaaaactgtaaatttatatcacagtagaaaaagtgctagacctaaatttagaaaacctgtcttttatcctagctcttgagtttttcacagagaaaataggagtcaagaagccaaaattctgacatgagggaaataattagcaaaatttaaataggtgccattgattagtcaatggtattttatcaacattaatttttattttattatttatttatttattttgatatggagtcttgctctgttgcccagactggagtgcagtggcatcatctcggctcactgcaacctccaccttccgggttcaagcaattctcctgcctcagcctcctgagtagctggggttacaagttcctgccaccatgcctggctaatttttgtattactagtagagacggggtttcgccatgttggccatgctggtctcgaactcctgacctcaggtgattggcctgccttggcctcgcaaagtgctgggattacaggcatgagtcaccgcacccagcttaacattaatttttttagttttggtaattttaatatggctatatagaatgtttacatttggaaaaatcctaatatcctttttgactgatccagatccagtccaggttgctcacattgcatttagttaccacatttccttcgtctctttaatctagaatggttcttcagtctttgtctttatgaccatgacaattttgaagagtcctgactggttttttgtagaatgcccttcagtgtggagtttcctcatgattaatacattttttataggaataccatagaaacagcctgggcaacatagcaagatgctgtctctacaaaaagtaaaattcaccaggcatgatggcacattcctgtagtcccaactacttgggaggctgaggcaggaggattgcttgagcccaggagtttgaggctgcattgagccatgattgccaccctggactccagcctgggttacagaacgagaacccccacacaccccccccccctaaaaaaaaacaacacaacacagaaatgctattgtgtcttttttcatgcgttatactaagattttagtgtgtttcgttactggtaatactaactttgatcacatggttaagaaaatgttggcccagtttattcacttcaaagttactatttctggccaggcatagtggcttacgcctgtaatcccagcactctggggagccaaggaggacagatcgcttgggcttaggagttcaagaccagcctgggcaacatggtataaccctatctgtactaaaaatataaaaattagctgggcatagtggcatgcacctgtagtcccagctacttgggaggctgaggtaagaggatcgcttgagcccaggaggtcacatggtgaccttggaagcaaatgctccctcaaacacgagatgactgcagccctggtctacatctcagttgcagtcttgtgaaatcttgagtcagaggcactcagctaagccatgcctggattccttttcctggaaactatggagataataagtgtttgttattttaagtcactaagttttggagcaatttgttacacaataataactaatatgctgtgaaaaacaaatttactaagagctcaatatctgtgtacaattttttttgtctttagccttttgtgtatattgtcaaaacacaggcttttagttaaagttagttcctttccccttcaagtattttaattttttttaaatatgtgaaacatttatatggttcttaacatcagaactatatgaaaaggtttactcagtagtgtcgctcctcccttatccctcatcttcctcattccccattctgtctctattcctaccctgtttcttcctacctaccctctataaataatctcattagtttctggctcacatttctaaatttcttttagcacaaattagcagctaaatgcatattttactgtatcttctttgttacatgaaaggtagcacactatagatagatcctctttgaacttagctttttttcaatcaagtgcatcttagaaatcattccataaaagctcatagagatccttctcatttttaattttattttagttatttatttatttatttatttatttttttaatgagatggagtctcgctctgtcacccaggctggagtgcagtggtgcgatctcggctcacagcaacttccacttcccgggttcaagggattctcctgcctcagcctcccaagtagctgggactacaggtgcctgccaccacccacggttaattttttgtatttttagtaaagacggggtttcaccatgttagccaggctggtcttgatctcctgtcctcgtgatcctcccgccttggcctcccaaagtgctgggattacaggcgtgagccacagcgcctggcctatttcatttaaaaaaaaaaaaaaaactgagacagggtctcactgtgttgcccaggctggtcttgaactcctgggctcaagcaatcctcctgcaatccttctgccttgacctcccaaagtgctggtattacagacatccagccacaataatcctcatttttttagttggattttccccattgtgtgaatgtaccatattttacccagtcactctcttatgtatggacattaagactgtttccagagtcttgcacttaaaaacaatctttcaatgaataatcttgttcatacatatttcttgggttgctagaggtatttcttcagagtaaattccttgaaatggaattgttgggtcaaaggataagtgcatataacgttttgttagatgttgctaaattcctctccaaaataattagaaatgttttcattctcagcagtagtgtaggtgaatgcctgtttttaatggggttattttaatatttggttatcaattattaagcattgctatcaaatggaattcactagaagcatgtaaaattctagctttatttcaaatacttagttgaaccagccaattcattttagcacagtaaaagtaatccaagaactaaaaagtgatcattctttaaggtacagattttaaagactcttttatcttttttttttcttttttttgctattttatcagacacattagaggaatatgaattaatccccattatacactctttagtttcattttctggccctgtattttcatcttatacttctctcctacaagcacctcttcctttctcctgtactgcctaactattcatgttttcttatcatcaatactcatttcatatattccctacctcacattctccccttctttccctcccttctccactcccattcagttggttattttataaatgtgattctgtgatcttgtgtatataattacaatgcttacatgtttcttttacactagaatgtgttcctttacagcagtgactttcattcttcactacattctggccacttgattggtgatcactttctgaccggaagttccaattatttaatcacaaagttggactttctggtgaccacttcccatcctggggctgacagtgagtcgccccatcagcataacaaaggcacttttaacaatcaggaaattctgagggtttttgaagctctgtgctaggaatccagacaaggacttgatatattttttactataccagtttaagggttaatgataccatgtaacaactttattaatagattactatttatagaaacttgataaatgtggtgggaggtggtgcagaatcatgtgatataatcaattataaatgaaagcacagataaaatttgaaataataagagagaaataagaatgaaggttggccacggtggctcacacttgtaatcccagcattttggggggctgaggcgggcagatcacgaggtcaggagatcgagaccatcctggccaacatggtgaaaccccttctccactaaaaatacaaacattagctgggcgtggtgatgcatgctactcgggaggctgaggcaggagaatcacttgaacccgggaggtggaggttgcggtgagctgagatggtaccactgcactccagcctggggacagagtgagattctgtctcaaaaaataatgaaaaccgaggagttttttctttctttctttttttttttttgagacggaatcttgccatgtcgccaggttaaaataaactttcaattctcttctcttgaatatctctcacccaacaatgtttttttcatgttgatcactttactaaagcgaacaattggggttttaccaaaattgtgaaggattttattcttccatacttatgtctgtgttcagggtcatacagattctactttttccttttagtttaaggtattctcttggagatttaatgtacttaaatttgaccacaatttattgagagcatattctgtgtcagacattgcactctgcactagatattcaggaatttctaaaaagaatgttaacattgctgttacatagtcagttactgatcacattcttttcctctcaacttttttcaaaataggaatctgcggtatgttttcacgtatggagttcaggtcaggcttaggggtccctgacaatgtgaatagttttaagctgggcctcaattcgtggtacccttatactaatttaacaagccgtggactctaggttccaccaaaaatattttgttccatcctctctggtttcagtccatggtgtacagaaagaaaactaaggaacttcagccccaaattgtcaaattttgctacttaagaaacagaagatttaaatctatcattttgtcttatattccagagttgactggttcctcctgtctttaacttcttgtccttgaagggtattctaattttcattcagaaatatgacttctcatagggtttgtgttagatattttcagggccagatggatatgatgttcccatttctgttttattgttaaactactattccttttgagctgtaatgaacaattcattctgagaggcaatatatgttttcagtaattgacttgaataaaagtaaatgttaaacatggagttactaagttaatacagtgggtattagtactaatttgttcaaattaagatagaattcttaatttgataaatagaattcttatattacagcatcagtccaattggattgatagtttgtagaaaggtaatttcttacatgaggaaagacaggttttctttctcttagcaaggtattaatgcaaaaatgacctcttcatttcctaccagcttccagaagggaaatgctggttaggaggtaaattcaatttactctacaagcaaacttcacatctgttatgctgaagtcagagtttatctttcttgttatgtggaacctagaaatataccatgaggaatactgaaaaataaactagcagaaattttgcgtgatgctgaggatttttagatggctgcaaaatgggtgaaagtaatataaacttaacaaagaatgttgtcacaactctctggaacttagtactgtttttcaactaacaaatggaagatttgtgagactaggtcgacttaatgtgatttcaatgcagtaattactgtgtggcatgggcatggtaagagataggccttttctagaaatattctcatctctgttttttttagttgctcttacttagatttatattaactcagcttcacattttcatttctttttattttattttaaacaatgagaaaaatactccacgatgtcactgatttagttatcagatttgctttatttctgtatataataggtaatgtgagtacaggaaatatatctgaaaaggttacttgtacctaaattttaagttagatcatttaaaaattacttataagtctcttgagtgttttatatagtagggcagatggaaaaacttatttgatattcatttttggtacctcttaggaaaataattgggaatgtattcagttggaaaaaatgttgagaagagtgttttatataatgattatttagtaaaacattaaaaataatttcttattctggaggtttatagacatcaaaattgacaaagattcatggattatacatttcatcaaggtacctttaagcgattttttaaaaaaaattctgactctaacaatgcatgctcattgtagagcgttaaaaatacaaaaacatgcaaaagaaaaaattaaaattaacatgtgtcatatcacccagcattaactactctataatttttcctgtgtttccttgtagggtttttcccacacatttttatttgtttttatcatatttatttttattccacacactttttattttgaaatgatttacaatctaggaaagaattataagaagagtacagagttctctcctactacacttttgagcattcttgctttttctctctttctgtctctctaaatatatgtgcttaaccatagtacatattcagatttttctagctgtcccaagaatgttctttctagtgattttgttttccaggatcatggatcatgcattgccttaacttgtcatgtttctttggtttccttaatctggagttccttgatctttctccttcatgccattgcatttataaagagtgttgtcaactgttctgtgtatgtaaattcttaaccaattgaaatagattttacatcatttttcccactttatatatatatatatatttatttatttatttatttatttatttttattttattatttttttttttttttggagacagagccttgctctgtcaccaggctggagtgcagtggtgcaatctcggctcactgcaacctccacctcctggattgaagtgattctcctgcctcagcctcccaagtagctgggaatacaggcgcgcaccaccatgcccagctaattttttgttttgttttgttttgttttgagacagagttttgctcttgttacccaggctaagagtgcaatagcgccatcttggcccaccacaacctccacctcctggattgaagcaattctcctgcctcagcctcccgaatagctgggattacaggcatgtgccacaacatccggctaattttgtatttttggtagagacagggtttctccatgttagtcaggctggtcttgaactcccaacctcaggtgatctccctgcctcagcctcccaaagtgctgggattacaggcgtgagccaccgcgcccggcctaatttttgtatttttagcagagactgggtttcatcatgttggccatgacggtctcgatctcctgaccttgtgatccacctgccttggcctcccaaagtgctgggattacaggcgtgagtcaccacacctggccacttaatatattttcaacattttccaatgtctttaattatgtcaattataattttggattgctgtataatataatttattttcattagtcttctagtgttggaaatttttactgtttgttttcttttcagtattgcaaatacaattgggaaataaactttgtaaataaatctttgttgtaattttaatttctgaatctatcaagtatttgttaaaacataaagcaacaaaacaaaaatcctacagaagaggataattaaatgttaatctttttgattctgaatacaattagaatggaaatttggaaaaggggaaaattgccagataaagaggttgccagatttagcaaataaaaatacaggatgcccatttaaatttgaatttcagaagggacacacgatatctgggacatacttatactaaaaaattattcattgcatatctgaaacttaaatatgactgagcatcatgtattttatctggcaaccctaccagtggtttgagtattcgggaagacttcatggtagagataaagagagggaataaagaagatgttttacacaaaaggaatggttgagattacctccaaaacaagagtgaacatagtttatgtgaaatagtctccataaagataaagactttgtgtctcattcactgctgtatccccgatcccttaaacaatctgtacactgtagtcactcaataaatatttgttgaacgagtaaatgaatttgcactataaataaagccaggcaacttgggacaaagattacctgttgtaactaagtagataaagataaaatttccatgaaagtggaaaacctggcagaagaatttggacttcctgccttcccttatttattttataatgattcattaagtgactgttatgtgccacatgcacaggatactttggagaacaaaaacagacatggcttctaccctcatggattttatagtctgtattagaggcagacattcaatttataattcaattattcatttaatagtcaataaatttcaattcaattatagcgtacaacttataaaattgaatttttaatcattcaatttataaatatgagtactgtaagggaaaagtatataatacttacattctgaaatcacacacagtgagggggtattcttgaaagaacctgatcaagataaatgtacatggtgttgtgtcttagggatagatccaatcttttctttgaaatcttcattcattcactaattttccctcgaatttatagaacactctttggactattacacttatacatcttttaaaatctttttatatgtgcaatttagtttacttactagattgtaaattaattaatttatttatttatttagagacagggtctcactcacatcacccaggctggagtacagtggcacaatcaccactcagtggcagtctcaacttcccaggctcaggtgatcctcccaccttaacctcctgagtggcttggactacaggtgcacatcaccactcctgtcttatttttcatatcttgtgtagagatggggttttgccatgttgcccaggctggtttcaaactcctgggctcaagtgatccgcctacctcggcctcccaagatcctgggattacaggcataagccctgcacctggcctagatcgtaaattctttagtgagctgggggtatttcaatttgcttttatcccctattgtttcatgtatgtaaaatatacacaggcgttaattattgacatgttgattcattgaaattataatggggcttttaatagctatagatatgccatgagcacataaaagacgatttcctgattctttgaccctcttaaagaagtttatgatgcctacttgtcattcttgggtccttagaccttctgtggcaatattaggtcggggatagatgtctaatgatttgcagtcagggagctttgataaccattgtcacatgttagcataaatcagaacccaatcacttttttttttttttttgagatggagtctcattctgtcgcccaggctgcagtgcagtggcgtgatcttggctcactgcaacctctgcctcccgggttcaagtgattcttctgcctcagcctcccaagtagctgggatcacaggcatccaccaccatgcccagctaatttttgtattcttagtagagacagggtttcactgtgttggccaggctggtctcgaactcctgacctcaggcgatcctcccgcctcagcctcccaaagtactgggattacaggtacgagccaccacgtccagccgagaacccaatcacttttgactctgccttcaatatatattgcaaatctaactaccttttactacctctacttcttcccttctagttcatgatgccattatcacttgcccagattattacagtagtctcataattgctctccctgcctctggttttgcctctcccctccagcagtgataggaaataatggaagtttttaagtaagcatggtagtatcactggatctgttctttgacacagctggctagtagtgtttggtagattggaataggggcatagtaaatgtgggttgacatggtatagtaggtagtcaagacagtccaacaatcaatcttaaagacatttcattttcttggtagttaaagaatataggcctaccagtacttgtaattttaattttaattgatttatatcattttacttattaatattcatttgaatcttagtttataatatctataatcatatgctatgctcaaatgtaattgagttactttttagagacaaggtctcgctatgttgcaggtttcaccatgttgtccagggtggtcttgaactcctgcgttcaagcaatcctcctgcttcagcctcccaagtagttggatctacagggatggcatgcaccatcatacccagctctgaactattttttaagtaaaattttttttagatgaagacaagcttgtatacaagagtagttaagacagtgtggtactgactcaaggatgtactaatagacaaaggatagaaaacagacccacacacatacagtcatacagttacagcaaagatgccactgggatatagaggagaaaggatagtattgggatcagtggatattcatatggaaaaaattaactcctaccttataccacacaccaaaattaattctatatgattgtacataaatgtaaaatagaacaataacacctctagaagaaatcgtatgaaaatatcatggtcttggttaggcaaagctttcttacaaagaatttaaaaatgttaacaataaagaaaatatagtctggtccaaatgcagtggtatttacaactaattgatcacagccagttacagatttctttgttccttctccacttccactgctttacttgactagccttaggaaaaaacaatttttcaggaaaaataagttggatgtgtcaaaattgaggacctttccccagaagacattgtgaaagtgaaaaggcaaaatataaagtgggcttaagaattatgagaagttcagcacagaggactagtggaagaaaatatgtttgtacataatttctttccctataaccaatactaagaatagagaaccctatatttaactgaaggcagaaaatattttgaggccatatttgttctcattttatgccatttacttagtaaatgtacataccttatagattcatgcatataatatacagtcctcccttggtatcttcaggggattggtttcaggacccctctcacacatacacaggataccagtattcaagtcccttgcataaaatggtgaagtatttgcatataacctatgcatatactcccatgtactttaaatattaatctctagattctttataatacctgatacaatgtaaatgccatgtaaatagttgctataccatggttttttgtattattattattattttttattgttggatttttttcatattttcagttcatagttggttgaatgtggatgcagatacagtgggccaactgtatacatattttgggatcattttagtgggtagtaaaacttggttttccccaactgtttctgttaattcacagccagttatgaaatatgccacatttgtcctgattaaatagtgaaatgtcttagccctttccactgattatattgatagaaaagattaaaaagtggtggataaacctaaccaaaaaaaaaatgttttcataagccactgctgtcagcacttatttgagattttaaaacattttgtagttctttatttttaaatgaccttacattttcaaaagggtttgttaattcaaaaggtctcctatggttaaggcagttcaaatagtagactgagggtagaagagggattgactgtaaataggcatggaggtatcttttgggggtgatgtaaatgttctaaaactggattgtggtgatgtttgcacaaaatttgcacaaaagcattgaattatacactgaaagcatattttatagtgtgtaaatgaatgccttaataaagcttttttttttttttaaggataccattaagataatgaattgtccagccacagattaggagaaaacatttacaattcatgtatctgacaaatgattgtatccagaaatcaataataagacaaatcaatagacaaatagcataatttttaaaaattgggcaaaagacttggacacttcatagagggaaataatctaatggccaaataagcacactaaaagaggatgaacattattaatcattaggaaacacaaattaacatcacagtgagatactgacccatcactcatccacttgaatggttaaaatcaaaaggactactaattgttgacaaggatgcagaacaactggaactctcattctttgctggtgagaccatgcagtgggaccacacatttgaaaaactgtatggtagttttttattttttttttcctggtaaaaattaaccgtacatctaccctatgatccagcaagtcatttacctgagaagaacaaaaacatatatccacaaaaagagttgtgcaagaagattcatagcagcaaacaggcatgttcattaacaagacaatttttcagcacattgtgtttttttttttttttttttttttttttttgagacagagtctcactctgtcaccaggctggagtgcagtggtgcaatctctgctcactgcaacctccacctcccaggttcaagcgattctcctgcctcagcctcccaagtagctgggactagaggcacgcaccacgacacccagctaatttttgtatttgtagtagagatggggtttcaccatgttggccaggatggtctcgatctcttgacctcatgatctgccctcctcggcctcccaaagtgctgggattacaggcatgagccaccgcgcctggcctatgtattcatttaacagtacactactgggcaataaaaataaatgaactactactacccccaactacatggataaatctcaggaacattatgttgaacaagaagagtcagatgcaaaacagtatttgtgttctacattataccattcaaacaaacaaaaacagtctataatagaaatcagaaagtagtttcctttttgttagggggtatagggattgactggtaagagacagtagaaaactttctgggattatagaaatgttctatgtcttgttttggataaccatttaagatccgtacatcgtattttatgtgatcatacctcagtaataagaatgcaaaatgctacaaaagcaagtcaacccaacatctctactaataaatctcaccattttaaaaagaacagtaaatcctacatctctattttgagaaaaaataattataattttatttaatgctatttaacatatgcttatatatgacatataaattgtgaaaagattatttaaacaaattggctaaagaaacttcatgaagaaggtgaatcttttgccttattgcatatgcttttatattgagtaaaaccaaagtgatttcccatggtagcttcttatactctgttctcatactctttcttgtgataaaatggaaactgatgttcttcccatgaaagggtaattatacattaatgtactctttttccctcctgtcctttttttattatgaaatatttcatatatcaaagaatatgtctaacatatgtgtattacaaagtatatcctctgcctccctcctcatttgaagatcctgccaatcctctgcagagctaatgcttattctgactttggggttttcatttcctttcatatatcccttatatatgtagtcctagtaggtgtatacatatgtatatcatgaatagttatatatataataattgcaaatacatcctgtttatttaatgggttatgtttctttaagttccaatacaatattttctaaattagaaaggtattacaattttaaaaaatgtgccaggacaaaattaataccaaattacaagaatggtaaagcttagaacattgtcattgactataaataatagctgcaattctattgttggtttcttttttcactagtccattttgataatatttcttgttgtggccaggcacaatggctcatgcctgaaatcctagcactttgggaggccacggcagatggatcgcttgagctcaggagtttgagaccagcctggacaacatggcaagaccttgtctctatttaaaaaaaaaaaaaaaattgttgtagtgaagcagtgttttctttcccacagaatatcgttcttcatttatttataaaaatatgatttggtatatatgcaaatgtagcttattttatatataaccatactgtaatagtctttgtggtaagcaattcagttaatatgactacaggtttaagatataatgtgaaatttggaatagattttaacttttaaaaaataatttatgttaggctgggcacggtggctcacgcctgtaatcccatcactttgggaggccaaggcaggaagatcacttgagcccaggagttcaagaccagcctgggcaacatagggagaccccgtctctacaaaaaaaagaaaattagccctgcatggcccatgcctgtagtctcagatctccagaggttgaggctgcagtgagccatcaccatgccactgtgctcccacttgagcaacagagcaagaccttgtctcaataataataacaataataatataacttatgttaagggctggtctttctttttctatatttaactgattaaactgattaactgtttgttgtttttttttatgtcataggtgtcagatccagctagcagtgccataagccagaattatagatggaagtgggggagagagagaattgtcagaaaaacttactaagatttctatcctggccaggtatagtggcttatgcctataattccagcattttggaaggccaaggtggaaggatccctggaacccaggagttcgaagctgcagtgatctatgatcatcccattgcactctagcctgggatacagagcaagaccttgtctcgaaaaaaaaaaaaaaaatctaagtggcttcatacagaaagtttaaagttaaatgtatactgttatgaatatcttattaaaatgcaagacaatcagagactgatctaaaagtaatcaaggatgatcatgtcttgggagtatcctgtttctcagttgctctggacagaaagcacctagaaggttgagataattcaatgcaaaatcagagatttccccccatgtaatcaacctcagaacttgagttggtcctaacagtagactcaaccccttggaaaagactaggcagagcaattttcctattgactacatctgagacgccattcattcttgtgtcacatgagacatagcatatactttttaggtctctaataatagcagttctctaagaagcaaactgggatgaaagacactattcacttattttcttaaatggggaaggcattaaaaggagtgaaggtttattaatgccacttttaaagatataaatagtagatttttattctaataagtcatacatcaataaaatttgttattgcagctccggggcagcaattacttatatattgacaacttatacatgttttacatgcccatttgctctccttttcactactgaaatgtagttaccatagcaatgaacacatcacatggttcctgtgctagttctaaaatagagaacagcaatatgccatatgagctctgcttattttctacgtaaggactgcatatacaacttgaggctattccataaccttctcagtgcagatagcttatcattgatttagaaagctttcaaagtaaaaagcaattggcagtaatatatttcaagtctctagcttctcttgtactgttatttgccactgagctaaaagaacagtttcactagctttgaccaccagggactctgctgttgtatatttagccatagattgtctatggaatagcagtgccacttagaagattggtgggagaggcatatatagcattcatggacacattttctaagtcttactgagcaattcttaaccaatcttagcttttctcctactgtctcccttaatgtttcaagtttttaaaaatataggactctgttttagaatttgaggaaaggaagatgccaggcacaactggaggcatgctattagttccttttatgtccattattgttgtgtaaggttttaaaatgcattggttatatagcagtttatctatagaaaaggacttcagatttcagtgcctggtggtatcaggccgtatttatgccttactatcacatttagagtgtgttgtaggctgtcagacctccagaaataaagtaggaacatacccctcttactgtgactcttaccagatacttatttgaaacagtccaagcactggcatattagggaatggtgctaactctttctaaccattaataagcaaaataaatttcaatgtgagcttttggctatactatacctatggtcaagtggcactacaaattcaaaattttaaatattctttattgaaactactaggaacaactgttttatatatagtagaggaaaccagggctttattctcttgactgaaacgtgtaagaagtgattcataggtcttcaaacacaaattagtaaatttaggaagctaaaaaggcatatatatttgactactgatgggggcaatatgttgattgtgtaatatttttatctaccctttcatctcagttataatttaaaaaccatttatatactacataaactatgtaatattggatacttctgtgtctatataatttgcaacaaagtagaataaatggccagagatgttattgtaatcttatggttgaatgttatttcttttttctaggtcattgtttaaaatctggacatcatagaaacagataatgcagagagaaaattctttcataattccaccacatctcaatctttgttattagttttaaaatatgtccttctagacatattttattgtaaaaagtatttaaaatactcattttattttattgccgcaagagagagaagggcatttattgtagggcaccaagcaaggaagatgggcagctcatgcttaagacccaacctccctgctggcttacaagcatgggtttttaaaggcaggggtacatttcaggaaagtagaagttacaggcaaaattgttaatcaatacatagaggttatacatgggttggctcaaaaaggagtaaggttttgagtgggggcttacaggtcatcaatggattaggagattctttgatttgcagttggttaaggaagaaaggctttgtctaaaaacttggggtcagcagaaaggagtgttgaggtttggccttaacataggttagttaggataaggaaacctgttaatcattatggggtgctatgtcagggtcaaggtatgagagcaagccacgatgcactgggtcagagtgaccagtttaggaaattgatagcccacaggtgtgactctctccaggcccctcaggaagcaatttagaacaaagagcagcagtcagagttcagtcttcagtttccctttatcaaaggtctatgtgacagcagttgacattttcttttttctgttttcttaaatttatttattaaaagaagtgtctcattctgttgcccaggctggagtgcagtggcacgttcatagctcactgcagtctcgaactcctggcctcaggcaatcctcctgcctcaacctcctgagtagctaggactacaggcacatgccactgtgcccagctcatcattttctatctggtgggtatgctggcatgttggaggaaggacctggcgagaggtgcttggatcatgggggcagttttccccatgctgttctcatgacaggagtaaattctctcaagatctgatagtttaaaagtgtgtggcagtttcctgctcgtgctctctgtctctcctaccactgtgtaagatgcaccttgcttctccttcaccttcagccatgattataagtttcctgaggcctccccagtcatgtggaactatgagtcaactaaacctcttttctttttaagttacccagtctccggtagttatttatggcagtgtgaaaacaggctaatacacttggtttctgaaaagtaatttggctggctttgaagtggggatgggccatgagccaaaggatgcaggcacttctggaagctagaaaggcaagaaaagattatcccttggagcttcaaaagaaatcaaccctgcatgcaccttgattttaccctagtgaggccgggctggacttctgatgcttcagagacaagggttcctccctcatctgtctcaggaagacttaggactaactttaggctttgaagtaaacagaagctgaaacatttgaatgtttgattttcatgatccagaactcaagcctcataggtcccatgcattccctgaacccaataggatgtcacagtctgcataccttcacaccatggcagtctggcttcttccctctcaggcctgcagcctcatgctctgggcttccctggaagctggtgttgtgggggcctgcagttgccaccctgctgtgtgtcagcactgctccctgacgctgttcatccactgacctccattccttggcccagctgcccaggcatggcagactacacgcaacctgggttgtggggaccaggcggagccagcagcactaggacctgatggccaaaacactcattttaatgaaatcatactttaattctgttttgtatcttctcacataaaatagctagatctcttttcctagtagtacaaacttatctatctgccttattttgtataagagtggtattatatgaatacatcattgtttattcttctattgaaagcttttatgttgttttctgggtttttgttattatagttctgtagtaatatgtcttatgtacttttgtgtaaatagttctataggctcaatctccagaattgaactgccaattcttagtaaaggaaaatttaacttttgatacattttaccaaactgccccttcaggggattctaccaaatcatattctctgtttaaatgtctttttaagctttgccaaactgatatatttaaaatggtattttattgtttcaatttgcagttttagaggtaatgttgtaattctatatcttttcatattatagtgcatttatattttcctcttctcttaactccttgtttgcctagctttctttttcttttggttggttcaatttttccaactaagttttttcatgttgtttttttttttctttttcctttgtatttgggaaataaatccttacttgtaaatacttcttgcagtttgtccattgactttttttttgagacaggatcttgctttgtcgtgcaggctggagtgcaatggcatgatcacagctcactgtagcctcaaccttgcagccctctggccacaggctcctgagtagctgggactacaagtgcgcaccaccatgcccagataatttttttaaaaaatttttttgtagaaaaaggacctatgttgcccagactagtctcaatctcctgagctcaagtgatcctccctccttggcctcccaaagttctgggattgcaggcatgagccaccatacccagcctgtctgttgattttattttcggtgctttttttgtatatggaactttttctattagtatttagtcatatttgttagtcttgtcctttatcccttctagcctttaccttatttagtaatatcagatgatgtgtttcatatgggtctaatttatgcattcattcacttacagaagctaatcatttgagtcctagtgtaccaagtatcttagatgatgggtcattgctgactgtacaatctaagaagaatcttatttgcaacaatgatgctttagcgtagcagcagaccaaattctctaggatgattagcagctaattctgaatattgctgtaaagtcatagtagcatgtaacatgtacagcaatagtaaaaacatgtaacagtttgttccttcctaaaattttgttaatttagtcttttatgtgtccttatatttataaatattagttttgtggctaaaatgtgtacatttttccaagttatagtattgagaagcatagctagtagcatttcacccaacagaaaaaattcctttagataaaagccaaatcacagttggcctcattctacatactgttctacaaattacaaaatcagtaaatgtttattgggtacctgtttttattgctaagctcttgcaagagaaagagagaggtggtaggatttttttaaggtgcgagctattatcctatttttaaagagctcataatctagtttggaatgtttggcataagtacatccaaaggtaaataataaaacaaatgataattgctcaacaatatgtaaagacccccctctccaaaccaaaacaaaacagaacaacaaaattgtcagtctcttctgtgagcagtattatctgctgaggacatgttactggtcgaagagctttggctgcagtcattcctagaatgcaaaatgaaatcatccaaaaaactgagagtggccagttttactagtcaaatggagtaagtggtcatctgtgagtttgtgaatctgtctgccagaatatatttattttcttgcttattccaccagttactccttcttgttaaagctttcaccgttattaaagagaagtacctcctggaaattttagcctgctagatgttgtcaaacctgatagcacagtgtgataggctaagattctttgttcatttgttttggatagggaaggaaagacacaatgaaaagactaggagtctgaggtgagggaagatgatgaagaatatgaatcaagggatcaggcatcaagataaccgttcatttatttaaatgtagactttatctgtcttgatcaggcatcaatataacctacatttatttaaaagtaaactttatttgtctaatgtatgtgttcctaatccctgaatctattcatttcattgaaattgatgagtactttcaatacaaatagttacaatattttaagatgttcactgtttataacatcattatatgagtccatgttaaaccagagaagcagaaccagtagacaatatagatttagagatttgttacaaggaattggatgatggaagtatggaggctggctaagcgagtccaaagcccagtcaagaggaaagcaggctagaaacccatgggcataagctgtttagagtccctcagctcagggaaagcctaagctctctttcaaagggctcacctaactttgccttgtaattttctataatggattcctagagtttaccaactaatatgacggtctagagttacatttaagtgaaatttgattgtgagattgtattcttaactgtctatatctggtgctcttgagcacgtatacaaccttctcgccttctctaggtccctaaaagtcatttcttaattcaaaaaatatttaaatgcctgctatgtaccaagcacttctcttgatagagtggtgagcatgacaatctagtagaaaagtgagacagggaaacaccaacattactgtggaaaacatagttacaggggaagtagaaggacattagtcatgtttttttcttcatgacccactgcctaacacatagtagatgcttaataaatgccttttaaataaataagaccacatggcatttttaaaggagtaaggacctctttaaaaataagtatatatggggaaggaaagagatgatgagaagactaggagtctgagtcttgctacagaactagggtaactggagctagtagaaaagcaaagaagcttctgatttggggatggattcaagagtatattgggatgggtgcaaacactttcactgattagcagtttacatatttccttcaaggatagtcttactctccttgtcctaacttttaacctttgcttcaaattagtttagcagtttgtactaagaggaattgccagtgaccaagtgaatatgatatacatataaaagaacagagaaaatcaagtctttactatgttgctgtatcactaattcaggcttccagctaaatgccagaacataaattaggtcccttatcaaatctggcacaaaaatatttaggatcctttttaatatagtacatgtgctttcaataaatgcctgctttggcaaaaaataaaaccagtgttttttgtgtcaagtacaagctgttgtactctgtaacttttaaactgtccttgtgaaccaggttgagggtaaaattaaatttggattttgtattcagttttacaatcaacaaataccattttttttctttgtgttgtgttgtcttatgggtgtttgttttattttggtttggttttggtttggttttcacttagaacaaaattcaaaatctactaaatactccctagccacactggcctgttttcagtttgagatttttttatttttaattttttttaaagatgacatcccactgtgttgtccaggctggagtgcggtggctattctcaggcatgattatagcacaactacatccttgaattcctgggctaaagaggtcctcctgcctcagccactcaagtagctgggactataggcttgcacctccacacctgacttctttctgtttttaagacagttgagctctttcacctgtcccctcaaactgtttgtacatgctcttccctctgccttgacctatttttacatcatgttcagtgttactcacccatcttactctcactaatttattaagtctcaaatattttctcagagattctttcttcacccatgcctccatatctcagttagatctcccttaaaaatctcttctgtgttactagttcctagcatatagtggatgtgtgataagtgaaaggatggactgaaacatagagcacatacaataggtatattctagtcattataaaatgtcctcaaggaactttcttaaatctgagttccaaagggccatgttattttgtaaataatattcttacttttactttagggaacaaaatcagcatttttaaatgaaatagatttaaaaatataggcatgtacattgtataaatgcatgtatacatatgtctaaatatggcaagttgcaaagtaacatgaataccatgattgctgtcataaaccttgaaagccactgtgttagtggatactgttgtataataatctccaaataagcacgtctagaaaacaacctgttttacttatcaatttccccaaacatctctctggtgactgcgtctttggcttcttttttatttatttatttattttttattattatactttaagttttagggtacatgtgcacaatgtgcaggttagttacctatgtatacatgtgccatgctggtgcgctgcacccactaactcgtcatctagcattaggtatatctcccaatgctatccctcccccctcccccaaccccacaacagtccccagagtgtgatgttccccttcctgtgtccatgtgttctcattgttcaattcccacctatgagtgagaatatgcggtgtttggttttttgttcttgggatagtttactgagaatgatgcgtctttggcttctaagagttctttgctgagagtaaagagccagaatctcagaaatcccccagaaagacgatttaagttaaatgcacccatcaagctttgaaggaaggcggcttaaaaaaagaaaaacactatattacattctacttttaattttcaaaacctgaaaaccttctcaaatccaggaaaactaatggtatttccatctattctctttgatagcccacaattcctatgattttcttagcatcccataatacattttgcttttatccttttactgtttttcttcctagaattttctttcaaggtccaacacagaaatcctttttctcaacaaacctttcctgactaaccctgtttccttttttaaaattctttgcattttctcaacagtttttgatatttattttttaacgtttgtatacaatactataatacagtcagttatttataactttattttgtgttagaagtaggttttttgtgtgtttgcattcttcctaattttacatgtgcaaaaagttactttaatcttatttttcttaaatgaaataatccaattttaaatccctttcctggagaattaaatataagtcattttgggggtgctttccttcacctcccccagaatctcacacaaaataaaacattcagagaattaatcgcccctgccccaccccaccctaatcttctgtccatgttggctgtcctgagttgtccactgttaaaccacataatcccttatagttcagtggctctgttgcttcttaggacatgaacatcttggccaaggcttcaatagctttctgtgttggatattttctcctggcatctccagatagactttttactcttttctttccctattctgtgcccaaaggccctgagaaaattgctaagtattagtaacatggagaaaaaagggatatagtttctgggactgtaaattattcaaaggatagttttaaagctctgggaaagtttggtgaaagttaaaaacgtgttcagagaggaggagttggagcctagtcaagtcacaaatcttctaattcagccaagctctagtagcactcctgaaacattactactatatccttaacatgtgcttttttagttcatgaaacaatattggcataactgttcccctaacaacttaatgagaaagttaaagattttaacaactcaagattgctgcctatgatacttatgatttttaaacaagttgtcatatcaataataataataaaaaaaccataaacctagctgggcatggtggctgacgcctgtaatcccagcactttgggaggctgaggcgggcagatcacctgaggttgggagttcgacaccatcctgaccaacatggagaaactccatctctactaaaaatacaaaattagctgggcatggtggcgcatgcctgtaatcccagctactggggaggctgaggcaggagaatcgcttgaacccaggaggcagaggttgcagtgagccgagatcatgccattgcactccagcctgggcaacaagagcgaaactccgtctcaaaaaaaaaaaaaaaaaaaaaaccatgaaccttcctttaggaaatagagcaatgtagtataaccccacttgcaattttatttttcagattaatgaatatgattaaaattaagatggaataaaaattaaaacaattaaataaaatacaaattggttgtataataaagacaaaattgttatcttgagacacatgttgcatctttccatatgttctaaaattccttaggaacttggcacaagtgctgctgaaataatttctgactgataagtggcagatgccttatcttttattgtggtattaattctaaatcccatcaaataagacaatgcatgatacaaaggataaatttataagcatttgcctcccaatttagacacagaatcattatcatagtacattcactttcaacttgtttctatgttctttctctccttcacatctggcctcttcatgtttttattttctctctctctcttttttttttttttttttttttgtggagacagtctcactctgtcacccaggctagagtgcagtggcacgatcacagctcactgcagcctccaactcctgggctcaagtaatcctcccacctcagcctcctgagtagctgggaccacagacatgcaccaccacacccggctatgtttttgatgtcttgtagagacagggtctcactatgtgagaggctggtcttgcactcatgggctcaggcagtccttcctcagtctcccaacgtgctgggattacatgcgtgagccaccatacctgggcctgttttctctttcttttcattctaaccataatcacttatctatttatggtttttgtttctatttctgaatacatttaaatgccagttataaaatcagaaattcttatttgtgcttaaacatagtaagatttagcagtagtttgaacttcaacatgattattaaatgtggattttaatactagtgatgattcacattttccaacttttatactttacaatttgtttttcttgatgagagtttaggtatctatgaatgaggagaaaagttaattgaattttggcttctagaaacaagtaattaatcttttcctgttaccttttaaaaagatactttactttttatagaaagatagcagtagaaaagaacaggtatttaaatctactcactgacttagaccaattatttcataatggaatctctacttctgtgaatatgtgttttgcttaacgagacctcctaaaaactcatttttatggtcattgaattttagagttagaaaagactttagaaagtgttattagcctctcattttttaaaaacagtttgtatcttgcccaaagtcacactaggggtaaagtaagaggcaaaggaagaactggaattcaagtttctagattccaagtccaggactctttctttttatctcattattttatgaaacatggagagcaagctgattgttcatttaagttcattacactgtatcttggaatttgtcatttctatgcttcactatttaaattaaaatattttatgtttatcacctgttttttgatctgccatgtaagaattttcacttattgtcttccctttaacattgagtctgcatactgctgctaaataatctttctacagtatagtcctaattatgtccctcaaaaaccataatatatctcaccccttctatcagccacatagttaaataaattaaatccaatcatttaacccattgcagactaaatctgcctttcaaatcttagtactttccactcctctgctcatattttatgggccaggcaaatggactacttacttgctattctcaggacacacgtctcatttttcataccactctatcctttcttatacatataacaactttgcctaaaattgtgcccatttgttgagactttgatcaaatttcacatttcccatttcttttgttctctctctctctgttttttttgttttttttgtttttttttttttttttgagatggagtctcgctctgtcgcccaggctggagtgcagtggcgcgatctcagctcactgcaacctccgcctcccagattcacgccattctcctgcctcagcctcctgagtagttaggactacaggcgcctgccaccacgcccagctaatttttttgtatttttagtagaggcagagtttcaccgagttagccaggatggtctcaatctcctgacctcgtaatccgcccgcctcagcttcccaaagtgctgggattacaggcctgagccaccgcgccaggccctattctctctctttttaattccaattacagtgtagtacaagcttgtccaaactatgacccatgggccacatgcagccctggatggctttgaatgcagcctaacacaaattcataaactttgttaaaagattatgaggtgggtgttgctgggtgtgtgtgtgtgtttagctcatcagctgttgttagtgtttgtacattttatgtgtggcccaagacaattctttttcttttaattgtgaccaaaggaagccaaaagattggacatcctttatgtattatattctgactttaaatattgctttccccttaatttttttttcattgtcatctcctcactttattgcaagtacagtcagcatcaatgttgagaactttttctcctaggaggtacaggatttggctctgatacggtgttgcctccacagttgctcagaatctaggctccatctgttacaggaaaggggtcctaatccagaacccaagagaaagttcttggatcttgcacaagaaagaattcagggcaagtccacagtgcaaagcaaaagcaagtttattaagaaagtaagagaataaaagaatggctactccatagacagagcagccctgaggactgctggttgcccatttctatggttatttcttttttttttttttacatgttctattttttaataaaaatatttatttggtcttatgaatacagaattattttatttttatttcaaatgcctaggtattataattctgtataatagttatttgtactttttatatttttatcttttttttattatactttaagttttagggtacatgtgcacaacgtgcaggttagttacatatgtatacgtgtgccatgttggtgtgctgcacccagtgactcgtcatttaacattaggtatatctccaaatgctatccctcccccctcccccaaccccacaacaggccccggtgtgtgatgttccccttcctgtgtccatgtgttctcattgttcaattcccacctatgagtgagaacatgcattgtttggctttttgtccttgcagtagtttgctgagaatgatggtctccagcttcatccatgtccctacaaaagacatgaactcatcattttttatggctgcatagtattccatggtgtacatgtgccacgttttcttaatccagtctatcattgttggacatttgggttggttccaagtctttgctattgtgaatagtgccgcaataaacatacgtgtgcatgtgtctttatggcagcatgatttataatcccttgggtatatacccagtagtgggattgctgggtcaaatggtatttctagttctagatccctgaggaatcgccacactgacttccacaatggttgaactagtttacagtcccaccaacagtgtgaaagtgtttctatttctccacatcctctccagcacctgctgtttcctgactttttaatgatcgccattctaactggtgtgagatggtatctcattgtggttttgatttgcatttctctgatggccaatgatgatgagcattttttcatgtgtcttttggctgcaaaaatgtcttcttttgagaagtgtctgttcatatccttcgcccactttttgatgaggctgtttttttcttgtgaatttgttggagttcattgtagattctggatattagccctttgtcagatgagcagattgcaaaaattttctcctattctgtaggttgcctgttcactctgatggtagtttcttttgctgtgcagaagctctttagcttaatcagatcccatttgtcaattttgacttttgttgccattgcttttggtgtcttagatttgaagtccttgcccatgcctatgtcctgaatggtattgcctaggttttcttctagggtttttatggttttaggtctaacatttaagtctttaatccatcttgaattaatttttgtataaggtgtaaggaagggatccagtttcagctttctacttatggctagccagttttcccagcaccatttattaaatagggaatcctttccccattgcttgtttttgtcaggtttgtcaaagatcagatagttgtagatatgcggcgttatttctgagggctctgttctgttccattgatctatatctctgttttggtaccagtaccatgctgttttggttactatagccttgtagtatagtttgaagtcaggtagcgtgatgcctccagctttgttcttttggcttaggattgacttggcgatgcgggctcttttttgattccatatgaactttaaagtagttttttccaattctgtgaagaaagtcattggcagtttgatggggatggcattgaatctataaattaccttgggcaatatggccattttcacaatattgattcttcctacccatgagcatggaatgttcttccatttgtttgtatcctcttttatttcattgagcagtggtttgtagttctccttgaagaggtccctccttgaagaggtccttcacatcccttgtaagttggattcctaggtattttattctctttgaagcaattgtgaatgggatttcactcatgatttggctctgtttgtctgttattggtgtataagaatgcttgtgatttttgcatattgattttgtatcctgagactttgctgaagttgcttatcagcttaaggagattttgggctgagacgatggggttttctagatatacaatcatgtcatctcaaacagggacaatttgacttcctcttttcctaattgaataccctttatttccttctcctgcctgattgccctggccagaacttccaacactatgttgaataggagtggtgagagagggcatccctgtcttgtgcccattttcaaagggaatgcttccagtttttgcccattcagtatgatactggctatgggtttgtcatagatagctgttattattttgagatacgtcccatcaatacctaatttattgagagtttttagcatgaagagttgttgaattttatcaaaggccttttctgcatctattgagataatcatgtggtttttgtctttggttctgtttatatgctggattacatttattgatttgcgtatattgaaccagctttgcatcccagggatgaagcccacttgatcatggtggataagctttttgatgtgctgctggattcggtttgccagtattttattgaggatttttgcattgatgttcatcaaggatattggtctaaaattctctttttttgttgtgtctctgccaggctttggtatcaggatgatgctggcctcataaaatgagttagggaggattccctctttttctattgattggaatagtttcagaaggaatggtaccagctcctccttgtacctctggtagaattcagctgtgaatccatctggtcctggactctttttggttggtaagctattgattattgccacaatttcagagcctgttattcgtctattcagagagtcaacttcttcctggtttagtcttgggagggtgtatgtgtcgagggatttattcatttcttctagattttctagtttatttgcgtagaggtgtttatagtattctctgatggtagtttgtatttctgtgggatcggtggtgatatccccttattttttattgcgtctatttgattcttctctctttttttctttattagtcttgctagcggtctatcaattttgttgatcctttcaaaaaagcagctcctggattcattaattttttgaagggttttttgtgtctctatttccttcagttctgctctgattttagttatttcttgccttctgctagcttttgaatgtgtttgctcttgcttttctagttcttttaattgtgatgttagttttgagcctatgtgtgtctctgcacgtgagatgggtttcctgaatacagcacactgatgggtcttgactctttatccagtttgccagtcggtgtcttttaattggagcatttagcccatttacatttaaggttaatattgttatgtgtgaatttgatcctgtcattatgatgttagctggttattttgctcgttagttgatgcagtttcttcctagcctcgatggtctttacaatttggcatgattttgcagtggctggtaccggttgttcctttccatgtttagtgcttccttcaggagctcttttagggcaggcctgatggtgacaaaatctctcagcatttgcttgtctgtaaagtattttatttctccttcacttatgaagcttagtttggctggatatgaaattctgtgttgaaaattcttttctttaagaatgttgaatattggcccccactctcttctggcttttagagtttttgccgagagatctgctgttagtctgatgggcttccctttgtgggtaacccgacctttctctctggctgcccttaacattttttccttcatttcaactttggtgaatctgacagttatgtgtcttggagttgctcttctcgaggagtatctttgtggcattctctgtgtttgctgaatctgaatgttggctgccttgctagattggggaagttctcctggataatatcctgcagagtgttttccaacttggttccattctccccgtcactttcaggtacacaaatcagacgtagatttggtcttttcacttagtcccatatttcttggaggctttgtttgtttctttttattcttttttctctaaacttcccttctcgcttcatttcattcatttcatcttccatcactgataccctttcttccagttgatcgaatcggctcctgaggcttctgcattcttcacgtagttctcgagccttggctttcagctccatcagctcctttaagcacttctctatattggttattctagttatatattcatctaaatttttttcaaagttttcaacttctttgcctttggtttgaatttcctcctgtagctcggagtagtttgatcatctgaagccttcttctctcaactcgtcaaagtcattctccatccagctttgttccgttgctgctgaggagctgcgttcctttggaggaggagaggcgctctgctttttagagtttccagtttttctgctctgttttttccccatctttgtggttttatctacttttggtctttgatgatggtgatgtacagacgggtttttggtgtggatgtcctttctgtttgttagttttccttctaacagacaggaccctcagctgcaggtctgttggagtttgctagaggtccactccagaccctgtttgcctgggtatcagcagcggtggctgcagaacagcagattttcgtgaaccacaaatgctgctgtctgattgttcctctggaatttttgtctcagaggagtgcccggccgtgtgaggtgtcagtctgcccctactgggggatgcctcccagttaggctgctcaggggtcagcggtcagggacccacttgaggaggcagtctgcccgttctcagatctccatctgcgtgctgggagaaccactgctctcttcaaagctgtcagatagggacatttaagtctgcagaggttactgctgtctttttgtttgtctgtgccctgcccccagaggtggagcctacagaggcaggcaggcctccttgagctgtggtgagctccacccagttggagcttcctggctgctttgtttacccaagcaagcctcggcaatggcgggcgcccctcccccagcctcgctgctgccttgcagtttgatctcagactgctgtgctagcaatcagcgagactccatgggcgtaggaccctccgagccaggtgcgggatataatctcctggtgcgccattttttaagcctgttggaaaagcgcagtattgaggtgggaatgacccgatcttccaggtgccgtctgtcacccctttctttgactaggaaagggaactccctgaccccttgcgcttcccgagtgaggcaatgcctcgccctgctttggctcacgcacagtgcgctgcacccactgtcctgcgcccactgtctggcactccctagtgagatgaacccggtaccccaaatggaaatgcagaaatcacacgttttctgcgtcgctcacactgggagctgtagactggagctgttcccatttggccatcttggctccgctactttctttctttttttttttttttttttgagaaagattctcactcagccaccaggctggagtacagtggtgcgatctcagctcaccgcaacctccatccacctccgacattgaagcgattctcctgcctcagcctcccaagtagctgggactacaggcgcatgccaccacgccctgttaatttttgtatttttagtagagacggggtttcaccttgttggccaggatggtctcgctctcttgacctcgtgatctgcctgcctcagcctcccaaagtgctgggattacaggcatgagccactgtgcctggccattcttgctactttcatagcaaaacatttggctttggctttgctattctgctttattgtactctttgatatccagtatctaccagtaatgtctggactgcatacatcgttgaaaatacaactgtaattaaagatttaaatgcaatattctttcaggaaaatctctttccctgattttgtttgatattggaaatgaaacaataccataatccttcaggataacttcccacagcaggacaactgcaggaatggcacaaaatatgaattgcataaatactcttatagaacacatcagactagcactttcccaagtttttagtcagatctttgctaccatccctgaaactgttaatgcatatgagtagaaaaattttttacctttgtaagcaaagattctactactagaataatcaaattaactcattctaatgcacatttacttaattcatactatgtgtgaggcagttttaggatgtgatagaaaactttgttttgaagaagctgataaactaggtgggggggaaacagagtacaaataaattataatgcaacataagaaatagcataatagaagaatattcagaccactaaagtcagtcaactctgatccccaaaattaagtatgaaccacaaaaaaatcaagtcagtgtcaatctaatgcagatttatttgagggcttctcttttcttctttgcttaatgtaggtgagtgctttatccttgctatttggtaaatcagcaaggatttattatctattctttgcagagtagtatgttagatgctttgaggatactaaatgaaaaagagtttctgcaccaagaatgtataatctagtagaggagataagctatctatacaaataactgtgtctgcagtctgcacataattgttataaaagaagcctttacaacttgagccaaattcttttacaatgcagaaagccactcctggaggtagagaaaggagagaacatgaacaattcaagaagacttctgttatgcaaaagatggctgaactaaccctggagggatgggtaggattttgacaagagtggttgaaggtattctaattcacttagtacctacatgtgcgaggcagcatgaaggcaaaaaagcctggggcatgttcagagaatagcaagtattctagtttgagtggcacctggtacgtatataagggaatagtaaaagatctggctggaaaggaaaagtaggggcaggttacgaaggacctctgaaagtcagactgtggaactggaacttttatcaggaagcagtagttagttttttcaagcaaaagctaattagagttgatatttaggaggatgaatctaacagttgtgtgcaaggatgccttcaaactgagtgagactagtactggagactggttaagagactacaacaataacctgagtaagaattaatacaggcctgacctagttttgagtgagtaggattggaaacaagagttttaggtattataggatttatgcatataaaatggacttgacagaacttgaagaaagagaaagtgtcaaaaggacacagaaagtgaggcaggatatcttacaatgttaaaggaaaggaataatagaagttaccccccaccccagagaaaaaaaagtaaagagaaaagattggaaagttaaaaactgaacttttagagaaagactgcatttagggaatgtagcaaataagataagcaacagaaaagtgagagaatgggaataaagatatgcaacagaaaagaagggaagagagttcctaggaaagggtggggaaattcaaattctaaaatatcgatgaagtctcatttttcatgtattaaattatccagtggagttggaagatccaaaagagagcaattaaatatgctagagtgcatggggaaaattgacaaaagacctaaaagaaaaatatttaaccacaaaatgaaaagtaataggagatgctaagaaattttggatgggagttaaaattaaatctctgaaagaataaaagggaattaatactcaatttatatcttaaataaatatttctaaatgttacactatgcagaaatccttcttccctggaaaaaatgagatcaagtcctattcaaaaaggtcaagaagaaagactgaggttggtgacccgtgagaaaagtttctgagataagtgtaggtggaatttgtagtattatttatcataagtcagatggctgttaacaaaaagttaattttacatctcatctgttagcccagtcgctttataatgttcggtacaacagaaatgccactactttgtaaccacctaaatgctgtattaccttcaatttccattgtgttgttgatacccaagcagaactcattctttgtcatggagactacagaataccacaagcaggcactaaggttggataatgtgttatctcacattctgaaaggagggtctacatggtagatacatttcttgattctgttttgggataattggctcctaagataattggctatttcattattaaatgcagtatgaactttgcagaagtattcagtatctcttaaaacctgtttcttttccatatagcagtggtacctactttcaatttagtatttattcaccatctactacatgctccacttagtgttttgtattatttctctgtgtgtgtgtgtgtgtgtgtgtgtgtgtgtgtgtgtgtgtgtagtctaacttgtacatttggccaatttctttttcaagcatgttagatttttctctctgacttctttgtagatgtggggtagttttgttttttacttaagagacctgtattgattatttctatggctgtccttgctaattcccactggccattgtgaaaaatcttgtctatggtgtatttgtttctaagacagccacattacaatacactctgtacataattactatgaatcagctggcaagaaagaagaaaataatactggttattggtaatatttgttgattttatatgttagctttattaaagatttttttttcttatcttttttctttcaactattgctacctctgaagaggcttttggtagtatttagatgggttgtgctatccataggtaaaaattctgacctgggggatattacctttatttttcactagatgtaggaaagtagatgctgctctgtttttactccattttgttacattaaaaaaaaattacaatgtagtcctataagtttctttttttattttatccagtactattttagactgtgaatattactggaatttctagttctattccctcttctccctctaaaaatcaaaagtgccaaagagtagtagaccttttgtgatatgttctagtcaaaatagctaaaaactagcgctctctctttaaagttcatattcatctagaacatctcacaccttactcttaccactttactcacagtagtttaaaaaataaaactgtaccctgtatatttgttcatttttgtgttttatgtagagtttccattttgtttttactttttttcaagagtgaattttgtaaaacttccagagtagagtaagttacggccattagagtagccctggaggatgagacttatagtggcaatgattatcacaccttgacaacttgggaagggccatgggatgtggatgtggaaaatatataaaaggacattggttcacatttgaacaaagtggaaggaattattagaaaagcacttaacaagggtgctgatctctccccatctgaggtcttctttcttcttttcatctaattttaagcactgatcagtgaattctttctcattattttacataagcaggtatctaaacttataaaaaattgattatttatcttgtcttttagtgcctttttattaatataagttatttggtttttaaattgtgttgccaatgaatgaaggaagtcctgtcaaaagatatacattttacttatcttaaggctaacagccaccatgtccagcctagcaaacattttttttaatgaaagtccaagtagtatggtctctgttaagctactctacttcaactctgtctgtggtagcataaaagcaaccatagataatatggaaacaaatagtcatttgctgtattccaataagactttataaaaacaggtggcaggatgaatttgtcctataggctgtaggttgctgatcctagcataatgtattgattatacattatggtagagccctctgttggttggaagagaggaccagggaaaaaaaagtgaagatgtattagctatacagaactttctagttggtaagacaaaaagcaagaaaattacagtaatatagaatatgtaaaataaaggaggattcagaactgagtaggtaattcttcagagcatgtcaaatgtagattatggtaaagtagaatgtttatggtttaatacatcaagaactatatccttcataaaataaaatgtagctggacatggtggctacatcttagccaccatatttttacatgtacatgtttggtacaggcttatggtggcatgtaattccaacattttgggaggccgaggcaggtggatcacctgagatcaggagttcaagaccagcctggccaacatggcaaaaccccatctctactgaaaatacagaaattagccgggtgtggtggcgtgtgtctgtagtcccagcttctagggagactgaggcatgagaatcgcttgaaccggggaggcagaggttgcagtgagctgagatcatgccactgcactccagcctgggcaacagagtgagaccctgtcttaaaaaaaaaaaaaaagtgaagaacaaggtaagacacatttaatatatctgatcaagtggtcttgtccaaaaaatgtcctgatacatttttttaaactaataaatggaggattgcagacttactgaatatggcaggatcctttagcatgtaatactttaaaatggatccacactgaacttctgctggatgtactggagtaagagtggccagatttatcctccctcctcaaacaatgcaaaaaccagacaaggtatataacataagagtttttagacactagacaatactgggcagtgatccctgagagaaaatgaatgaggcatccctacaatttccatagcattctgcctagatagcttccagtctgtagtctgcaggaaggagatccaaaacagaaagaacccagtggcccaactgaatggagacaaagccaaggtggctagaatttgcatgagacagtgcgagagaagacagagctccacagagatagagcacacacactggatatctgcagagggctccccttgatttttaagccaagtactgaaccacataagtatgctaggaaactacttagggacagggataaagccactggaaaggaataagtggaacatttcctgaactcagataagattaataatagtttatagccccaataatcacagtggaaaagcctctaataaattggacatcttttttagtactcaaaagaatattacatcagttggggacaatattagctctagattaagagctgctctcatctcacctagtaaagcttctaaataagcttgtaaagaatcaagttgtttttgagtaaccaactgaatttcagagtaaagttagggccattagagtagccctgaaaatatataatgagaaacaaaatatttgatatggtttggctgtgtccccatccaaatctcaccttgaattcccacgtgttgtgggacccagtgggaggtaattgaatcatgggagcaagtctttcccatcctattctcatggtagtgtataagtctcatgagatctgatggttttaaaaagaggagttcctggccaggcacggtggctcacacctgtaatcccagcattttgggagtccaaggcaggtggatcacttgaggtcaggaattcaaaaccagcttgaccaacatggtgaaaccccatctctattaaaaatacaaaattagccaggcatggtggcacacgcctgtaatcccagctacttgagaggctgaggcaggagaattgcttgaacccagaaggcagaggttacagtgagctgagatcatgccattgcacttcagcctgggcaacaagagcaaaactccatctaaaaaaaaaaaaaaaaggagttaccctgcacaagctctctctctttgcctgctgtcatccatgtaagatgtgacgtgctcctccttgccttctgccatgattgtgaggcttccccagccacatggaactctaagtccaaataaacctctttcttttgtaaactgcccagtcttgggtatgtctttatcagcagcatgaaaatggactaatacaatattctacacctaaaacataaaattcataatgtctgttatccaatcaaaaattacctttcattacctgagaaaggcattgttaaaaaataaataagtaagccaggcacagtgacaaatgcctgtagtttctagctacttgagaggtggaaacaagaagatagcttgagcccaggattttgaggccagcctgtgcaacacagcaagaccctatctcagtcaatcaataataaatacacacacacacacacacacacacacacacacacgtatatataaccattcatgcgaagaagcaggaaaatacaacccataatgaggagaaatattaatagaaatggatttagaaatgatacagatgttaggattcgttgacaaagatgttaaaacagcatttctaaatatattatgtatttcaagaaggtaaataaaaacataatcctattaaagagtaatgtgggaaatgtaaaaaaagacctaatttctagaaataaaaaataccatgtctgaggtgaaaagttcactgggtaagatgtggcactacagaagaaaagattaaggatcttgaagacatagcaatagcaattgttcaaaatgaaacacctagagggaaaaaaagactggaaaaacaagcagtgtcactgtgagctgtgagacaactttagatgatcaaatatataaagactacggatggggcagggagacagaaaaaatatttgaagacataagggctgaaatttttccaaatttgataataactgtaaacccacaaatccaaaaagctcaacaaaccaaaagcagaagaaacactgaaaagctacaccaaggaacataatcaaattgcataagatcagtaataaagaaaaaaaacttaaagtagctaggtttctaaaaacaacaacaacaacaacaaaaatgcattacatacagagaaacaaagataagaatagcagcagtctcctcaacagaaacaatgcaagctagaccttggaacacagaaggaaagagaatattaacccagaattctagacccagtgaaaatacctttcaaaaacaaaagcagaatactttttcagacgtataaaacctgaaagagttcatcagcaggagaccattcagaaagcctcagatctaaatgctgcctgtaacaattacctgctgtatggccttggacatacttgaatctctctgaaccttcaaattttcatctgtaagataaaaataatgctaatttttaggggtttcgtgagaatccaatgatagaaaggaaaagaactgacattcattgaatgtcttctttataccaaccacgtattatctcattaaaaatggaaataacctgcctgggcaacatggcaaaaccctgtctctacaaaaaaatacaaaaattagctgagcatggtggtgcatacctgtagtgccaactgtttgggaggctgaggtgagcctgggaggttgaggctaaagtaagctgtgatcctgccactgtattccatcctgggcaacagagtgagacccaatctcaaaaaaaaaataaaaaataaaaatggaaataaaattcccaataatagggctactatcctaacatttttcttatgctagcctctttcttcttgttctttaatactaaaaacttgggttgttctgaaagaaattagtctaagtagcttgtctgtcttacgttttgatgaagcactttttcctaacttaatttgttctttagttaccagattaaatatgcttaaaagtgggaatgaacaactctccttgctagaatagacaagtcagttaatcactttgtgaaacagttaagtttcttgtaaactgcactttatttttttgcctgtgttttggctgcttaatttttttcagttatgtttattgaggtataatttatatactgtttatctaatttttattataaacctattggatagaggcatgagtgtctttatagctgtgcattgccccatagagtttttggcactcaataaaatgttaaataatatttttattcagcattctgtagacgggaagcatatggtaacaaatgtcagagcacaggttgaaaatctccaaaaagttatatgatatattctttggaaaagctagtagagatacttttgtgaatgaaatttctcttaaaaggggttcccagactcacattttatgcaacaaatttctccagccttcagttactttatttacaaattaaagtttttccttatcagaaataatgcataagttaaaatagtataatactaacgtggtatcataagaaagtatataaatggtttgatagataacataaagtaaaggtaactcatagtttgaaggacagcatgagaaaatatttagaagctttagcagtataagtctttatgttgtgatatattgtatgaaaagaaatacacagtggatagttctttattgttaaatttcagcatgacttagttatgtcactgctacagctgttgcagacattctagtggtaggagactttgactcaatattgtttttctcacctgaggattctagcactatttaatactcttattttagtgtcagaaacaatcattgcttcagaataacagaagacattgtgaattaaaacttcaaataaatttcatgcaaaggataatatctcccggttaatctgtgttgaagaaatggttgaccataatcaggtatacaaagccatttagatagcatatatctaaattttctttccagaatttgcttaccctctgatttgctgaccacacttgctttgaagttttggtttttgttgtcttgctatgttgcccaggcatgtctcaaattcctggacacaagcaatcctcccacctcagcctcccaaaatgttgggattacaggcatgagccactgcacctggccactttgaagtttttattaacataatttgaatgtgaaattacctgagtttttcttgttaacctcatgtataaaatgtgggatagggaatccaggcactgcttacttagcttggtgcctctggctctcataagacttttaataaaggtgtcaaccaggtttgtagtcatcttgctgctcagctaggggaggatcttcttccaagcccactcatgtccggtcacagccctcagatcctcactggttattgatcatgcaccactccatagtcctcacaacattgcaacttatttctcctagagcgagggctcagagagagaaggcttgtgatcaagaagatgaacaaaacataccatcacttttgtcatatatttgttaaagcaagtcactaggtctagagcacattcaaggggaggagaatgtacaaggatttgaataccaggttcaaggatcattgaaaaccattttgaagactgcctcctacacatataatccacagatgggacagatcattaaagtactctaggtgctctgacactcatttgtttatcctgagatcttaacaagaacttgaattcaataggcaaaatgatttcagtttcacataaagtatttcatttattcctagcaacaatgcaacgaaataggtatggttaaccccaatgttattgatgaagaaattgatgtactgagtgactggctcaagattacatagcaaataatttgtaaaactgggaccttagtgtaggccttttgattctagaccctgtactctttccattggctataattgcttcctaccagtactatgttgcacttaaagccattcaaggagaatattatacctctaaatttatatacaattatatgaatttttattatacagagatttttatacatatatgtagagaaagacagacacccccctgtcttaatctctaacctataccactccgtttaggagttatagtattattgagtcaaagtctaatatcattataaggcctgtaacagctgtagcaatgacacacatgtacacagatgctagcagcctaaaactacacttaggaggtaaatgtttgttgcatggagagatgaagaagcaaagtaagaaaacagacctggtctggtggctccattcccccttggcttgtcagtatacagaaatcattgtgtttctatataactagtaacaaataattggaattgcagtgagtatgggcaagttatggttttagtttaatattgattatagataattctactttataagtaagaacttgtgttatcagatgaaatatagagaaagttttctcctccatagttgtctttcatatacgcaaacatgcacttgagtttctttcctttcctgcataatctgaggattgtgctttttaatagtggcttgctgatccctttaaatagctcttaatgtaagtattccatagttttcattaatctgattaacatagtttttccctaacctccattcaaaaactatatttggttgttgttttaccctggttgctgaagcagcaagcctactgcaaaacctaagtggtgtggtatagatgagagtctaagactttaattatatgtcattttattcacaacactcaattccaggaaggaaaaaatgggtctgtttttgtaaaggacatattatgtgagtatcattcattgtaaaccaaaaatgatactgtattatagcatagacaacaatgagaactgattctgaaaatgtgacctgactgagaaactgagtaatagtgaaagttatcaaaatggaaaaaaagcgttaatgtgaaatccagccttctcagaaatactctttcctggcctgtttagttttgcttttgttgcttgtcatgcatgaatgaaagtgctgtactctcaggggagcaggaaagcctctgtgtcggttgtttatttccttaatccctcctcctttgtgatttttgatgtcagatctaaaatggaaagcctgtaaatataatgattatcacacggataatcacctgcattaggaaccgccctgcttttctattctaacccgagctgttctccacatgtcacatccactctgtggttggattttaacctgactgcttcattagatttgtgaaactcagtacgaggcgccctggggcagcacagatggggacttgcttgttttcttttctcacttttactgcaaaggcacactaaaaagtccttttcaatttagtgcgatcagttcacttggaattatctctgatatttggaacctgtcttgctcttctgcccaccaactatgcctattctttcttccttactttctgacctaatgtcttttctttctgcctctgcatgtcatgaatctgacaactaaaattctgcttacaattcttactgggtcaaactgttcccccgtgttgttttgtttgttttgctgacagggaaaaataaatgttgttccatcattgtacctacaaacaccttcagatcagaggttagctgtgggaaagtctgcagtgatatgagccagctgccttctctaatggagtgacttggggcaccagtccaagatcagaggaaggtgggaggaagtcagaagataagatcattttaagccacagaacaacaagcttagcttttctagtgatagggcacagctcagcaaacctgtgtgagggggcactaagacaaaaaattgagttgactttttttaagtacatctttcctcagtcagaaatatgttgatgcttgaaatagtttacagacatggaagtgtcctagggcctggtttccttaaaagataatgatttgacatttatatatgtgtcttcttgcagttagtcagctccataccataacagatcacagttaatttttaaaaataatttttttgggctgggcatagtaactcatacctgtaatcccagaactttggaaggccaaggcaggtggatcacctgaggtcaggagttcgagaccagcctgatcaatatggtgaaacccccatctctgctaaaaatacaaaattagctgggcatggtggcacacacctgtagttccagctactcgggaggctgaggcaggagaatacctttaacccaggaggcggaggttgcaatgagctgagatcgcaccactgcactccagccagggctacaagagcaaagctctgtctcaaaaaaaaaaaaaaatatatatgtatatatatacacacacacatatttatatacacatatatatacatatacacacacataaattttttacagttaatttcttatatttgagcaaaactggacattaaaaaaattttactgtatgtgaattttgagcatttatggcttagtgcaattttagtcctacacattcttcctttgaactttgtcttacagtcccctggggttctctcatgtctctgatgaagttccatataaataagtggttctagtatagcttttttgttgtctttttcatataagaatttgcttggttcagagtgacagcttgggaagcactacatcaatagcttttgaaccttttcctattccttgatatcaccgccagcaaatgttactgactatgtgatgtacaaagttctaaccttgcttgcacaaattgaccagttgtcaagatcaatatttatttgcttatttttgtctacatgaactaagggtaacttggtcaggcttatgtttctctagtaaatagcgtaaggagttgtactttcaacttaacacttcctgttgacttcagtgtttagctgtaatcatacattttgacctttctaaatcctcaaaatggttctctaacctatatgttattagtacattggaccataggtgcatacatgtatttttttcccaatgttttcccaaatttctgctgaagacactgactgtactttctgccttacatggcttgatgctacagtcgttttagttgagttggatctgctcactactcaggctcaaatcccatccttctattaatatctcttggcaaagataattttggaagaatgtgagttaagatgtagagactcttgacagttgtctgcagttttttttttttttcattttcaagagggaagtagagttgaaaagtaatattgcctcccttttctatctgtcctaaaattaaagtataagcacaaagagtgaagaaagggaaaggatttgattacacatatgtatttttgtcatttagtaacctgttataagagccttagggtatataataatcattagattgtgtccttaagatatttaaaatctagaagaactttgcatattaaaattttttaaccatacatatttttaatgctcaactgtttttaccctgtcatcttatattaaagaggatttttggactgtttattataaaaaatttcaaacaaaaaaggagacattggacccctacatagcacatacatctagatttaacacttgttaacattttgccacttttgcttcattttaatttttttctgcagtattctaaaataaattacatatatcatgacatttcatttctaaatacctcaggattcatcttaagaattaaggacttttaaaatcaaactgataattcctaatattacctaattttcatttcagattcaaatttctccccttgtcccaaaaatgtcttttatagctggtttgtataaaccaattaaggtttatacattgttcttggtcattttcccttttctactttacattacattgacttgttaaaaacattaagctagttgtcctacagaatgtcctaccctatgaatgttttcagttgctttctctgtgtatactttaacttgttcccctatcctctgtatttcttatagactgcaagttactggactaaagttttgattaattcatattaaagtatttaggttagaatactttataggtgatggtgtgaacttcacactgcatcacaacagaaggcaaagaatatttggtgatcccactattagtgatgataagtgatagcatcgatcactgggttaaagtgatgacagcttgatccttccattataaagttatgctttgctcccgtgaccagcatataatctgagatactttgattccatggaaatacccagttccctatcatcctttttacccaatgagtttaacatctactgaggatccttgcctgcataaatttcgttatgaggattgcaaaaagatgatttttctgaatttatacatttattagcaggcattcttctctacataagagctttttgagaggtattgttttaattaaaaacacaaccaccagcatattccttggattgtctttctttgctgaggtcagaacacctgaactcactgtggcagctacagtaaaaacatgtactacatcttctttattccaacttgtgaagtgtgttgacattaggctgcctttttttattattattattccaagggaaaaaagaaatctttattgctgtaagaataaaaattgaactatgtgggtatattgagataattgtgtaaagaagaagactgaatgagtttcaaaaaatggattatttcttcattaccgagcactttataattaactgttcttttttttttttatttcaggaagctgccacttttgctagagagcaaggctttgaggtgagttaacccacaattgcacactaaacagatcctaaaggttttttctagctgataatgaagttcttttggacagtgattgatgtgctattatactctcagagcctcgcagcagttgccatggaaacttggcagtcgtcatggtttctttgttctgccagcacagtgttatgacgcactctgctaggtctgcacccaacatcgcctacagatgttatttattgaattttgaaaagcctcttgggaagccaagaggttgggcacggtttcaagctgcctctgcagatatggggcctgtcagtttgttcagttaaaaagctacctcattagctgcattacatttcataaggattcactgctaaagcagtggtggaacaagactaaataatgaaatataatgtcgtttaaataatttcagccctatcacatgtagattatcattatgcaaattaatttctaaaaggttgtacttaacagttgttaggaactgattaatttaaatcctgcttttataaacttactctttgaacctatcttttcttctctctccctctttttttctggggagacggaggtagcataaaatatacatacattttctgaaataaaatatcaataattggatttaatttctaggtcctaattctgtttttctgatataagtgttatcctgtcaagattcaaaactccatgtggttgttgttggcaaaactgagataaccgtgttttttatctgtataatacccctcttccaactgattgttagaaaacactgactaatatgaacccaggttaactgacagagaattaactaagttggagttgtttatgactatgatatttattgagtgaactatgtagaatgctgtgttcttacagcaacttaaagtgttacagggtagtaatttttaaaaatttaatctaaccacagccgaaatgtaggaactttctttttatttgcatattcagtattgtctatcaaacagggaagaggtgagtggtgattgaatagtatcagtaaggactagtaagctcactttgaactctagagaaagatattatatgagtttgtgaaactctttttaaatgtagtaaaggcagattatcaagcagcaaagtaatacatgttcatgttattcatgtcatcagacttgacaaacgagacatagagcttcctcttcatagaggaaagacaaggaacatgtgatacagatattctgttctgaagatcctataaaagaactactccagagtagggaaacttgcttctttgtactcaattattaggagctgtgatagtttcttacaagtttgcttttttatgctttaccatattatagtaaatctaggtttaagtcacatttagaaaaaggatttccaagtggtgggtttttttctaatttaagtttcacattttaatttcccaaactggcaattatatgtaggacaaaatgtaatcatgggaatattcaattaaaaagtcaaatgttttgatcatgagaatataaataaaaattttcaggaattttttaaagttttactgattttaagttttaatattacaaaaattatattatctgttgatacatcagaattctccatagaagaaaactttcagaacatacatttgtatcctgtcagtttactgtgttaccataaaaaatgtatttttggttctataaaataaccaattttgcagatacttagaaatataatttgttatataacatgatcatgatcctgtagtatctacatagcagtttttaaaaaatagtttattaagcctgattaatacttttatttcccccttgagctacttgcttttcatgtgcctggtttacattcagtcatagcaacaaactactttttctattttccattaactagcactatattcacctttccattagttcttacttactgattcttgaattgtttttgccataaatctgccataattgattacagcatataagcaaaatgataatgattataatcacataccttattacctcctgacatagcaaaactgctctgtcagtgatattgacagtgatatgttagactaaataaagcacatagtgtcttgatgtgtctcttcgtagattcccaaaaccatcacaagcattgcagaatatatttgaaccatgagtagggtaccctcaaatagatatttttaatcaaatgtaatccatgtatggaacactatctagagaaattcaatgattttataatgtcactaaagtttcctaggtcattagacagaaatggcagagcataggtttgaaacttggtattcttaaggaataaaacaaaaataaatcactttatcttaatagttttctgtgtgaaaatgcattaatactcttggctagtgtgacaaactagacaaaaatctgcattttatcccttctaactttaattttgactctaaatttggagcatgaatgagaagaaagaagtgaaaagattaaaagaaaggaaaggtgagtattttttccttccatcagtgccgctgtcctaccctcattttctcctataaatcccaatcagttccaaaagccactgagtattgccactagtgatctggctgctgacagaccaatccaagcgcctctaaaaataaccagtgtttattcgtcaggaaatattctcagtggcattttttttttaattgattattattctggttagcttctctgcaaattttacttttgtaaaaaaaaaaatctttaaactgaattcggcagttttcagtgagaagcagcagcttaggagagcactggagaatgagataaaaactggagctgggcagaacacaaagcataagagaggatttttttatatatataggtgatggaaaattgcatagtgcctgatttaaatgacagacctgctaagaatttaaaatgacaattcttggggtaaaaagttttataaggccttttattattctagaaaatcagttcagactggagtgtgtttttaaatctagcttttcttgagccgaactgattaaatgttcgtatttttagaacataaataaaaataaggtgctcaaaagcatgtttcattataaagccttttttaaactattgaaaattgatttaaataaagtgaagaaaatacctcaaaacctaaatatatatattctctatcttttcattgtctctgcaactgagtaaatgacaaatgatgaagagaattcataccttctctattggatcatttatttccttttactccaagtaataaattttagattttttttaaattttagatctctaagaataatacttctgctcataggggaaacaaagcaatccttttcgcctttttcacttcctccatagcccctgactacccagaagatcctagacttgtagtctttctctgaccaatgaggattctttcatcttacaccactgaaagagaaaagtatggaattgtgctatccaatacagcatctactagccacatgtggctatttaaattaggattaattaaaattaaataaaatttaaaattcatcacttcttggccttttggctaagatcaaatgtaaaattttaaattcagtccttcagtcatactaggcacatattgagtactctatagactatgtagctaatgactactttattggataatgcaggatagaacatatgcatcatcacagaaagtttcattgatcagcatggatagaaagtctacagagaatgtattcaggcagtgttgattaccaaagaattaccttaggtgacttttaggttcctgtgttcttcacaaatataaatagtgcaatgaatgatcactcagagtttcagagtttctgaaaataagaccctaaatcaggccctgctggctaagagagtgcagtgttgtttttgtaggtgcctgaaccccaaaagaggacaattttagaacagttcagttaagggaaagcaataagctagtcttctaattctcttcatttaatcatttatttattcaacaaatatttactgagttcttactatgtacataccactttgatagaccccaagacaaggtggaagtgaccagagagtgtaccatgaaagagcatgtgggaagggttcccattttagctatgatggctatggaatgaccctaaaaatatgaatatctagcaatgacaaaaaaaaagcgacacaaacagcaaaacaaatttcaaacagagagaacaggactataaaagtctctgaacgagagagaacttaatgtactatgtactccaggaactgacagaaggccagtgtgactggaatggagttagtggggacagcatatgagatcaatctggcactgacacatcatataaacagcataactattaaaggagtttctatttggaaaacaaaacaaaatggtatggctagatgactcaatgtgtggaaacactacagttggttttctacagaactaggtagactgtgacaggattgcttaacctttgtataaccagctggttaaaaatagaataaagattttctttatccagtctatcattgatgggcatttgggttggttccaagcctttgctattgtgaatagtgctgcagcaaacatatatgggcatgtgtctttatatcagaatgatttataatcctatgggtatatatccagtaatggtattgctgggtcaaatggtatttcttgttctagatcctttaggaatccagttcatgttctttgcatggacatggatgaagctagaaactatcattctcagcaaactaacacaggaacagaaagccaaacactgcatgttctcactcgtaagtgggaattgaacaatgagaacacatggacacagggagggcaacatcatacaccggggcctgttgtggggtggggggttggggagggatatcatcaggagaaataactaatgtagatgacaggttgatggctgcagcaaaccaccatggcacgcgtatacctctgtaacaaagctgcatgttctgcacaggtatcccagaaattaaagtatgattaaaaaaaatttctagtaatagtaacactactagtaattcaaatgaagtgtgtgtaacagaagaaataaaaaaaaaattaaaatgctacatctgaaaatacctatttcatacaaagcaaggaggtaaagaagggatagaacatatttttttaaaatatgacatatggaaaacaaatagcaaatggcagatattaattcaactgcattaataataatgttaatctggagtaaataatatgataaaaaggcagaaattctcagactagataaaaaaactgaggtctaactatatgctgtctgaaagagatgtatcttcaattcaaagatacaaataggtaaaaaaaaaaaaaaagaatgaagagagtatgttctttgatttggaagacaatgtgatcaccaatgacaataaaaccatatttctacatttataaaatgctcacagtttataaaacctttcccaacatatcagtaatacattcatacttgcacaaaccttgagagataggtagggcatgtattgccatatcagttcaacagattaaaaaaataggctatatggccgggtgtggtggctcccacgcctgtaatcccagcactttgggaggccaaggtgggtggatcacctgacatcaggagttcgagaccagcctggccaacatggtgaaaccccatctccccttaaaatacaaaaaaatagccaggtatggtggcagatgcctataatcccagctacttgggaggctgaggcaggagaattgcttgaaccaggatgtggaggttgcagtgagctgaaattgcaccattgcacaccagcctgggcaacaagagccaaactccatctcaaaaaaaaaaaaaaaaaaaaaggctctatgactttttcaaagtcatatagctaatacattatgtagccagaaccagagctcagctctctatgtctggtgctctttactataaagcacacagctttctctcacacattctaacatgttggaagaggagattagatttcaaaatgactttgagaaatgaaaaatacctttttttttttttttttttttggggagggggtttggctttgtcacgccaggctggagtgcagtggcgtgatctttgctcactgcaagctccgcctcccgggttcactccattctcctgcctcagcctcccgagtagctgggactacaggcccccgccaccacatccggctaattttttgtatttttagtagagacggggtttcactgtgttaaccaggatggtctcgatttcctgacctcatgatccgcccgcctccgtctcccaaagtggtgggattacaagcgtgagctaccgcgcccatcgccatatcagttcaacagattaaaaaaataggctatatggccgggtgtggtggctcccacgcctgtaatcccagcactttgggaggccaaggtgggtggatcacctgaggtcaggagttcgagaccagcctggccaacatggtgaaaccccgtctctactaaaaatacaaaaattagttgggtgtggtggcgggcacctgtaatcccagctactcagaagcctgaggcaggagaatcacttgaacccaggaggcagaggttgcagtgagccaagatcgcaccattgcactccagcctgggcaacaagagcgaaattccatctcaaaaaaaaaaaaaaaaaaaccactgaaattcgctggagtaaaaatatgagccaaattaattaagaaaaaatagcaaacttaaacacaagatcaggaatgacttgtgaatgtggtaggaaaatggtttaggatgaacatgctatagttttgtgataaaaaaaaacaacaaaaagcacattgctagcatttatagaagcactataataatggttaagtgtattatccttggagtcagactgtgggtgctagtctgttctccactacttgtatttatgaccttaggcacattacttaacgtctctgactcagtttcttcatctataaaatggcatattgtattagtacctactgcctagagtagttcagatttaatgagtactttattttattgattggttgattgattgttttgagacagcctcactctgttgccctgactgaaatgcaatgatacggtctcagctcactgcaacctctgcctgctgggctcaagcaatctgtagattcaatgcaatccctatcaaaattccaatgtcattctctctctctctctcttttttttttttgagacagggtctggctctgttgcccacgctggagtgcagtggcgtgatctcagctccctgaaacctctgtctcccaggctcaagccatcctcccacctcagcctcctaagtagctgggactataggcgcatgccaccacacctagcaaatttttgtatttttttgtagagatgaagttttactacgttgcccaggctagtctcaaactcctaggctcaagcgattcacccgcctccgcctcccagtgtgctgggattacaggcatgagccaccacgccttaccttaatgaatactttagagctttatacatggcttttagtttcttcatctataaaatagggataataatagtacctactgactagagaagttaagatttaatgagcactttagagctatgtacatggctcacagctcaattttatgagctttcaactcatacttcttactcctccctgtcttcatcttcttcgttatagatactataattgaatgttccatattcaaaactcttgaagccctttctagcgattttggggcaacctaagtatgtaaccattttagagagtattaaaatgagagtaattagaggaaataaattaatatttaagttcttagcatgtgctaaaattgcattaagctatttcacttacctcatcttctttcatcctcacaatttttaactttttattttaaaataactttagtcttagaaaaattacaaaaatagtacagaattcccacatacccttcacccagtttaccctaatattaacatcttacataaccaaagtataatgaataacagaaaattaacattaaactacaataactgaactatatacaggctttattctggtttcaaccgttttttctctagtttcctttttctgttccagaatcgaatcccacattgcatatttgtcatgtctccttagtctcttctaatctgtgacagttcctcactcttgttgttcatgaactttatacttttgaaaattattggtcagtcattttgtagaatgtccttccatttgagtttgtctgatgttttctcatgtacattgagattaggcatttttggcaggaaaaccacagaagtgatgttcctttcttggtgcatcatatcagggaggtacacagtgtcacagattcttattgctggtgatgctaaacctttatcactaggtttaggtggtgtttgctagtttatcctctgtaattcccattgtatttaataaatatcttggaggagatactactttggggctatggaaacattctattttatccactaattttagcatcactaaactaatctatctggcttaaggtgatgtctgtcaattttctctactataacattatgatttttccttttgtaatgaatatcttagggggacatactttgagactgtaaatatcctgttttctttaatttttgcccactaatcttagcatacttatccctcaaaatcttttaatgtgaacattttcttagttttgtagatgaggaaatggatcttagagaggtttattaacttgccccaaatcatacaaatagtaaatccaagcctgtcatattctaaaagtccttgtaatttcattgtttgttaagatgtgtgagcttaagtgtaagggagaagaacctattggggacagaggagaggaattactgtagaaggagaaataaagttttacatacatctgggaagaattatgttttgtacttggaaagtttattttgtcctttaattgccattttatgaggtttaatttgagacataagaaacatttctttgattaaattaccaaagctctcaacaaaatatgtcttctcacagggttggtagaaagcaaccatggaatcttattcctttttttttttttttttttttttttttgagatggcgtcttgctctgtcaccaggctgcagtgcagtggcatgatctctgcacactgcaacctctgcctcctgggttcaagcgattctcctgcctcagccctcccaagtagctaggactacagacacgtgccaccatgcccaactaatttttgtatttttagtaaagacgggatttcaccatgttagccaggatggtcttcatctctcgacctcgtgatctgccctcctcggcctcccaaagtgctgggattacaggcgtgagccactataaccagccagaatcttattcttaatttattccttatatcaccttgaagaaagactttcttttaaagaacatctagtacattcataagattctgctttcaagatgatgaagtgaatgtgtttttctcttatctttattaaatatgagctgtacttaatcacaagcaaaaatcctatagtagtaaaatatatttgtgctaaggaaattgccaaaatatacatgagtcattttaattatatgtgtacacttatttaggtgagtgaagacattgcatggcattttttggtcctttcagctgttactagtcatttctaaaagtctgtctcctgaaactgagggaatttcttctcatcttatcagagttcagacttagttctgttctaaaataagcaaccgaaagcgaaatagtcagcatgtttgaagtcagcagcactgtcctactacaaatggctattcttttcagaaacaactgtcctctagaagtcatcctgttaggtatattagaagcttagcttcatatattatctggaatttattaaatattgagtgaacaaacaatataaaaatatttcaccactaattgtcatccctttaaaaatgccagtttctggtgacgtttgtaacgattgcaaaccattgtgacttgtctgctttgcttgcctaaatgttctctctcatatattctatttgttctcttatatatactttatttatgccactcagctatatttccgctctgataggtgtttctttctctataactatttgaaactttgcatagtgatagaataaactagttttgttagcaaagcccaaaactatggacagttttaaaagcccactgaatacagacatggattttcaaattatccaaaatggttgaaaagatgattctaaaacctctgcctttagctcaaggttaggtttcaagatttcagaaaacttcaataaagatttcagtaaaactttatggcctatgtggtgtgaaaaacagcatcagagtttgacaattagtttgtcattttttaaactttatcttttttaaagaaaattaagtctttgtaggaaaggattagcatttctttctctcaaatcagtcctttgaaaaattgacattataagaactgtattttttccaaagtcagcataattatgttctgtaaacctctaaaataattaaattttcctctttataaaaacctctctttaattgggaatttgaaaactgcctggatatttgctgatacttagtcattgttaataatttttgaagtatgataatagttttgtggttatgtttatcattacctttcaaagatatatactaaaacatttatagatgaaattatgtatagttcttggagtttactttagaataatttgaaaagcaagtggatgaggatataggtgaaataagattcatcatacattttaaatttgtgtagatcattgatgggttccttggaagtcactgtgctattctatttacttttgtatatggttaaagaaatttttaatgtctcttaatagatatgcaggtctcttattttgatcaatagaagctaaattgttaatctactaataaagttttgttttattttattggtcatgagaattttttccttccttctattaatagactaaagacattaaagagatagccaaaaagacacaagccctgccaaagatgaactcaaagaggcagcgaatcgtgatcttcacccaagggagagatgacactataatggctacaggtacatgtgggaaatgtgtgatgaatctagtattatggagattaatcaattacaaaaaaaaattctgtattctttctattataatatatacaatatacatatacaatatatataaaatgaaatattttattttaataaatatttctaccctgtatctcagtagaaaagatttcatgttcaagaagatagtttattaacatttagttaaataaaccactttgatataatttatttacttagttatcttggggattttgtcaatcaagaaatatctttcctgaaaaaaagaatacatttcatttataaaatacctgcactagagtaaaataaatttactcaattatgaacaaataaaatccagaactaagttacattttccatttttccttcaagaagaaaatctcattttttgttttatttcaccatctattttatagcactcataaaacaggaatttcatctagtaagcaaacatgttattgattaaaatgattaatagtgttaatatggagctacccactattaaaaatataaatgttttaattctgtctgtaccattcagattaaaaccaatcagttgattagttattgtaaactggagcaatttagtattacctatgtgtttgttcagtactctgctgaacactgaaatataaaataggaaccttaaagatctaactgggaattaatattcataaaatataagtacaaagtaaaatataattatagttcttatctattggtgctaactatatggattgtattgactcaggagatcagtaaatcttgaaaaaagatgttatagtgaatatgaagtacatttgtgttgaattaaatataaagcctgaaataggccaaagatgaaattactgtcaagatattttctttcttttttaaaataaattttattctttatatttgaggtttataacatgatgttataggatacatagatatatatagatcaactttcttatttcagaatggtcaaaagcaagattcagagatttgtttcaaaaaatatttgcttcaaagtagttcagtgagtggtagataaagtgagggtataaatgaaatgagactggtaatgaattaattgttgaagctagacagtggatatatgggggcatcattatgctattatctccacttgtggatatgttttaaattatccataattaaaactttaaaaaaagaaagaaaagtttttttttttaaatttcaaacaagattcagagatgttgagtggctttcccaagatacattgatatccttgctaatccttaaattctaggaaggattaaaagaaaggaggacaagtgggcacagtggctcacacctgtaaccctagcaccttgggaagtcaaggtgggaggattgcttgatcccaggagttggagaccagccttggtaacagcaagacttcatctctacaaaaaaaaatggaaaaaaaaaaaaaattagctgagagagtagtggcacatgcccatagtcctggctacttgggaggctgatgcaagaagatcacttgagcccagaagttcgaggctgtgttgagctatgatctctccactgcaccccagcatggatgacagaccaagaccctgtctccaaaaaaaaaaaaaaaaaaaaaaaagaacggagggcaatggagtcaaagaggatcaagtaagcaaaggcacaagtactagcaatcttttattgtgatggcaagaagaaccaccttgttaatttgtacaagagagaaaagaaaccatgaaaagatatccctgcactgatacaaactatctgaattgctttcttcctatagtataaggattattcctgtcttagcagtggacagtttagaaaagtgaaaaacatacaggcttcttataggaattgtagtactaccttcagatttacaaaatattctttggttgctctttgtggagacattcattttaagtctttgtatattctagatatacatactgtacaagtgtcttccttattgtgaatttgcagttttcccaaaattgaaaattaacctccccattctgtgactgtatttccttgtgaactcattttattctttattaaatctattaagccattcttaggaatgcttacaagctggaatttatttgaggaaagacactggctaatctttgctgttcctaccatatgaaaatgaacttaaatcaaaggatgcactatatctgcaatgcatgataaatacaagatggatagagaatctgttcagtggtgtcagctacaaaagcaaacatgataaatgttaatgcagttttgagccctgggataagctattcagtgcacaagtgtagctgaatctctttgctatgttgttattcattgcagccaaataaatgtcaataataaaagagaattaaagattttcatttcccagaggcagtcctctaatacggcttgatctttcatttcatttgtaattcgttctcatgtcaggatgcaatcattcgccaggctctgggtgtcatgttaagccatttaataatgattaagaacataaaaatgcttggcctgtggggcaattcacaaaagagatgccaatttgttattgttttccctcctttcctcttgaatatggatcagctttttcccacctcctagcattaaaatactaatggaagatagggagggaaagtgtcccttaatttaccataagtgacattccagaatggcacaaggcagtgctaacacacatattaaaagactaattaggaatcattgtgccttaaacctatttttttttaatgatactttaagttctgggatacatgtccagaatgtgcatgtttgttacatagttatacacatgccatggtggtttcctgcacctatcaacccatcatctacattaggcatttctcctaatgctatccctccctgagctcccccaccccccgacaggccctggtgtgtgatgttgccctccttgtgtccgtgtgttctcattgttcaattcccacttatgagtgagaacatgcagtgtttggttttctgttcctgtgttagtttgctgagaatgatggtttccagcttcatccatgtccctgcaaaggacgtgaattcatccttgttatggctgcatagtattccatggtgtatatgtgccacattttctttagccagtctatcattgatgggcatttgggttgactttgctattgtgaatagtgctgcaataaacatatgtgtgtatgtgtctttatagtagaatgatttataatcctttgggtatatacccagtaatgagattgctggatcaaatggtatttcctgttctagatccttgaggaatcgccacactgttttccacaatggttgaactaatttacacttccaccaacagtgtaaaagcattcctgttcctccacatcctcaccagcatttgttgttttatgactttttaatgatcaccattctaactgacatgagatggtatctcattgtggttttgatttgcatttctctaatgaccagggatgatgagctttttttcatgtgtttgttggccgcataaatatctccttttgagaagtgtctgttcatatcctttgcccactttttgatgtggttgtttgttcgttttttgtaaatttgtttaagttctttgtagattctggatattagccctttgtcagatggacagattgcaaaaattttctcccattctgtaggttgcccgttcactctgatgatagtttcatttgctgtgcagaagctctttagtttaattggatcccatttgtcagttttgacttttgttcccattacttttggtgttttagtcatgaagtctttgcccatgcctatgtcctgaatggtattacctaggttttcttctagggtttttatggttttatgttttatgttttaagtctttaatccatcttgagttaatttttgtataaggtgtaaggaaggggtccagtttcagttttctctatatggctagtcagttttcccagcaccatttattaaatagggattcttttcccccattgcttgttttttgtcagatttgtcaaagatcagatcgttgtagatgtgtggcattatttctgaggcctctgttctgttccattgatctatatatctgttttcataccagtaccatgctgttttggttactgtaggcttatagtatagtttgaagtcaggttagcatgatgcctccagctttgttctttttgcttaggattgtcttggctatacgggctcttttttggttccatatgaaatttaattttctctaattctgtgaagaaagtcaatggtagcttgatggggaaagcattgaatctgtaaattactttgggtagtatgaccattttcacgatattcttcctatccgtgagcatggaatggttttccatttgtttgtgtcctctcttatttccttgagcaatggtttgtagttcttgaagaggtccttcacatcccttgtaagttgtattcctaggtattttattctctttgtagcaattgtgaatgagagttcactcatgatttggctctctgtttgtctattattggtgtataggaatgcttgtgatttttgcacattgattttgtatcctgagactttgctgaagttgcttatcagcttaaggagattttgggctgagatgctggggttttctaaatatacagtcatgtcatctgcagacagagacaatttgacttcctctcttcctatttgaataccctttatttctttctcttgcctgattgccctggtcagaacttccaataccatgttgaataggagtggcgagagagtgcatccttgtcttgtgccggttttcaaaggcaatccttccagcttttgcccattcagcgtgatattggctgtgggtttgtcataaatagttcgtattattttaagatatgttccatcaatacctagttttttgagagtttttagcatgacggagtgttgaattttatcgaaggccttttctgcatctattgaggtaatcatgtggcttttgttattggttctgtttatgtgatggattacgtttcttaatttgcgtatgttgaaccagccttgcatcccagggatgaagccgacttgatcatgatagataagctttttgatgtgcttctggattcagtttgccagaattttattgaggacttttgcatcaatgttcatcagggatattggcctgaaattttctttttttgttgtctctgccaggttttgctgtcaggatgatgctggcctcataaaataaattagagaggagtccctctttttctattgtttggaatagtttcagaaggaatagtaccagctcctctttgtacctctgatagaattcagttgtgaatccgtctgctcctgggctttttttggttgataggctattaattactgcctcaatttcagaacttgttattggtctatttagggattcaacttcttcctggtttagtcttgggagggtgtatgtgtccagtaatgtatccatttcttctagattttctagtttatttgtgtagagatgtttataatatccactgatggtagtttatatttctgtgggatcagtggtgatctcccctttatcattttttattgtgtctatttgattcttctctcttttcttctttattagtctagctagcagtctatctattttgttaatctttgcaaaaaaccagctcctggattcattgatttttggaagggttttttgtgtctaactccttcacctctgctctgatcttagttatttcttgccttctgctagcttttgaatgtgtttgctcttgcttctctagttcttttaattgtgatgttaggatgtcgattttagatctttcccgctttctcctgtgggcatttagtgctataaatgtccttcttaacactgctttagctgtgtcccagagattcgttgggtctctgttctcattggttttaaagaacttatttatttctgccttaatttcattatttacccagtagtcattcaggagcagattgttcagtttccatgcagttgtgtggttctgagtgagtttcttagtcctgagttctaatgtgattgcactgtggtctgagagactgtttgttatgatttccattattttgcatgtgctgaggagtgttttacttccaattatgtggtcaattttagaataagcgtgatgtggtgctgagaagaatgtatattctgttgatttggggtggagagttctgtagatgtctattaggtctgcttggccagagctgagttcaagtcctgaatatcgttgttaatttttggtctcgttgatctaatattgacagtggggtgttaaaatctcccactattattgtgtgggagtctaggtctctttgtaggtctctaagaacttgctttatgaatctgggtgctcctgtattgggtgcatatatatttaggatagttagctcttcttgttgaattgatccctttaccattatgtaatgcccttgtttgtcttttttgatctttgttggtttaaagtctgttttatcggagactaggattacaacccctgctttttttttgctttccacttgctttgtaaatattcctccatccctttattttgaacctacgtgtgtctttgcacatgagatgagtctcctgaatatagcacaccaatgggccttgactctttatccaattccccagtctgtgtttttcaattggggcatttagcccatttacatttaaggttaatatattatgcatgaatttgatcctgtcattatgatgctagctggttattttgcccgttagttgatgtggtttcttcatagtcttgatggtctttacaatttggtatgtttttgcagtggctggtaccagtttttcctttccatatttagtgcttccttcaggagctcttgtaaggcaggcctggtggtgacaaaatctctcagcatttgcttgtctttaaaggattttatttctcctttgcttatgaagcttagtgtggctggatatgaaattctgggttcaaaattcttttctttaagaatgttgaatgttggtcctcactctcttctggcttatagggtttctgcagagagatcagctgttagtctgatgggcttccctttgtgggtaacccaacctttctctctggctgcccttaatactttttccttcatttcaaccttggtgaatctgacaattatgtgttttggggttgctcttctcaaggagtatctttgtggtgttctctgtatttcctgaatttgaatgttggcctgtcttgctagattggggaagctttcttggataatattctgaagagtgttttccaacttggttccattctccccatcactttcaggtacaccaatcaaatgtaggtttggtcttttcatatagtcccatatttcttggaggtttgttagttcctttccattcttttttctctaatcttgtcatgatgctttatttcattaagttgatcttcaatctctgatatcctttcttctgcttgatcaatttggttattatatttgtgtatgcttcacgaagtgttcgttctgtgtttttcagctctatcaggtcatttatgttcttctctaaactggttattctagttagcaattcctctaaccttttttcaaggttcttagcttccttgcattgggttagaacatggtcctttagctcggcggaatttgttattacccaccttctgaagcctacttctgtcaatttgtcaaactagttctctgtgcagttttgttcccttgctggtgaggagttgtgatcctttggaggagaagaggcattctggtttctggaattttcagcctttttgcactggtttttccttatcttcgtggatttatctacctttggtctttgatgctggtgaccttcggatggggtttttgtgtggacatcctttttgttgatgttggtgctattcctttctgtttgttagttttccttctaacagatgcctctgctgcaggtctgctggagttttctggaggtccactccagaccctgtttgcctgggtatcaccagcagaggctgcagaacagcaaagattactgcctgttccttcctctggaagctttgtcccagaggggcacccgccagatgccagctggagctctcctgtatgaggggtctgtcgacccttgctgggaggcatctcccagtcaggaggcatgggggtcagggacccagaggcaatctgtctgttaggagagctcgagcactgtgctgggagatttgctgctctcttcagagctggtaggcaggaaagtttaagtgccgaagctgtgcccacagctgttccttcccccaggtgctctgtcccagagagatgggagttttatctataagcccctgactggggctgctgcctttctttcatagatgccctgcccagagaggaggaatctagagaggcggtctggctacagtggcttttccaagctgcagtgggctccacccagttcaaactttttttgcgaactttgtttgcatctttgtttacactgttaggggaaaaccgcctactcaagcctcggtaatggcagtcgccccttcccccaccaagcttgagcatcccaggtcgacttcagactgctgtgctggcagcgagaatttcaagccagtggatcttagcttgctgggctccgtcggggcaggatccgctgagctagaccacttggctccctggctttatccccctttccaggggagtgaacagttctgtctcgctggcgttccacacgccactgtggtatgaacaaaaactcctgcagctagcttggtgtctgcccaaacagcagcccagttttgtgcttgaaacccagggccctggtggtgtaggtacccgaagaaatctcctggtctgcgagttgtgaagaccatgggaaaagtgtagttatctgggctggagtgcaccatttctcatggcacagtccctcatggcttcccttgactaggggagggagttctcgaccccttgcacttccccggtaaggtgacgccccaccctgcttccgctcgccctttgtgggctgcacccactgtctaatcagtcccaatgagatgagccaggactctcagttggaaatgtagaaattacccgccttctgcgttgatctcgctgggaggtgcagaccggagctgttcctattcagccatcttgccagccacccaaacctatttttaaatgatcacactgttaagtttgcagtacttagcaataatgtatcaaaatgtttccttggagttttattctacagacctatctccttttgagatatgatatacataaactactttgtcttattttataaatttaattctttaaattgcctgtaaatctaaagtattttccgctcaccctgttttatgggtcatacctctttcagattgagtttccatctaccctagaggttctgtcacataccaatcattgtttcagtccttgcaggttaattgagtttcaaaaaaattttcaagggagtgctgggcactgaagaatattaagagtaacaggctgggcaattccacagcagagtatatgtccaaaataattgaagcaggaacctaaacagatatatgcccacccatcttcatagcagcattattcacaataaccaaaaggtagaagcaatcaaagtgtccatcagcagatgaacagataaataaaatgtgatatatacatacaaaggaatattattcagctttaaaaaagaaggaaatcctaacatgcactacaacatggatgaaccttgaagacattatgctaagtgaaataagccagtcacaatgggataattactgtgtgattccatttatgtgacatacctagagtagttagctttatagacaaagtagaatgatgttagccaggggctgggggagggctgaatggaaagttattgtttaattggtaaaaagtttcagttttgcaggatgaaaaagttgtaaagatgggtagtgataattgcacaataatatgaatgtacaatggcactgagctgtatattcaacaatgcttaaaatgttacattttatgtatatttttattttttaagcatatttttcaatttaaaaaaaattaaacataacctaaagagtaagatgctgggggtgaaggcagaaaagatgactgtccattttgatcctctttataaatgttgaatgaatctgttgaataacatggcagtaaggtgaaggaaatcatttctgtgtttataaactggaaaaactaacagtgttctttacctgttggagagcaactactaatgagatcttcatacaataaaaccttattatattaagcatggtagtaaaaaagtaaatatatatatgtatgtaaatacatatatagtgctttatagaaagtttaaacttccccaagtttctatactaaataaatcaccaaaaattggagaaagcaatacaacttttgttctgaattggaaataatgtgtttccaattaaataggtccactgaaaaataaactgtagatttttctgtttcgtttgttttaagaccaggcctcgctctgtcacccaagctggagtacaatgacacaatcatggctcactgcaacctcaaccgggctcaagcgatcctcccttcccagcctcctaagtagccgggactacaggtgcctaccaccctgcccagctaatttttttgtattttttctttggtggagactggattttgccatattgcccatgctagtctcaaactcctgagctcaagtaatctgccttcctaggcctccctcctaaaatgctaggattacgggtgtgagccaccacacctggcctaaattgtagacttttctgaacactcagaattcttatttgaattgtaatttttcacaaagggagaaaatatattaagtcagatgttttcaactggaagactggtgctatcacatcaaaatcacctagtgagtttttggtaaatacagtcctaccttttttttttttttttaattttagaattgggggagggtgtgatactttttcagggttgttacatggatatattacataaggctggggtttgggcttctattgaacccatcacccaaacagtgaatataatacccaataggtagtttttcaactcacccccacccacttcctgcctccccctttatgtccatgtatacccattgtttacctcccacttataagtgagattgtggagcatatggttttctgtttctgggttaattcactttggataatgtcctctggctgcatctatgctgctgcaaaggacattatttccttctttgttatggctgcatagtattacatggtgtatatgtaccacactttctttatccaatccgctgttgatggacacttaggttgattccatgactttgccattatgaatagtgctgtaataaacataagaatgcaggtatctttttgatagaacaatttcttttactttgggtagatacccagtagtggggttgttggattgaatggtaatcctgtttttagttctttgagaaagttccaaactgctttccacaggggccaaactaacttacattcccaccaacagtatgtgtttccttttctctgtatcctcgccaatgtgtaatttttttactttttaataatagctgtgctaactagtattatgatatctcattgtggttttaatttgcatttctctgattattagtgatgtggaacatttttcatatgtttgttggctgcttgtatgttcccatttttaaaaattgtattgatttatttgtattttatagagaaagtgtcttgctatgttgctcaggctggtctcatacttcctgaggctcaagcagttctcctgcctcagccttccaaagtgctgagattacagacatgagtcaccatgcctagctgtatgtcttattttgagaagcatttgttcatgtcccttgcctactttttaatggagtaatttgggtttttcttgttaatttgtttaggttccttatagattctggatattagtcctttattggttgcatagttagcaaatattttctcctaatctgtaggctgtctgtttattttgttgatagttacttttgttgtgcagaaactctttagttaagttacaatggtcaatttttatttttgttgcatttgcttttgaggtcttagtcataaattctttgcctaggcctatgtgcagaatagtttctcctaggttttttctaggatttttatagtttgaggttttatgtgtaagtctttaatctatcttgagttaatttttgtatatggtgagaggtaggggtccaatttcattattctgcatatggctagccagttttcccaatatcatttattgaattgagtgtcctttcatcactatttatttttgttgactttgtttaagatcagttggttgtaggtttgtgggtttacttctgggttctctattttgttccattgatctatgtgtctatttttgtgccaataccattgctattttggttactataccctagtagtatagtttgaagtcaggtaatgtgatgcttctggcttcgttttttgcttaggattgctttggctattcagctaccctgccttcttaaaagcacctttctttcaatctgatacaaccctgtgaggagtattagaaaatacaacttcaaggagatgtttgagaatgcgggcagtacagtctggggcaaggggagtgtaggattatgtatggttgaaaatgttccctttggtgatatagcaatgctgtctatcctccacctgtcactttgagaatcactggattaggtgatttaataatgctgcaagttccgtaatctgctggaaaaacgaaaacagaactttttaacagctaagggtctagttcttcaataactcaggccttgggaaatgcttcttttttcgatccttcaaaatccatccacacttacaggcaatctacagtttactttaaatagtctcctacttttgaggtgcttataatttaacatagttacatcccaatgccctttgtcattttattttaagtaaatggggttattgacgttacttgtcttcatgttcctgagtccttaaagaaacgtgttacctcatctgctagttaagttttcatgttctatgaaaacactcaatgctgcccattactctgtaagaaaaggtcagtgtgatttgcaattctggtagacgtaaagttcagaaaatgtgcgttagaaaatgcaaactctaaaggaaaacaatctcagcattggaagaataatgtcagcacatgatcccaactcaaaatattaatataaatcattttgaaaatgtctctactacagccaaatcaattttaaatgataaccttgttggcttagattggtgatggtaaagatagaataaactaagtggcattcttttaaaatgtcttgtatggcattcatagaaaaaagttcttaccaggtaagatcttagagaaaatatatttctcacctatgaatgtaagttactaagttattagctcatggtccatttttagattattgtaatcacaaaagataaactcctttaattaattggtcaaaaataatttagaataacatgtggacctgtcacatttttgacaaagtagtatctttgggatgtggttcatttagttcagtgatctcaagcctgaagaaatgagacttctttcaactcccacctttttattgaaaaggatcctgctagaaggcaaaataagaggcaacctatcctaagcagatataagccctattatagcactgatttctggagggatgtttaagtcagatttgttgagatatagattacatatagtaaaatccacaaatatgttactaaataacatgtaacaaccaccacagactatagaccaccttgtacagtttgtattgaagtataatgtgcatacaaaattgatacaacttttcattaagtggatggacctgtgtagctataaccagatcaggaaatacaatacttatagcacttaagaagcttctccttgtgccccctcctaatctttatccccactgaaggtaaccattgtcttagcttctactactgacagttagctttgcctgtttttgaaatggaaccactcagtatgtagacttttgtctgctctatctccatccatttttgtgcactttcttactttttgacaacataagatcccccgggctcacgttgtattttctccacttcagtcctataatcaactatttctccaaggaaccctggttccctttattgaagaatggtttttagaaacctgtaactgtgctctagatatgctctttgttccttgagtgtctttgcttctaggccctcttagcaaacagaacttggcaatatatgtatgtataataacctatgtatactcactcatctatatttatttctgtatctatatgtttatatatttttaaaacatgaagtcatactgataaattttatttcagtccagcagcacaaggctcattctagccttcattcttccttttgtacaacttcttcctttgacattgaaaattctggctctcattatctaaaatgtatttacttatttgttttatcctaaagtagttttgaattgcttgcccatacccttgtatgagaaagagatttaccctttagagtataatatttgcttacagttctttttttctgtagcccaatagtgtccagtcaatatatagttatccaaagtaaattagctcttttatttcatccactcattatggttacattattcatttgtaatacaggtagggtcacttgttaagagtattccattttggtttcttttcacatcctgattggggttttattttctcaataaaattcactttttgtagtgtcaagttctgtgggttttgacaaacacataagatcatgtaaccaccaccatagttatgataccaaagagttacatttttcagctccggatttgcaaggatggtaccaatataaactcccccaattttatgagacggcactaattgttccacatctctaccaatatttgctactatccatctttttaattttagccattctggtgagtatgtaatagacctcataatgattttgattggaatttttctgatgtgtagtgagatggagctccttttcatctgcttactggtatttgtttttttgtgtgtagttttgttttgttttgtttttttgagatggagcctcactctgtcgcccaggctggagtgcagtggcgggatctcggctcactgcaatctccacctcctgggttcaagcgattcccttgcctcagcctccctagtagttgggactacaggtgcccaccatcacgcctggctcatttttttatttttagtagtgacggggtttcaccatgttggccaggctggtcttgaactcctgacctcaagtgatccacctgcctcggcctcccaaagtgctggggttacaggcgtgagccatcgtgcctggccttgcttactggcatttggatatcatctttgattgtattgttgttgggttcttttgcccatattgagttgtcttattgatttagaaatctttttacagcctgtatgccagtcttttgttagataaatgtattgtagatatctcctgctactctgtggcttgccttttcactctcttcatggtatcttttgataaacaaaagttcttgattttaatatagggcaattcataatgttttccccttatgattaatgcttcttatattccattaaagaaaatcatggcagatctcaaacttgtgaagatactcttctgttgtttttttctaaaacttctattcttttacttttttcaactagcacaattcatctaagattaatttatatatatatataaggtgtaggatagggagaatgattcatttattttgcccatatgaataaccaattgacctggcatcattcattgacaggaatatcctttccctaactgcattacattgacacctttgtcatgtttcagatgaccttatatgggtgagtctttttttaggctatttcattgtcctcattctctatcctttaccaattgcacactctcatgataacttaggtttataatcagtctttttatctggcaatgtcagtcttctgagtttgttcttcaagattatcctggcttttcttggctctttgcatttctacttaaattctagaactggcctgttaattgtcaccaaaggaattttttaaaaattccttactagagttttttcagattatattgaatctgcaagtcaatttggagaaaacttatttctttacagtattttgtcttccaatccatattttcctctatttatgcagtctttaatttttctcaggatgtttttttcttttcagtgtaaaggtcttgtatatgtatcttttgtaagattcttaggttttcgatgctatctatttttaaatggcatccttttaggtttctgtttctatttgttttttactggtatatagatttctaaataatgatctttttcacatattaactgcaataacatatcagataattattttggattttctatgcatataattataccatctgtgaataaaaataatttgcatttctgcttttccaattctcatacagtactttttttcttactacactagttagcacggtaagacatgtagaatacaagtaaattgaaatggttatagtgagcacctttgtcttattcccgatatcagttgaaaaaccatcaatattttatcaaaaaggataatgtttgctatagtctctttgtagatactctatcagataaaggaaatttctttccattaatagtttgctaagagtttttgttttgttcttaagagattttttaaaaatcatgaatagttgttgtatttcatcagataatgtttttgcatgtaaaattactatatgattttttcccttttttcttttaatgtgtgaattacagattgattatggaaagatatttcacctttgcattcttggaataatgccaacattgacatatctttttaatgtcttattggatttgatgtgatgttattttgttttctgtttgtttttttgagagagggtctcgtcttgtcacccaggctggagtgcagtggtgctctccaggctcactgcagcctccacctcctgggctcaagcagtcctcccacttcagcctcccaagtagctaggattacaggcacgtaccaccacgctaattttttaaattttttgaagagacgaggtctcactgtcttgcccagactgatcttgaactcctgggctcaagcaattcacccaccttgggctcccatagtgcggggattacaggtgtgagccaccatgccagccttgctttatgtattttaaagctatcttaactaagtgtatataaatttataattctcacgtcttcctgatgcattgaaccttttaccttatgaaatgtccttcttaatctctaatgatgcatcttgccttaatatctatgccagctttctattggttagtgtttacatgatatcttttttcattcctttattttcaacctttctgtgttcttatatgacttttgttgttttttaattaattctgacaatcttcatattttaatcagcctgtttatatttaatataagttactaatgtatttgtgttcatatcttacatcttactctttttgttctgtcttacatgtgtatcttcttttttctctcctttcctgctgtttttggattgatcaagtatttttttctttttcttctcatttagcttctcggtcttgccctgttgcccagactggagtgcagtggtgtgatctcagctcactgcagcctccaccttccagtttcaagtaattctcatgcctcagcctcctgagtagctgggattacaggcatgcgccatcatacccagctagtttttgtgtttttattagagacagttttgccatgttggccaggctggtcactaactcctgacttcaagtgatccgcccgcctcggcctcccaaagtgctgggattacaggagtgagccatcgtgcccagcctgaattctcagtttttgtttgtctgaaagtttccttttgcctttcaatgtgtatagttctctatgttgggagttatactttttgagttctttataaatggctttccattatcttttggattctcttatttttgttgagaagtcagctgttactcttattctgctcttttatatataatatttttattttctctagctgctttttagaatttgtcaaactttaactttatccttagttctggttttccttttatttatcctgctgggatttttagtgcttcttgaatctgtgattgatgactttcatcagatttggaaaattctcagccattatctctttagatactagaactgtttatacttgggaatctagttatacatatactaggtcttttcattgtatcccatatgccttttatgctctttgtgtgtgtgtgtgtgtgtgtgtgtgtgtgtgtgtgtgtgtgtgtgttttaccccttttcctccccgagcttcaggctgtatattttgcactgacctggcatttagttccctgattctctcttctgctttgtcccatctgcatttcaaaacatccagtgaggctgggtccagtggctcatgcctgtaatcccagcactttgggaggccaaggcaggcagatcacttgaggccaggagttcaagaccagcctggccaacatggtgaaaccctgactctaccaaaaatagaaaaattacctgggcatggtggcaggtgcctgtactcccagctacttgggagactgaggcaggagaattgcttgaacccaggaggcagaggttgcagtgagccaagatcgcaccactgcacacgagcctgggagacagagcaagtctctgtctcaaaaaaaaaaaaaatctagtggatgctttatttcaatagtcccttttttattttctaaagtatctgattatttcttattcatcctagttctgtagtataatcctctaccttgtcatctatttttttctaacatattaatcatagtagtaataaattctgtgtctgaaaactacaatatctcagtcatttgtaggtctggtttttaaagattttttttaatttccacataataattgcaaatatttatggggtacatagtgatgggtttggtgttttaagagagggtcttgctctgtcaccgaggccagaaggccagagtgcagtggcgtgatcacagctcactgcaacccgtatcttgcaggctcaagagattttcccaactcggcctcctgagtagctgggactacaggcacatgccaccacacctggctaattttttttatttttattagagatgaggtctcgctgtgttgcccaggctggtctcaaactcctgagcttaaacgatcctctcaccttggcctctcaaattgctgggattatgggcgtgagccacaacaccctgcccatcgtgatgttttgatacatataatgtatggtgatcagagcagagcaattagcatatccatcatctcaaacatttatcatttctttgtattgtgaacattcaatatcctccttctcactatttgaaactatgtaatatattattgttaactgtagttatcctacattgctgtagaacactagaatttattcctcctatctagctctaattttgtatacttttaaaaatctctccctattgcctcctccttcttacccttcccagcctctaatatcctctgttctactttttacttctgtgagatcaactttttttagcttccacgtacgagtgagaatacatagtgtttaactttgtgttcctggcttatttcatgtaacataatgtcttacagttccatccatgttatggtgaatgacaggatttcattcttctttatagataagtagtattcgatcatgtatatataccacactttctttatccatttatctgttgttggacatttgggttgatttcatgtcttggctatagtgaataatgctgtagtaaacatgggggtgcaaatgtctctttaacgtactaatttcctttcctttggagaaatacccaatagtgggattgctggatcatatggtagttctgtttgtttcttttctctgcatcctcaccagcatctgctttttttttctctttttaatgatagccattcttactggagtgagatgatacctcactggttttgatttgcattttcctgatgattagtgataatgagcttttttcccatttttttggccatttatatatcttcttttgagaaatgcctgttcaggtcatttgcccttttttaaaacagagtagagttttttgtttttatttgtttgtttgtttttttactgttgagatgtttaagttccttgtatattctggatattaattccctatctgattagatgagtaagttgtatgtatttttttctattccataggttatcttttcactctgttgattgtttcctttgctatacagaagcttttcagtttgacataatcccatttgtttatttttgcttttgttgcctgtgcttataaaaggttgtactcataaaacattttcccagaccaatgtcttgaagtgtttcccttatgtttccttctagtagttttattgttttgggtcttacatttaatccattttgagttgatttttacagagggtgagagctaggagtctagttccattcttatgcatatgactagatgcatatttagttttcccagcatcatttattgaagaaactgtgctttctccagtgactattcttggtgcttttgtcaaaaatcagttgactgtagatacgtggattaatttctgagttctctattctgttccattggtctttgtgtctgtttttatgccaataacatgctgttttggttactatagctttgtcatatattttgaagtctgatagtatgatacctccagctttgttcttcttgctcaggatgttttttaccatttagggtcttttctgattccacagaaattttagaatattttttctatttctgtgaagaatgtcattcgtattttgataagggttgtattgaattggcggatcactttgggtagtatataggtctgtttttttgtttttgttcggtttggtttctatttccttttggggcttgtttcttggtttgcctgataattttttatcaaatgttaaacattgtccataataaattatagagcttctgttagtgtagagtccaattagatctaggactaagccacctcaaggttgggttatagtttttgtaagacccagtctacctctcatttgcttccacttctataccatggccctcctggaatctcagctgaaatcctggtgtttttatgagatccctactcattaatgggttctgaactccaaattttatctgttttgtgtaccatacaactagcacaatcaccactctgccttatggatgccttatacttggtgtcttggcctcttgtcctgcttcctgacaagtgtggcaaataccttgagtagagtatttcctctcctgagtttcaggcctactttattgttttcccctcctcttcaggatcatgaccctcagttctgtctgtcttgacagtcccaaactcgaatttttgtcttaccacccactagagattgcaaaaagttatgttggcttctctgcctcttagtagtagtccattgcccagattctcagcctcttacccgacacaggaatttgcaaataccctagggagaaaacgactttttgaatgtcagtttagctctttaagatcctcttctctctgagaccttctcttgtcaaattttgactaccttgtcagctctctcatcccttctttatttaaaaaaaaaaattaagcttttctgcctttttatggtctgggaattggtttactacaagctatggcattagagcctaaccaataggtcccttattgaatacatttttttattattaaatagaaaaatacatagcccgagaaagttaagtgggcttatctgtgtattaaggaatactgtttttaggaatgtgacttaggaatactgttcttcataccgcactttgggaactgctggattaggtcactttcccaaggtctcagaattagaaacaaaagcagctagattagaacccagcctcggcctggtgcggtggctcatgcctgtaatcctagcactttgggaggccaaggcgggagggtcacctaaggtcgggaattcaagaccagcctgaccaacctggagaaaccctgtctctactaaaaatacaaaataagccaggtgtggtggtgcatgcctgtaatcccagctactcgggaggctgaggcaggagaatcgttagaacccgggaggcggaggttgcggtgagccgagatcacactattgcactctagcctggacaacaagagtgaaactccgtctcaaaaacaaaaaacaaaaaacaaaaaaagaacccggcttcttgaatcccagactagtccaatctgttccataccatgttaactcattggcttacatctgtggttttcaaccagaaacaactttcccccttcctttcagttatgacaactggctggtatggaagagttgggtcttccactggcattttgtgggtaaaagccagggatgctgctatatatactataatgcacaagacagccaatccacaataaagaattatctggcccaaattattaattgcctcaagattagaaaagccctgtcttacagtatccctcaaaatttatatatttaaaggatcactggctgattcctctttacacttaatcataaggtcaacaccaataggctttagtaggataaagcatctttatcctactaaactacatccagaggccctttgacccaagaaaatgtccatatatgatctagtccgtacttgcttaactgtgtttctcaaagcttttgccaaatatgctccaattctaagacttctctttagttagaatttgttagagctggaaaactttctggtgtagaattgtgcgtgcatatcttgtaaatgcattttgtatgcatgaatggatatctagatgatagtgacatttacctacacatttatagattttatttatatatatacacatatatacataatatatatgtattctaggcatatatatatatatacacacacattagtctaaatggttcttagaaaatttattcattttggtttataactctaatcaatttctataatcaaaagctcttgaaaatgtaatacaaatagatatttaattaaagaggtatattaccaaatgtttttcagaataattattgtttgtaccagtgagtatttctttcagaaattcaattagactctaaaattcatttttcagagcattacaacttggcggcaaaattttcttttggctgaaacactgcatgcaagcttttggctcagaaaaaaatctttggaagtatagctgaaaagtctgattcagataactgaatggctaaaattttccttgtttaaaaggaataaactggttacacgtgaaatattaaaaactgtatttaaatggatagttaactattgccttatttcttttaagtcttaaccaagctggcttatcctatttcaactgctctagaactcacatcatttttgattcattgattttttttttttttttagtatcccaatagaagccatcatttctaaggttccaccccaactttgctgagccttggcccagaaaatttgtttagcttttctctgctgttgttaagctattttaaattttaaatttttgtgtttttaaacctttctgtgtttttaaagcctttctggtttaataaacaattctaaaatctcaagaaaatatccaaattcttttgttaataatttggcacttagccatctattcaatttatttatcatggtaaattttgcttatacttaattatttcctctagtcctagaactccaccccttaccataataaaggggcagtttataaaacaggtgtttttgtaagtaatttacatggtttagtatgcaaaaagtacaataatagagctgtttagctgtcagtacttgtgaggaagtaagcagttttttcgttattaggatgaccatataacttattagaaaaactcagatgcttttgagagtgaaagagtggggtgctattaataatactaggacagttctgggcaaaccagcccatatggtcacactaatcattatagatatttaaacaaaaatatttggtaaaatgaatttgtgtattggttgaggtttttggctgtgtttatttctaacatttcttccagtgaaaagattcttgatcatgtgctaagtatatgccaggtaatatagaacttaaaaaaaacatgagaacctctaatctcaagcaggacaagttggagaggcaagatacttatagataatgcagtaatgtaacagcacaaataaattcaattcattatggttttattgagtgcctactgtatgtcaagaattgtggttataaagatgaacaaaacaaaaactccttttcttgaaatctagaagagacatacttaaataatatgatgtgaaaaatgatattattttcatgaactaatttttatagaacaaatggaacaagaagttggggaaagcttttcaaagcaagtgatgtatgaactaggccttgaggaatccttacaattttggcaagttgagattacaaaggtattcaaagttaatgaggtaataaaagcaaaaggcagagtccttcatatgatttgttacaagaaatggcagaagggagatatggggcaaccatctctgaaatggtaattgtgatgggatttaaatgctatgctgggcaatacattattaagtgcttaaagtatatatatatatagagaagacatcctttggactgagaaacattttgtgatcagtttaccgtaattccataaaagaaaggaatcacacttccatttgtttataaagccctgtttcagagggatcaacaaatactaaagatgaaaatcctttttttaattaaatgctaaagaataaaagctgcaataatccctctaaaaagtattagtgatgaacaatcccatggggttatagtgagacaaatgtgatagggttagaaaaattgtagagaaaaattatggtaaaagcactagggaaatgccttagaaaattaataaagattggcttggtttaaagacggtaaataaagactaatgcaaaaggctaatgaattcagtcatggagaaagtttatactatagtgtttgctaaaagaattaccactagatgggattttattaagcatttttttattcaaagaaaaagggtaactcattaataaaatgtgtagttgatactaaataaataaatcaactagtgtagttgatactaaattaggagatagtgtagttgatactaaataaataaatcaactagtgtagttgataataaattaggaagatactgtagctgatactaaattctagaaattctggtaatagactctagaaatagatgtttgaaataggtgtttaaaataatattttaaagaaaatcatattcaccccattttaaatccacatagaagcagcagttaacattaaaaacttgtgtccacttccaggagatagtcatggtttaagggtccagaaatcaatggtagaatcacctgaaatttagaacagtagaaatatgtcttcactaaagagtctaaattttttttttttttttttggaggagtcttgctctgtccccaggctggagtgcaatggcacgatctcagcccactgcaacctccacctcctgagttcaagcgattctcctgcctcagcctcttccaagtagctggaactacaggtgtgtgtcaccatgcctggctaattttttgtatttttagtagagatggggttttaccatgtttactaagctggtcttcaactcttgacctcaagtgatccacctgcctcagcctcccaaagtgctgggattacaggcatgagccactgcgcctggcccaagagtctaaatttataggatgtatatgattaaaagtgacttttgtgaacatttaaataaatatttgtgactgaattttctatggaacatttttccttcagtggcttgcattttaatgaaggaattattttaaaattaccttattccctcccaatgttgtttaaatatctagagggtatctagggcttaaggaagattggatgtggaacaatgagtggaggcctagagaacaagggtagtttcctgcaacagttatatggatccctagcaaggttcatatttctgtctatactgctggttaatctgaatattcccataaattgtggaacataatccatggccttggttttctgtttcttgtagtaagatttatcattttatttctaccataaattagagatcattacatgattactatgaaggatctacattgctatttgttatgatcaaataaacagtatttttgcagttgactattcagggatctgttaaagcatttagaccttaggccctcatagcatatatatataagctttttggagacttggctctcactactttgagaatttggcacacagggtaatcaaaaaaaaaagctttcttggctcttgcctgtaatcccagcattttgggaggctaaggcagaaggatcccttgagctcaggagttcaagaccagcctgagaaacatagcgagacctcatctctactaaaaaataaatagtaaaaaattatcccagcacagtgatgcgcacctgtagtcccagctaatcaggaggctgaggtgggaggatcacttgatccagggagtttgaggctgcagtgagctatgattgtgcacactccagcctgggtgacagagtgagaccctgtctaaagaaaaaaagctttctttcgaaatggcctcaggtttatcgatttttaatttaacattgctctacagatttattttgttgagtttttttttttttaagtactaagagtgttttgggcaggggaaagaaattcacagtgtttttttgttgttgtattttgttttgttttctgagacggagtctcgctctgtcacccaggctggagtgtgcagtggcacgatctcggctcactgcaacctccgccccctgggttaaagcaatcctcccacctcaacctccccagaagctaggattacaggtatacatcacctcacctggctaattttttttggtattgttagcagagatggggtttcaccgtgttggccaggctgatcccaaactcctgacctcaagtgatccacctgccttggcctaccaaagtgctcggattataggtgtgagccaccacacctggcctaccacaatgttttttaactgaacagttggctgcagtaagcttttagaagcctacacgttggtatttgagcatacgaggtggatcataatggggatcattaggtttctttgacaggtgatattaagaacccaacccagcatgccacttgtaaaccatctatacatagagacatttgtcaccattgacagttgtgacatttaatctgggatctatttgcaactcagcttcctatgtattactatgtatttaacagtctcaattcaggctcaaagcatcagcttttttcttctagtttttctaggttttacttaacaaaggaaaatagaaatatctgtttactattgaggtgatcatttctcctcagatgagtcatgccagtcacgattcttggatgttgacctcttgtgctgtttttgtagttcacaagccaaagctgcactaaataggattatggaaattagattaatggtccaggaatgaggcatagtgctttggttgaataggaaagtctgtaaagtggagccagtagtacctgaaaaaaacttaatccaggtgaggcagatgttctgaagaatctcactcgtctcacctggattaagtttttttcaggtcctgctggctccactttactgactgctattcaaccaaaccactatgcatcctttttggagcactaatctaactccaaaggggtacaacaacctcatcacttctaatatgaatacaaccaagatattgtgtgagctgagagtggcagaagaaaactggaaaaagctctctcttagatagccagtgtcacttggagaagtctattcttatgtaaaaggagttatattggtcttctaagaagaaaggttgtcaggaactggcaagcactaaaatgcctaaccaacaccttggagttagagcagtctagttttagaaggcagagactaggagggataatcagtcatagctaaagatagggaatctagaccaaagctcattccagttcctaggattagtgcagaatacaatttattaagctagaacagaagctttgcagtcacaattagatcatcacaacgtacatctggatgtcagaaataattctgcaccctactcttttttttttaagttaaagagactgtctcccaggctggagtagagtggagtgatcttagctcacttcatcctggaacacttgggctcaaacaatcctcctgcctcagcctcccatatagctgggactacaggcacacgccaccatgctggctaatttttttctattcttttagagacagggtcttgctgtgttgtccaggctgatttcaaattcctggcctcaagtgattctcctgctttggcctcctgagtcactgggattgcagggcaccctattcttgatttttattcttcccttgtcaggactagcttagaactgttaccccaactgtataagtaagtgcatccttaactatcaagacccaagaaagatatgagcagagcaaaatgaggagctcacgcaagcaaaattaagacttgaaatgtcagcagataaggtatctgaacatgtctatgacaggaagccagttgcaacttaactactgcagtgctaaattaaaccactgctatgtataccatatttgaagtaataattggatacaaaggtatatggcccttacttcaaagagcttatacttgtgaagtgtacactagaagacagtatgtagaaattttaccaaatttttatcaatttacagtatgaattttaccaaaaaattcactatagaaataatgcatgacttcacatcacactggtgatcagagaaacaatgtattttaaaagtgacatatgaactggtttgtgaaatacaaatgaaattttgatgcaaaatataactagaaatgaccttagatatcagctggtacatcttagaaattcgagaaaaattaagacccactactagtgggataaatgttggtgtacagtttttcttggtgacagcttgagaatacatatcaaaagccttaaaatatgcatatcctttgactcagtaactttacttacaaattaatcctatggaataatttaacatatgcacagatttacatgcaagaatgttcttcatagcattggtcttaaattttttaatttttttaacttctcattttgcagcaaaaaaaaagttgtaaaaatagtagatattttccatatatccttcatccagctttcccaaacattagcattttatataaccagagtacatatatcaaaaccaaggagttaataaataggtagaatttttgtcaaataaataaataaaattttaaaaccagcaaactactatagatgtgatactattattgaagctacagacctttttcagatgttcccaattatcccacttttttttttttttggtccaggatacaatctaggattctactctgtgcttaataggtaatcatattcttttattctgttactatctggcataattcttcagtctttttttctcctccttaacattaacacttttgaagagtactggccagttattttatagaatgtctctcaatttttgtttgactgatgtttccctgtgataaaattcagattatgcatttttggcaagaataccacagaaataatattatgctcttctcagtgaatcatattcaaagacgtgatactaattagcctcgatagtagtgatgttgactctgattcactttacttggttaaagtggtgcctgccagttctctccattgtaaagttagtattttttctttcttattgaataaatatctcatggggaggtacttcaagatacgtcttccatacatacatggattaatcttgcctgaaataattattactgtggtattagccaaagaattatattttatttttattattccttataaacttctcaattcaaaattatacacttattaatagagaagagctttcccctttttttgtttattaatttacttatgtcatatggactcatgaatattttattctattatttaaaatatattactatcactatttattgtgtttctcaaattgtcgtagatttgaccattggaagtgccctcaagttggttcttatgaacttccaatgtactacagttattttctgacttccttacattctgcgaccacaagatctccaggttcagcttgtgttttccttgccccagccatgaaataggaatttctccaagaagccctggtttcttttattgtacactaagaatttatacacacatctatatctgtgtctatatttaacctgtgtgcgtgtgtgtgtgtgtgtatgtgtgtgatatatatatgatttatttatttttttttttttgagaaggagtttcactcttgttgcccaggctggagtgcaatggcgcaacctcagctcactgcaacctctgcctgctgggtccaagcaattctcctgcctcagcctcccatgcccagctaattttttgttttgtttttttttttttagtagagatggggtttctccatgttggtcaggaatggtctcaaactcctgacctcaggtgatccacccgcctcagcctcctaaagtgctgggattacagacgtgagccactgtgcctggccctgtgtatatatttttaaaacatgagtacacagtagtatcacctattgcaatccaataccacagagttcaggactggcttagagctgttaccccagctctgtaagtgcagcctgaaccatcaagaccagggaaacatataagcagagcaaaatgaggagctcacacaaccacacatcctggttaattttaattaagttttttaaatatatagaaaattaccatggttctaaaagtcaagaactattcacaaagatagagtaaaagaagtgtcacttccctgacattactttttcgccattcttgttttagcgttcttcccaccctgttcccacctacctcttgtaggtaaccaatctcagttttttacttatcttttctgtatttcttctttttttttctaacagcttcactcagatataattcacacaccatacaatttccttatttaaagtatacaattctttttttttgtatattcataggttgtgcaaccgtgaccacgatcaattttagaacattttcatcatcccagaaactgtctctctccagcttcacccatcttctcccaaccttaagcaacgattaatctactttctgcctctatgcatttgccttttctggaaattgcatataaatggactcttacaatatgtggttttctgtgttaggcttctttcacttaacataatgttttcaaggttcatccacattatagcatgtgtcagttttttacttctttttattgccatgtaacattctattgcatggtttattcatttcctagggctgccataacaaattaccacaaagtgagtggcttaaaagaacaaaaatttattatttcacagttctgaaggctagaagtccaaaataaaaggtatcagcagggccttgtaccctctgaaaactctaggaaattgttccttgtctcttcctagctactgggctcctggaaatcaattcttggcattccttggcttgtagctatatcacttcagtatttgcctctgtcttcgcatggccttcttccctgtgtatatctttctgtgcccactccttttattttaaagacaccaataattggatataaggcctaatctaatctagtgtgacctcatcttaactaattaatctgcaaagactttatttccaaacaaggtcacattctaaggttccagatggacatgaattcaggggcaacactatttagctttctacatatagagatacaacattttatttacctattcttcagttaatggaatttcattcctgtatttatttatgcccagatgagcagatacatgagcattttcttatttctccttcctttttatttgaaaagtggcatactgttgatatgtttgttttttccttttttcagtttataatatattctggaagttttttcatatcacttcacagagctctagctcattctaatctaaatattcagccatagagaatttattaatatatacataagatggaaattgatttagtattttaatttttatgaacatggaatgatgtatacaatatattggggatgttttcttctataggttttttaatctgtgttttcaaggtattatattcacacagtatgaaattcctccttctagatgttacccatctaatcagccctttcccagagtgaaccaatgcttccactgaatgtcagctatacacattgttccacaccttgcctttttgcttaatatatcttagagattgttccatttttttatagctgtataatatttcattttcttgtcacatcatactttattttactaatcctcttttggtacacatcttggtatttctagtcttttgctacaacaaatataacagcactatttgcaatgaccaaaataattggaaacaaccccaaaggtccataaagagtaaactgaatatattatatatttatgtgatagcatacataatgaagagagaatgaatggattaccactcaactcaacaatatcaatgaatataacaaacataatgtggaacaaagtcagacccaaaagagtgtatacagaattccaaactaaatagggtaggaatagctcatgtcagaacagcccttcttcaggtagcaattataactcttaacaaaatattacaaaaccaactacctggagacactggagaagaatgaaaatcaggcagaaactgaaggagagtctatacttggaggaggagaatggccttgagtacatttcctatttttatgactctttctctagggccagcccaagttggcaccaagtagcatgcctaaaagttggtagaaaacacgcagtcttactggcttgaagatccagaggaagagtttaggtaaaaagtgagtgaggaaatttcagaaaggagaaaaaccatacagaggtagccctaaattctacatacagaccttatccaaatctctggatgacccctcaattacgcatatgcagagtggattcctagcagcccagctaaggctaaaagaacttaataaagatgtctcattgtccattgctggggtgcagagtttggaatttcattctagccaagtttacttgtctccttaaaaaaacaataataatcccctccttagaaacatttgagtagactgtacaacagaggtcagcatttttatttattttttttttttgagacgagtctcgccctgccttccaggctggagtgcagtggagtgcagtggcgcgatctcggctcactacaagctccgcctccccagttcacgccattctcccgcctcagcctcccaagtagctgggactacaggctcccgccaccatgcccagctaattttgtttttctatttttagtggagacggggtttcaccgtgttagccaggatggtctcgatctcctgacctcgggatccgcccggcctcccaaagtgctgggattacaggcgtgagccaccatgcccggctggcatttttttcttaaaggaccagagagtaaatattttaggttcacagggtactctttcagtaatttaaatatgacaaggagcaaacttgaatataggtatgtagaaattatcaagtgtggaaaatgaagagaaaaaaaacaatgaacatggccgggtgcagtggctcacacctgtaatcccagcacttttggaagccagggtgggtggatttcctgaagtcaggagttcgagaccagtctggccaacatggtgaaaccccgtctctactaaaaatacaaaaattagctgggtgcagtggcacacgcctatagtcccagctacttggtagggtgaggcaggagaatcactagaacctgggaggtagaggttgcaatgagccgagataatgccactgcactccagcccaagtggacagagcaagactccatctcagaaaaaaaacccacaaaaacagagaacagagcttccttgacctttaggacaacagcaaaaggcctaaaatgttcataattggagtctcaaaaggaaaggagctagagaatgaggcaagataaatatttgatgaataatggctgtaaggtttcccacttctggtgaaagacatgaacttacagatttgggaagccctgtgaaccacaggcagaataaatacaaagaaaaccacacctaaacatttaattagactactactgaaaccaaaagatgaagagaagatattgaagagcaaagtagcacattgcatagaatgggaaattatatgaacaactacagattccttacagtggagatcaaaagaaagtggaacatctttgaagtgctgaaacaaaactgtcaacccagaattctatctccagcaatattttccttcagtgatgaaggtgatattaaaacattgttatataaacataagagtatatactatgtgattccatttgtataaagtcaatggaaacaggcctcaagttacttttgatggggattagtaattgcaaggaggggagggaatttttcaccataatgaaccactccataaattagtaacataaaaaacagcagttttattttctcatgattctccagtcaaggctaggctcagccgagtagttctacttgtcttgacagtggtcacttgttggctacattaaggtagtacgttggctgcaggctagactcattagggatgttcagaactctctatttagtctaaaggccaacatttccagagtcagacttccaatttgtactcttctctgtatgtgtcatacctcaattaaaagcccactttcagactaggtgcagtggctcacacctgtaatcccaatactttgggtggccaaggtagaagaattgtatgaggccagggattggagaccaacctgggcaacacagcaagaccccatctctaccaaaaaaaaaaaaaaaaattagctgggcgcagtggcacatgcctgtagtcctagctactcagaaggctgaggcaaggaggttcgtggagcccaggagttcaaggcagcaacagtcagccgtgatcacaccattacactccagccttggcaacagagtgagaccctatctcaaaaaaaaaaagtctactttcaaagggcaatagataattatttttttaattacaatctaacaaaaatagaataatctaatataaatagaaactacaaaatgttccagaaaatgtaagtattcctgtgtgactagtgtagaattaatataagaaacattaataggtgataaagtaaaaaagataacttagggttagattacactgagatttgagtgcttggctacagagctgggtcttatttgaagggaagtgggaaactattgaagggttttgagcagaggaatgatatgttcaaaacagtggtttaggaatataatcccatgctagtgtacaaattagactagaggagggagagactattatcaaacggatcaatttggaaacaatttagataagcaccaataggaattgaattaaaataatagcaagctaatgaaaaaaagggaataaaatgtattaattctacatctacacagattgagagcctactatgttctatgtacttggtaaaggactgtatatatttttgtctttatagtcaaggaattcacaacatatgaaatgtagaagtatgaaaaaataacaatttgttgtaataagaactataatagatgaatatttaaggtgttaaggacacaagaagaggaagcagccaataatacagaggagtctaagacatgctttagataagatttaaccttacatgagtagttacagtttaccaaacaaagaaggcaaagaacaacattctagccagaagaaacagcacataaaaagtcacaggcaaagaagagtagagcatggtgaattgggggacatagttcactatatctacatgtgcaagctaagcataggtacagaagctagaaagataaggatcacatcactaagggcaaaagacatgaaaaatttggtgactatatgagatgaaacaagatttagtgactttataagaagacaaggatgaccttaatattttgaatttaagtgactagaaggataatgataaacccaatagtaagaattgtataacttatagacacttttcatctgagtggacattaaatacctaggagttctttttatatgtgtgtgaagaatagcactagatgtgtttcatcaatgaaattctgaatataaaataatcatcataggttcttaaagccagtcaacaaccaagaattgatactgaccactggcacagtttttttcaaaaatgacaaactttaaaagaaaaaaaaatgccttgaatgaatgtttttcttaactcagaagaaaagaaaaatctttaactacatatagcttacctgaagaaaaaacagaattgcagaattgctgtgaatgttctaaagacctggttctatataatcaagttaattcctctttcatgtgttttaaaatattgttgatccaagaaccaaccatcagctatgctggaagtctataattatgcattgatatatgagaaggctatcattctctacagacgactggtaccatccttagcagaatacttgaggctgcttttggtttagggaatctgtagctcagagattttcctagaaagtaacctctgttgttcaaattagatagccatttgtggagacaaaacccactgggtataggtagtattacctgaatcactaaaagataattgattagaaatccaaatcaaaccttgagactgctgagtctagatgagtggctgcctagggatagagggcaggaaggggtgggaccttacaaagacacatgaagaaacttttagaattgatatgtttgttgttttgattgtggtgatggcttcatgagtaatacctattcaaacttttccagttgtacacttaaatagtgcagtttattgtatgtcaatcatgcttcgataaagatgttagcaaaggaaatgactttcatcttagaatggtcagataaactgttttaagtgctacaccattatccatataaagaagagatggccatttaaaaatatttatacaagacttgaagcaatgtaggtaacctgaggtataataaattgagtgtcttgatatttagagtcctgatgtaatacactttattaagatatagatttgtaaatttatgctaattctggatgattatttttcttgagttggtttctatggactgaatgttaaagtgggttttaagcaggttttatataatatatcaataccacattagcttgattttttttattgcgagagatgcagaaagatcaatatcttacatgctctatatcaccataaatactttcaataaagcttttttggcctggtagggtgactcacacctgtaacctcaacactttgagaggctaaggctggagaatcacttgaggccaggagttcaagaccagcctgggaacatagtgagaccctgcaaaaaaaatatggaaattagccaggcatggtggcacacgcctgtagtcttggctacccaggaggctgaggcaggtgatcacatgagctgaggagctcgaggttacagtgagctatgatcataccacttgcaatgtagcctgggcaatagagtgaaaccatgtctcattcaatcaaacttatttgaaccttcgtacatttttgcttttattaatgagcttttcttttaaaatcagacttttaatggctttctggcagtgtcatcctggttgtggttgagactaatatgagctctagtttgtgttttttgttattgtttttgtttgtttttttgagacagggtctctctctgttgccaaggctggagtacagtggcacaattacagctcactgcaaccccttcttcctcccagactcaagtgatcctcccacctcagccttccgagtagctgggactataggtgcacaccaccacacctggccaatttttaaatttttttgtagagacagggtttcatcatattgcccaggctggtcttgaactactggactcaggtgatccacccacctcaacttcccaaagtgctgggattataagcatgaaccaccatgctcagctgagctctaattactgaagattaattctataggttgaacctggatatgttagaagacataggggactttcataaagaagttcaaattagaatatgtgagataggagaattttttaaaagaattgttatttgatacttagggtgtagtcatatactcttaatattgctagagtgtaaattggtaaaagttttcatatccttttatacagcaatttcagctcttggaatttaaataatcaaaagtctgggagcatctacatgtgaagacattcatgtcacttttatgtataatagtgtagcaacttgaaactatatatattatgttacatgaaaaataaactaacacagtgggttcattcactttgtgaaacttcatcacttatttgaggactttgagtataaacaaatcagaatataaaattacctgctattacgaagtagcaagagaggctgggcacagtggttcacacctgtaatcccaacactttgggaggccgaggggggcagatcacttgaggtcaggagttccagaccagcctggccaacacaataaaacccatctccactaaaattacaaaaattagccgggcgtggtggcatgtacctgtaatcccagctacatggcagactgaggcaggagaatcgcttgatcccaggaggcagaggttgcggtgagccgagatctcgctactgcactccagcctgggtgacagagcgagcaagagcaggcgagcaagcgagactccatctcaaaacaaaaaacaaaacaaaaacaaagtagcaagagtgagtatgccagtgtgctgggggtaagatgatttagatactctgtattttccatgtcttattttcatactttaaaaaacatatcagttgtttctaaaagaacatattccttttagttacaaacatatacattcagcaaccctaaagtagcatagactactactggctgaagctctggggttttattagtacagtgatgacttaattaacaaatcctctttgaacaaagcctcttcactcaagactggccttggtgcagtaggcatgagagaaggaccagttttctctgagctagatcggtagcagcagggactaatgaggcagggccttgaaagtggctctctctcagatctaactcctcagggactggctaaagctgaagctgagggtactggtgcactcctgggacctacacagcctggttacccaggtgttgaaaaaacagtttctgtgccaacaccatatgtggcttttaagagactcggcaggactcttgctttaggcagagcattccttgtgtggaatgagtaagctggaaaataacaaagagggaatcccatgtgctaggaagcttcctcttgtcttctgtgtgctccgtgtactgctttttcaattctctgggccttattttgttcaactataaagtaaaaggagtagctaaaaaatctctaatatatctttcagttctaatagactacatgtttaaatcaggaatcggcaaactttttataaagggtcaaatagtaattattttctgctttgcagggcatactacctccattgcaagtgctcaactctccctctgtagcgtgaaaacagctgtatataaacaaatgggtgtggctgtattccaataaaactctatttataaaaataggcagctagccagatttggcccacaggccatattttaacaagcccaggtctagatgttaatgtaatgggaatgtcatattaagagaattatttgatgaataggatataattcttatttcatagagaccattctctcagactttttatttttaaagcgtaggcaaatataaaatattatttcactgtcaggatgtaataccatgggaaaaagattaaaaatactctggcaccaaactgttgtagtaaattatctgaaatagagcctttgacttcccaattaaggaagaaaatggtgtctgcaacacctgtgactgggttattttaagtcttcaaaagttaggggcctagtagaagagagtctcaagggcttgttcattttctttctcatcaaatgggccaaatcatgcttttcatagtagaaggtaggctgtggaccctttactattttatttttaaatatttctcttggctaggcataatggcccatgcctaaaatcccaggctgaggcagaaggatcccttgagcccaggagtttgagaccaccctgggcaacatagcaagaccccgtctctactaaaaaaaataactttttaaaaattaaaaataaataaataattttttggtggtccagaaaggggcagctgccatgctttgcaggtttcagatccccatctatcttgggttgggtttctatcttggtcttaagttatcagtattctaatatggagataagtctgccttcactttggagacctttgttagttcttccatgtcaggcttcagctagtatagtttgtctaatgcatttatataaaacttgtttccaacaatgaaaaagcaattacaggttgggatatgtaattcaggcccattactacataaaaggatcagcacagtggtactttatctgactagggaagtctaaaatattcttgttggccagcttgctttcacataagcactgttcgggatcttttctaagttgcagaacatgaattccttattggcctatcccactagccacagctgtgagcacaacagaactgacacatacctggtaattataccttatctaaagtgaacagggccaccttcccagcatagtgacagctatagcccttaatctaatgcagtggttctcaaagtatagactcactgggggtgccctttctgaggctctttcaaggaatctcttctatgaaatcaaaactacttcacagtaattcaaatatattatttgcctttttgactctcaatgacagtagagttttccagagactacataatgtatgatatcacaacagattgaatactgaagcaaatgttaagaatccagctgacttctgttaaccagatattaaagagattagcaaaaacttaaatgtcatactctctactaatatttttgtttggaatatatagttattcttatgaaaatatgttaaaatgtaggtttattcagaaattttctgagatcattttattttctaatacagtaaatattaataaatatgactcacacaaaatctatttggagtcctcaatttttttttcttttttttcctggcttacattttttgatgcactcaatttttttttttttttttttaatttaaaaagagacagggtctcactatgttgcccaggctggtttcaaacttctgggctcaagcaatcctcctgccttggcttcccaaagtactggtattacaggtatgagccagtgcacctgacctcaataattttttaagagaaaaagtttgagaacccctcctctaatgtaatacccttagttgcaatactctgatctcatggttactgatatcatctttaccatattccctcttataaaatatttactaaaattatccccagagataacccttgttaacaatttagtgattacttctagacatctttctactgagtgcttgcattcacacataatatatatacttttacatttattggatcatactgtggtctttcaaaacttattctcctgagtttaatttttctacctgatcactctctgaattcttataaaatcttaagttcttttttttttttttttttttttttaagacagggtctcactcagtcactatcacccaggctggagtgcagtagcatgatcatagctcactgtagcctcaaactcctgggttcaaaggatcctcttacctcagcctcctaagtagctaggactacaggtgtgtgccaccatatctggctaactttttttatttttagtggagacaggcatctcactatgttgctcaggctggtctcaaattcctggcctcaagcaatccacccacctcagcctcctaaagtgctgggattacaggcatgactcaccatgcttagcctaaatcctaaggtcttaaaattgaaagggacagaggggtcatcttatctcattcccaactcaagtcagaaaccctctctaaaacattcacaacctgagaggtccatttaatttggttttataaaccctaaattgttagaaactttttccttctcttggacataaatttgccttcttgatcacttttacccataggttctagttctactttgggaaactatatagaatgcatcttatctgtcttcactgggcttcattgtgggtattttcttctgttctatcttccagttcactaattcttttttaagttgtgtctaagcttctattaaaactatccactaaatttttactttcaatttccatttaaacctgttgtattctagtcctctgttaaaattctcgattttatctttaactcttgctatttcaaagtttctgtttgttaagttcaatatctggaactgctttattaagctgtaatttctgctggttttaatttcctgcttgcctctttgtattactgtttattttttattgtgggtgatatgttgtatttgcaaaattgcttatagaaataatttgaagtataggatgattcatgtttgcttttggcaggcatggggacattggcacactatatttatcttcatctaagtttaaagatttagatgattagaggctaagctacaatcccttgtctaggtctttctactgcctgttcacacacccttaatccttttgattcccaccctgagataaggagattttaactaggcccattactcttgacagactgggttccagactttgtcctcctagcatcaaacaccagactcacttctctgggtttctatcatcctctgtattatagcctggtaattcttcattcttttgttaggacttcaatgccttcaaacagattttttaaaaatatgtccagatgttctaattcttgataagacagttggtctgaattacctaggctgccattagtacctgcaacctactttaatccgtattaatatttttctgtccttctggattgcttgggaaactgttaaagagcaggaataaccctgaccaggcatctgtaccacattcaaccagatgctctgtaagagctcctcttgaaggtttaatctgatattaatcagataggaagtacagttcttatgaacagattcagtcttcccacagggatgagttcagttaagaggggcaatggatacggtgtacagtggccccattttcctttatgtttatattctagtcttgtaataaaactaatgctcagaatgaaaggtctcaatttaggatttaaaccaagtataaacaaaaagttaaaacaagctattgttcaaactttgacttaagtgaaagaattggtttttttatttgtttgtttatttttgaggcagggtcttgctctgccacccaggctggagttcagggatgcaatcatagatcactgtaacctcgaactcctgggctggagcagtgctcccgcctcaggctcctgagtagctaggagaacaagtgacaccacacccagctaattttttaatttttttgtagagatggggctttgtatgttgcccaagctggtcttaccttctggcctcaagtgatcctcttgccttggcctcccaaaagtgctggaattgcagacatgagccaccatacccggcctggttttattttaaaaaacacttttgctgcccttctgtaaaatgttaattatatgtatgcacattttcttttatctggtgcttctctaaattcctttagcccacgtcttatccaactagtcatgtgggaatttcctctttggggaattaaatatttaatattaacttctaggtagtacagagcagcccactgtgtttcacttttgtattattcctttgttagcactaagttttctgtatcagcttgtctagaatttttgtttcaaaattgtattcttctaatttatttgcagtttttctcttctaattgtttaattgtccatcccctaccccctgccccaaggcaaatgtactgtcttttatccatatgtgcccataaattctaaactcaaagatttctggttctcccttatatttatggtatttttctacttctctgttcagtatatttttgcaagtgtttcagttttcttcagtgtttgaggttctctagtgtgtcatttcattttcatgcatcagagtaattcctaccattcttatatggagtctcttacctgatgattttttaattagtaaagtgcaatattgaacaacattgaagattttatttcttaatctaaaacataatatttatttaataatgaaatggaaatataggttttgtgaaagggagaaaggtgtttctctaaatattatacctgtgtcaaaaagctgcaagtgctactaccactgttttgtgacccctgaatgatttctgctttctttatattaatacttactctaatagtaattgaactcccaaaaagatcacaaagtccccaattgctagctttataaatacattgatgtgtaccttgtttgatgagataaaagcttcagtaagtgatatccccacctgtgtggttaatttcaaaatattgtttgtctaatacattgttgtcagtgacaactgaacaagaacttttagaagcagttggctgtccattaatggcagatttcaaggctatgcaaattgtgccagttcagccctgcattttttcgatattatcatatcaattgagtcagttcagagtagacaaagcaaggttatgggaaccacctagagcatcatgcaccatttaacatcaatgcagcatacatgaacatctgcaacttcgatcttattaacagaggatagaatggaaggcagtaaacagctttcttcatcacttaattgcaaaatagtatttcctaatgtttgcattgtttatcaacacgaacttcatcaataattgtataattatggttgcctagatcacagtgccctcatgcatcttgtcacttattatagagtggtctgagtttaatttgaatttgaacacatgatacaaggataataatacaagttccttgaaatgtgagttgcataatacaaaaattttgtgtagtaggagaatggcaagttatgattcttcagtcactttggggattaacacaaggaaaaacaggactgaaaggcagtgaaagatgaggggaagccactagttagattcaaacatagacccattggacatgagagtaggttatgttccttagaattaatcatgagtaattcgatgtttgctttaggcccaaattgagctgaattaaaacaggattattatgcttaggtcttcccttcagtctctgtagttaaagagagaaaatggcagaaaactacaaatatagtgaggaaaaagctatggtggccaaagttaaaaataccacatgctgaggaaagccttgacatagctgctcagccttcattgctgttgcttttgaagcctgataatgccacactactcctaattagcaaatgttagtattacagtaagcaatcaagtgcagtcttcaggctttgtggcagcagtttcgcagtgcaaaatattgaagaaaaaatgaaggaaaacaatataagctcagccacagttattggtgtggtcagtgggagttgtctcacaagagagcaggaaaaggaaaatgtgaaaaacagtgggtgcatttaaagcatgtaagacaagagctggctagtctgaaaagtttgtctattttaatcatgaaaatctcacatttttacttaaatccattttatatttaaggaaaaatctaaggcttgttcatgaaattacacttgaaatattttaatttgtggttagagtctcctccccatctcaaattaaaaggtattaaattgtatattgagtgagctccgtttgtactcagctcttcccaattaataaacatagtcatttccttaaaaaaaaaaaactctagagttagaatgttttctctcactaattagtctgtatttatgcctttaataattatctgttcattttctagcagcaaatgtttgttctcagattaaattggagaaggaaggaaaaaaaagatagctacccacagtatagtatccacagacgatatagagttatgtccctctttgtgtggttcttgagtataatagacataacagaagctttcttaatatgatagttaatctattattttctgtatttgggggatgctaagaactggtttactagaggtaatagtttgatctgtagttatttatgttaaaatacttttttaaaaggtaattacagcttctactataaacttgaaaaagttggtctaactctgtgccgaatgagcggggagatattactatatacatacatataagtgtatatgcctcttacctgaatacctcagggagcacacttttctgaaccagggttttgtaataaatgtgtgtactactaattctgacacatgtatagttctcctttaaataacttgtatgcaaacgttattcagaaacgtcttctaggagctatttatcaaaactgctataataataactttgtcctaatgagtttcagtctctgtttagggagtaatcgataaactacaaattaatgttccataattcacattataatgcacatataattattttgagatgaggcaaaccctatgcatttaatttacagctataattaagtaagctcatttgatactaattaagtaagtctaaaaggatcataggtttgtgtatttaattatcaaggtacaatcagcaactaattccttgaaaagctttcctatcttcagttcaacactgatctcagcccacactacaatttatcttcttgcatcttcaatagattaaaatgcattgtgaattgtggagaatctacttggtaagttagcttctttatttaaaaagtatatatatgtatatatatatacacatacataggcttaagaatacagaaattctataatctggcaaaactgtccttaagaagtgaaggagaaattaagacatttccagataaaagataaagaggtttattgccaatagacctgtcctacaagaaatgctaaaagggaatgcttcaggattaaatgaaagaatgctagacagtaactgaaagccatatgaagaaataaagaactcctgtaaaggtatctatataagtaaatataaaaaccagtattgctggtttgtaactcttctttcattcatgaaaggaaaatgcctaggccgggcgccgtggctcacacctgtaatcccagcactttgggaggccaaggcaggcagatcatgaggtcaggagatcaagaccatcctggccaaaatggtgaaaccccatctctactaaaaatacaaaaattcgctgggcgtggtggcacacgcctgtagtccctgctactcgggaggctgaggcaggagaatcgcttgaacctgggaggcggaggttgcagtgagccgagatcacaccaccgcacttcagcctggtgacaaagcgagactccatctcaaaaaaaaagaagaaaagtgcctaaaacaataattatatgttaatggaaagacatgtaaaatatgtaatttataacaacaacataaagagggaaacagagctgtataagagcaaggttttttatactgtccaggctaagttggtaacaattcaaactagattgttatgaatttaggattttaattgtaattgccatagtaaccactaagaaaataagaaataggtcagggcgcagtggctcacacctataatcccagtgctttgggaggccaaggcaggcggattacgacgtcaggagatcaagaccatcctggccaacatggtgaaaccctgtctctactaaaaatacaaaaattagctgggcgtggtggcacgcagcctgtagtcccagctacttgggaggctgaggcaggagaatcacttgaaccccggaggtaggggcaggagaatcacttgaacctgggaggcggagtttgcagtgagtcaagatcgcactactgcactccagcctggatgacagaccgagactccatctcaaaaaacaaaaaaagaaataaaataagaaataatgaagttttctctagttttgttaaagtagtatataaaaattagattattagaaaatacacttaattgctagcttagaagtcttttaaattctactgtcagccgggcacagtgtctcacccctgtatttccaacactttaggaggccaaggtgggaggatcacttgggcccaggagttcaagaccagcctctgtaacatagggagaccctgtctacaaaaaattaaaacaattagccaggtatgatggcaagcacctgtcatcctaggtactcaggaggctgaggtgggaggaccacttgagactgaaagattgaggctgcagtgagtcttgattgcaccactgtactccaacctgggcgacagagtgagactctatatcaaaaaaaaaaaaacaaattctgtcagtcaatcaactaatattcaagtatttaatatagtaggcttcctgctaagtttcaacaattgtctccatttcttcccactaaattttttaatgtatagtcaagaaggaagagctatctgatgtctagagtgacattctagtgttgggaaatgctagataagatgttcacattttcagatttcccagccacatttaagctcaaaaaatatgaatacttgtccccatgactttcctgaaggtctaaaagatatttctgtctccatcccttcaaaaccaagatacctgattgtgaggagtagaagacccctatatggtccagtgtatgttctcttcaatctcaaagcgtgtttagagtattgccattgctatcagaaatgtgaactttcccctcagatcctagattttcagattaagctaatcttagaacatgggctttcctccttccttatcagaggccactgtggtaaaatattatagaaagtaattgttggccagtcgcagtggcttatgcctgtagtcccaacactctgggaggctgaggcgggcagatcatttgaggtctggagtttgagaccaccctggccaacatggtgaaaccctgtctctactaaaaatacaaaaattagccgggtgtcatggccggcgtttgtggtcccagctactcgggaagctgaggcaggagaatcacttgaacccaggaggtggaggctgccaagatctcgccactgcactccagcttgcgtgacagagtgagactctgtctcaaaaaaagtaataataataattgctaatacctaatgttgcgctttacagctcacatagaacatttacttatattatctaaaatgaggtattaaaatagatgaacaaactgatatctgggctgggagggagttgttgcttcttttatttctttggggtactactagcacagcctgtcagtacattaaaaatagagactttttggcattactttgttttttccaagattaactagcacaacacaaatttcttgtgcctaggtgtaaccagtgttgagacttcacataccacacacaattaatgacatcaaccttgcagtactgacagcgatatcatgcccagtttgtatatggtgtctgggtcatctgaggaagttaaaatagtattgtgatctgtgaacaggccaagtctagcaggtgccatttgcatagactagaatataaatagtatcctctaaagctatatgatgtaatgtccctaaaatgaattatctcccatcttctttcattctcagaaacaaaaatactgattcttgtattgtttgatggaaaactattagttgttcaacataaccagcaaagtataaagacttgacacctaatggcttctgttttctctgagagttagaattagtatgtagcttaagaagagctgtaggcatttagaatgatatttggggtggtggtggggaaatggaggcatcagctagggatagtttagaaccagttctaaattgagtggaattgccaaaattcggtatggtattggataacaaatatggcctattttgacacagggtcttaattttttttttaataggcttgtgccattcttcttaatctaataggcattggcaatccctaattacggagaactggtttgtctagtgacatcccaaacataggaagaatgtttccttctttaaaattttttgatagacacttgagtcaaatgaagaaatcccagatgaaaaattttagaaaggacattctactctcctgtagaatgggaaaattgtcccattcagctagttgtaagccaaaggagaaaacttaaggggttgtattatgcagctacatttttgaactgataacagttacccttccctgtcctttcctgcctaaacagatcctgatgctgcaaaccaacatttctttctttttttttatcactgttgatgaaggttatttaaaacagaatcagtgatatgttagcaaatattttatgactggctttcaggaaaaaagaacatagattcatagcaattgtgtcatggtttaaatactcccaccatcaatgtgaggtcactgaatgtagatttgagaagagctttgtatatgcagaattaattctcattagccaatctgagcaggctccagcacaccactgacagttaaaagaggtggatgactgatgtgagtaaccacatgaatgaatgtcaaaaacattatgctaaaaaaaatgtgctgaggtaagaagccagatataaaagaacatatactgtatgattacatttatttgaatttagaacaggcactattaatttacagtgatagaaatcagatcagtagctttttggtttttgttttattgagaaggaatttggctatgaagggatatgaaggaactttctttctttctttttttttttttttgagacagagtatagatcttgtcactatgctagtagcgccatcttggctcaactgcaacctctgcctcctcagttcaagcaattctcctgcctcagcctcccgagtacctgggattacaggtgcccaccaccacgcccaactaatatttttgtatttttagtggagacagggttccaccatgttggccaggctggtctcgaactcttgacctcaggtgatccacccaccttggcctcccaaagtgctgagataacaggtatgagccagcacacctggccaagaactttcttagatgaaaatattcatagcagcattacccaatagaactttctacagaactatcaacataacaattgtattttcaatctctgcttaggaaaaataaccaaacagcaatttaaagatagcctgtaggccaggtgtggtggctcatacctgtaatcccagcattttgggaggccaaggtgggcagatcacttgaggtctggagttcaagaccagcctggccaacatggtgaaactccgtctctgctcaaaatcaaaaattagccggctgtagtggtgggcgcctataatccaagctacttgggaggctgaggcaggagaatcacttgaacctgggaggcagaggttgcagtgaactgagatcgcaccactgcactccagcctgggcgatacggcgagacttagtatcaaaaagaaaaaaaaaaagcctaatagtaagatggaacccagtatgctagtatatatttaacagtcagctcatagcaaaccaagccctagtttgttgtgttttctaatttctatggtgtaaatactctcaccatgactcaccattcaaactaccaagatgaaggcattgaatggtgagttggaaagagaaatgtacgatcaattcataagctggtgtgaactcagtttctgaactgcttctacccgtcactattattgacggactgaattttcttggttttagtttagttctttagattattcaatctttcccagagctgtgtctttgcccagagactttattgaacctcagagatgtctggctaggctgtagctcaactttagatcctttaacagaaggaagaacacgagggctgagtgcggtggctcaggcctgtaatcctagcactttgggaggctgaggtgggcagatcacttgaggtcaggagttcaagaccagcctggccaacatgatgaaaccctatatctactaaaaatacaaaaactagttgggcttggtggtgggcacttttaatcccagctacacgggagggtaaggcaggagaattgcttgaacccaggaggcagaggttgcagtgagccgagatcatgccattgctgtccagcctgggtgacagagcaagactccatctcaaaaataataataataaggaataacatgcgtatgatccttaaaatatttctgcaactttttttttcccctggtgctgcagcttctattcgtaaagaatggtgaggaacacaaccaagctttaaaatcagtgtacttgagaggttttgttgttgttgtttttacaggtaattaaccatatgttacacattttaatctgcttttaagtgcaagagagattggcaaatgacttaataaagaaatgacttctgcttaaattggataaaatggttgtttactggtgtttattgctgtattccaagtagacaagtaatctgtgaatccagtttagtttattggacaataaatggtactcagaacttttatcagtgtttgattgtcaggatgcccattgaaattgacttcatacttagggaactttaattttattgtacagtatgcactgttaaaaaaaatatccttgtctttcagtataaacctatgacattgccttgtggcattatcatccctgagatgctttcttgctctaagatttcttctatgtcataaagaaaaaaggaacttttggttccttcatatctaatgcagttttttcttttgtaaactctaaatattttccattgccaccatcaacaattcaaataacaatcttactgatggaaagtccatgattagaaatagctgcttcttcaaaaataaagaactttgtatgtacctatccattttgaaaatcttaaccattgtgctcagaaggagagatatgattttaagaagggtcacatttagaataccaataatgtcctactcctgaaataattgggaccaggccgctaaaaagaaagcacctgatgtttggcctttcagtattttctataactatgacgccttggtccaaattatctaataaatgcttcttcctattctcccgccctaagagtccatggtctctttataaagaagaatcatatacatacagatattacttgaatttatatggcatcctcatgaggtgaatcccacctatgtcacttaggattcatttgattgccctggtttgatccaattcaagtattaattcaggccaggtgcaatggcacatgcctataatcccagcactttgggaggccgaggtgggcagatcacttcagttcaggagttcgaggctagcctggccaacatggggaaacccccgtctctactaaagatacaaaaattagccgggtgtggtggcaggcacctgtagttccagcaacttgggaggctgaggcaggaggattgcttgaacccgggaggcagaggttgcagtgagtaagccaagattgtgccactgcactccagcctgggtgacaagagtgagaccctgtctcaatagaaaaaaaaaaaaaaggccaatatgggcccagggcctgccattcagacttccgcttgtggcagagaccaagggatggcagcaggttagtcgcaggtgaagtcataacaagcggtgtggagccgcacctgggcaacatgtcggaaggaaatgcagtgagcgaacccagcactctgcaagggccccgacccctcctgactggggcccaggagctcagcaggcagcgactggcaccccttcaccccgggccgccttcccttcatccgctctgggaaccttaccctgggggttgaggttgggggtcaagaagaaaaccttcaccccaaatatcatcagtcagaagaacccaaggaagaagtaaccgtcaagaaggagaaacatgaaagggacagagatggacagagacaggtgcatggacagggatgaggccacccagaagtgatccagtctcactccatctttgagaagggcccagctgaaatgatgaagaaaaaaggaactggaataagaaagtgaatgtgtcagacatgggaccttctcatatcgtccacatcaaaaaagagaagaaagagttggacgaagacacgaaacatctcaccatgctgtagaaggacgatttcattgatgaccctgggctgaggaatgacactcgcaacatgcctgtgcagctgccactggctcactcagggtggctttttaaggaagaaaacaatgaaccagatgttaaaccttggctggctggccccaagaaagaggtgggggtacctactgtgaaactgaaagaggagctacaagatgaggaggaggccaagataaaggctccttccagagcagccaggaagacccccgggcctcccgaaggacatatccgtggcagagctgcccagggagctgagcctcaccaaggaggaggaattgctgttcctccagttgccagacaccctccctggccacccacctatccaggacatcaagcccatcaaggcagaggtacagggcaaggacagagaggtggtactcatcaagcaggagaacgaccaggaagccaggctggcaaagaatgcttctaccctagctgacctgacagagggtcaggttggcaagctgcccatctgcaagtccgaaagggtgcaactcctcctgggcaaggtgactctggacgtgaccatgggaaccgcctgctctttcctgcaggagctggtgtctgtgggccttggagagagtaggactggggagatgatagacctgggacatgtgaagcacaaacttctgtgttcccccgattttgaatccctcttggatcacaaacactggtaaaatgatcagatggaggaggatggcggctgctgtctgctccagacattttgttctcgaatctctgcaacccaggagaggccagttgagcccacccactccagcctttggcagccattgtcccagtttcccccagggcccacagggcttcctcccacagcagctgtgaatggcacagttaccttcccacagtgtgaagatggtacatccttgctgctggggacttgtccatgctatttgtttttgtatttatattttgtattttgtcttaatctcttcaactgactgcatcctcccaagggaggagggaggatctgtgggaaggtgcaggcttttggtggctgttgggccgtcaggcagcaagtgtgaggactgcagcttttgctggtgctcccttcttcctcccagaggcagtataggagagagagcaaggattgagtctgagacttaagcatggggtcccaactcatcagttcctggttctgtatccttgcgcaaactacctaacctttctgagcctcctgttcctcatctgacaaaaatggggatgatacctacttcacagggttgacgtgaggattacatgggatattatagatgaaaactccttgcacaaggccagaaccagtagccactcaataaatgttaatttccttttaagtaaataaataaataatcaaatgttaattcaaagtcccacatgagagcgttctgtgttttgtggtgtttgttttgttttgttttagagacagggtctcattctttcacctaggctggggtgcggtggcacaatcacagctcactgcatcctcgaattcctggactcaaaggatcctcctgcctcagcctcctgagtagctggaactatagacatgtgctaccatacctagctagtttttttttttttttaatctgtagactgcctctgtggacagtttttcaaattttttgtagaaacagggccatgctttgttgcccagactggtcttgagctcctggcctcgagtgttcctcccaccttggctgagacgacaggtgtgagccactgcacgtggtcagccttctatctttaaacaggatctgaatctagattcatcaactcataaatatgttctcatttttaaatgatggaatgatggaaagtgaaagcaccaatcaaatcatattttcattatttccagaatgtgttcagcacagttaggtctggaaaggtttttgggaaaggttgtgcaaggttgaatttattcactgttgaaatagcacctctaaatttcaagcaattgtatgatttacttttatacaagtgtcagaaatgctaaattattaaatcccaatggcaggatcactgacaactagaaacttgagtttatttgcttccgtggtttactaaactaagctagagaaatatagtacagttatttactacttaagatcagccagaaaatgtatagtgagttcatactgtactagattctgggagataatcaaatgtaaaacatataccagtctcaaggaagttaaaatctagtaggaataatcactatattcagcaataattgttaattgagcacctactctgtactagatacagtactaagagctgggaataagattaagtcataattcctacctataaggagttcaaagtttagttgagaagacatttgtaaagaagtaattgtaactatgatagataccttcctggaagtatgtgaaggttataagtgatggcataaaagagaataatcagttctgcttggaggccaaggactatagccaagaagacatgccttatttggaactaagagtgaaagacaatttgaaatgtagacttgatacatacacaagaataaaagatcatggcacatttgggacatcatgagtatgaccaaagagtaactgactaaagttactcttttggtcagggaaagataaagtttgaacaataggctggattcatatcctagagttaagagttcattcaatagagaaccattgaagagtttttaacaggggaataacatcagatttgtattcatgaaaaagtactctgtttattcatcatatatttattgagcccctataatataccaggcatagttctggatgctagcaatcatcagaaaaaaatattgccttttctatagctcctcttacctaggcagccaagttttgtgccctgagccctagctcctttcctgtgctcagctgagtgaatcagggttaggaacataaccaaaggtagacagtccatagatggtcagtgagctatgagctaaaacagcagaggaaatcagttttttgtctgtctgtttttgatgtaggatctccctctgtcacccaggctggagtgcagtggtgctatcatggctcactacagccccaacctcctgggctcaagcaatccacccaccttagttagcctcccaagtaactgggactacaggcacgcacccccatgcccggctggcttttaattttttttgtagagacagcttgttgtgcaggctggtctcaaactcctgggctcaagcgattctcctgtctcagcctcccaaggctctgggattacaggcataaatcaccatgcctggctggaaaccagttcttcagataagagagtgcagcatgtaacatttaaagaagtagagaccaggttgacatgaacagctttatagtaagattaaagtgatatgcttcatttagtgaacctattaaagataacagaaacctcgttaattcattatacacacacacacacacacatatatacacgtgcatatatatatgtgtatatatatagtcaggtgcagtggcccacacttgtaatcccagtacttcgggaagccaaggtgggaggatcacttgagcctagaagtttgaaaccagcctaggcaacatagggaggcccatctctataaaaaaaataaaaataaattagctgggcatggtggcgcatgcctgtggtcccagctacttggaaggctgaggcaggaagatcacttcagcccagagctcaaggctgcagtgagctgtgatggcaccactgcaccccagcctgggtgacagagagagatcctgtctctaaaaaatttcttaaatgcagtcacacacactaaacaaaggggaaataaggttttagagcagtaattccatctatcattgttttcttggtcatttttccatggaaaactatttttgtattcaaagtcaacactcattctcttatatgtttacattcagaactgaagaccttaactggaattaacttaaaacatttgtagaaaatcagatgcaaacatgaacaaactaagagattttaccacaaacaatgatgtagaggcaggtagtctgcaaggtcagaaccatgccttcagaagcagcaattttaagtgagacctgaatctcctatactcaaaggtcttgcattagtcaggattctctagagggatagaactaataggatagatatgtatctatataaatgggagtttattaagtagtattaactcacacaatcacaaggtcccacaatagaccacctacaagctaggagcaaggaagacagtccgagtctcaaagctgaagaaagtctgacgttccagggcaggaagcatccagcgcaggagaaagttgtaggctgggagggtaagccagtctggccttctcatgtttttctgcctgctttatattctctggcagctgattagatggtgcccaccaagattaagggtgggtctgccttccccagcccactgactttggcaacaccctcacagacacacccaggatcaatactttgcatccttcaatccaatcaagttgaccctcagtattaaccatcacaagtttcatttcaagattaataatatccttgtccatttaatcataaaaaggaatgcttattatgtgccaacttttccaagtgctttatatgtattaactaatttactcctcagaaaaatcctgtaagtacctgcaaatgctattattgttccttttttctttctttctgagacaacatctggctctatcacccaggctggagtgcagcagcactatctcggctcactgcaatttccgcctcctggactcaaaccatcctcccacctcagcctcccgaatagctggggctacaggaatgcaccaccacacctggctagtttttttgtatttttttgtagagatggagtttcgccatgctacccaggctggtctcgaacttattagctgaaacaatctgcccatctcagcctcccaaaatgctggggttacagacacgagccaccgtgtctagcctcctattttaaatatgagaaaattggcctggcacagtggctcatgcctgtaatcccaacactttgggaggccaagttgggaggattacttgagcctaggagtttgagaccagcctgggcaacatgacgaaaactcttctctacaaagaatcagctgggcatggtggcatgcgcctgtaatcccagctacctgggagtctgagataggaggatcacttgagccagggaagttgaggttgcagtgagccgagattgcaccactgcactccagccagggtgacaaagtgagaccctgtctcaaaaaaaaaaaaaaaaaaaagaggccaggcgcagtggctcatgcctgtaatcccagcactttgggaggccaaggcaggtggatcatgaggtcaggggttcgagaccagcctggccaatatggtgaaaccccatccctactaaaaatacaaaaattagctgggcgtggtggcacgcacctgctgtcccagctactcaggaggctgaggcagaagaatcgcttgaactcaggaggcggaggttgcagtgagctgagattgtgtaactgcactccagcctgggtgacagagcaagactctgtctcaaagaaaaaaaaaaggaaaaaggagaatttaatctgattaccagattgtaaatggcaaatctggaatgtgaacccaagcagtctgacttatgcacttaaccacagttatactccctctactctctatggagaatttatcaacttaatttagtcaaatttggttatcagtaccaggcttaagggaatttaaatgtcagttaactgctgtgtaacaatgaatcaaaatctatttattccatcatcacctttttttcaggaaaatagtagcaacattacttgaatgacaactttgggatcatattttactacttctctttcattcatttgtcccaaattcctgcctttgccatgggactctaggcagttgacaaactctgtgagcctcagagtcatcatttataaaataaggttagtgataccttactcatgtgagaattagatgagataaagtatacaaagcatttgatgcagtgctttttcactcagataactaccgttgcattccattgcctgatgtatcaaatccaaacttttgcgtggctttcaaagtctccctagaaatggctagatcccacccatcttgatttatttcttgccttacttgatatataaactttcttctgtctctattcctcttgggacatacacacctttcttttcctctctttttcattatccacatgtttaagacctagtttaagttcagtcttctccgtgaaagcatctccagttaaactatattgttctttcccttttttgaactcctgttgcagttataatagatgttacattgtgtgatatttcacaaattctttgatatatgctaggtttctctttccatctagattctaagctccttgagaagatagatcatgtcttaatatttttcctgtatctcccccagaggatctaacagagtatcataactattgttctatgagatctaatgagctcacagctattgttcaacaaatacttattacctgattgaagaaaataagctcctaaaaatacctgataatattatataggtctttatattgtcagggtgtttttataacactgttaatacttaatccatataatagtcacagaaaataggtagaacagatattatcttcattttttaggtaataacactgagtttaaattacattgtggcttgcccaaggattcttggtaagtagcgttattgaccccaccctcaacccctgccattccagtccattgtccgttctctatcaggctgccaaaataattttcttttgagacagggtgttgctctgtcatgcaggctggagagcagtggcacaatcatagctcactgcatcctcaaccacctgggctcaagcgatcctcccacctcagcctactgagtagctgggaatatagatgtgcaccaccacatccagctaatttttccattttgggtagagatgaagttttgccatgtctcccagtctggtctcaaactcctgggctcaaccagtcctcccgcctcagcctcccaaagtgctgggattatagacatgagccactgtgcccagcaatattttcatatcaaagatgagattgcatcactcccttatttaaaactttccaacagtttcccattttacatagaatgaaatcctgcaaaacccccacattcagtatactccaggtacagtggccttctttagcttcagcagtcttagtttgccaagcttgttgctagtctggggcctctgcacttgaatgttctacccctggaacttcacatggcttgttccttcttacccttgaaatctcaactcaaatatcacctcctcagtgaggaagtaatacctatgtaaattaactcccctcccttgtcacacttcatcatatcatcctgttttattttctgtatggcacctattaatatctcaaattaggccgggcatggtagcgcatgcctgtaatcccagcactttgggaggccaaggtgggtggatcatggatcacttgagctcacgatttcaaggcaagcctggccgacatgatgaaaccctatctctactaaaagtacaaaaagttagctgggcatagtggtgcacgcctgtaatcccagctaagagtagctgaggcacaagaatagcctgaacccaggaggtggaggttgaagtgagccaagaccacaccactgtaccccagcctatgcaacagagcaagatgctatctcaaaaaaaaaaaataatatatatatatatatatatgtatctcaaattagcttgtttatatatttgttacttgtgtattgtctatccccactagaatgttggcctcataaaagcagagtttttatcctattcacatctgtattcccagtccctaataaagtacctgacacatggtagagtcttaataaatatttattaaataaaatagctaagcccgaactagactaaaactatggcttttttgctcctaatcaagtgtacttcccatgaacatttaatttttcctactttttgtggaagcacttatacctttggaactacagtaagaattgatgttcagaataatgacattaagatgtgctgtaggattctctattatcaaagaaaaattttattcagttcaataaactaaactaattaaagcagggatgtcatggcatattattatattaacacatttagaaagatttccaaataaaaagactttctgctttttctttagttaactagaaaattaaattaactcagagctctttatgcctcaaaagtccttgttaattaggattgttctataaatctctattattagcagagttcatcatcttttttattgccctgtttattagggcagtctaagcagggtgtctttgctcatatcctgatatgtgtgtcctagtgaaaagaaaagcatttccggattctcattttttccctattccttgatataggcatatttcatgctgttagtataacaatttagtttccttctatcagttctctccataaagctggaatgatattattgacctatgaagcaaaataattaaatttaaggtctgtttaaaagcattaatgctttgtgacgttgtttatgataatagaagattgaaaatagcctaaaagtccatcagtaaaggattggttaaataaattatactatatccatgtagtggactattatgcagcaataaaaaataatgaggacattctctgtttaccaatatagaaagatatccaagattttaaaatatgatccagagtagcctagatagtatgatacctttttttgtgtgggtgaggggaggaaaaaattaagaatgtagtttattgtatatgcatagaaaaattctagaaggatatataagaaagcaataacagtgataaccagattgggaagtagaaggagcagaaaccagctgaagggcagagatgaggagagggagattttatagcatagcttttcatatgttttatatttttgaatcatacgaatacattacctactcaaaaagttaaattaaaaacaagcacaactaaaagtaatatgtggccaggcatggtgcctcacgcctgtaatcccagcactttgggaggccaaggtggatggatcacttgaggtcaggagttcaagaccagtctggccaacatgatgaaactccgtctctactaaaaatacaaaaattagccgggcatggtggtacacacctgtagtcccagctactcaggaggctgaggaaggatatcgcttgaacctgggaggtgaaggttgcagtgagccaggatcgcaccactgcactccagcctgggcgacgcagcgaaactccatctcaaagaaaaaaaagtaatatgtgattctggactgaattctataccagatgaaaaatattgctataaaatacattaggacaattaagaaaattgaactgtggactatagattagattaaaatgttgttttctgtgtttatcaactataacctggctaacagaatatcatcactcttaggaaatacacactgaagtattaaggggtaaaaggcataatatataccacaaatgctaaataaaactttgaaagaataaataatgttatatatatgggaggaatgatcaactaaatgtggcaaaatgttaaaaaatggtaaatctggataaatgttgcatagaaattgtctgtatttttctgggaacttttctgttaatttaaaattatttctaaatagttttttaaaagaaacaaacaaaaacattttaatactatggatattaccttattataagcaatggcataagaatgtgaagggttctggtttttacgtagtcatacttttcactttctggagaagtttttaccatcacttttctgtttcttccatgcctattgatgctgggtcagaggcagtggcaggggtagtgactgaattttaccttgaggttgaaaaacaccaggccaagtgtggtgactcatgcctggtgtttaggaggctgaggcaggaggatcacttgaagccaagggctcaagaccagtctggagaacacagcaagaccctgtctctacaaaaaaaatttaaaaattagccaggcatgttggcttgcacctgtagtcctagctgctcaggaggctgaggcaggaggatccttttagcccaggagtttgaggctacagtgaaccatgatcacaccactgcactccagcctgggaggcagagtgagaccttagctcttgagagagagagagagagagagagagagagagagagagagagagagacagacagacagaaggaaaatgaagaaaggaaggaaaaggaagagagagagaaaagaaagaaagaaaaacacctgcctacctgcctttcaacctgctggatcaccttcacttgtatcttctcaacagtttaggacatcaacaaaacagtaacaatgtggcattttaaaaattctttgaacaaaattttctaaggatatcgtgaggttgtgtgtatctagtgctaaaatatatagttaatttagtggaggtaaacctgcagaaacatttaattgtttggcattgagtaactggatttgtattattgttcaattagatattgtggcaattgtagaaacttaaccatctctaatataattgactttcattattgatgcatgaagatgtttttattctaattagattggcctcttaagtgattaggtagtgaagcttgtctcatatttaagtgaagagtaaattatttgtatgaagtgtctagaggatgcctaaaattgattattttgtattctaggtaagctaaattttattgttttgaatgaaggcactctgcaagtcttatctaataaatgacacaaaacaaatctgttatcaactgaattgttagtgtttgtttcctgtctgcttggggaagcttatgatttagtggttttttagaaatccagaaagtaggaataataattattcccaacccttttccttctcactttacaaaaagtttgtgaagaattgagaaataaatgctacgaataatcttaagctcttaggtagaagtacttgatcaaaactaaccaggtcatttttctacaattagtgcagaaagctagtttttactaattgttcccacagctactccaggcccatttcatgcctaagaaaactaggtcccagtgagagtcatgtgagtgttgtaggcttcattggttgaataacgtccttacctgtaagtgtatattcagatttagtgaatgtacttcatgtgttcatataataaatttcctagaatagctatggagtaggtcatgccggtaaaaactgttagttttgtgacttttttttttttttttttttgagactgagtctcactgttgcccaggctgaagtgcagtgacatgatctctgctcactgcaacctccgcctcccagattcaagtgattctcgtgcctcagcctcccaggtagctaggattacaggcacatgccaccatgcccaactaattcttgtatttttaatagagacagggttttaccatgttggcgagtctggtctcaaactcctgacctcaagtgatccacccgcctcagcctcccaaagtgctgggattacaggcatgagccactgtgcccggccatgactttttataatagatctgtaaaccagcttaagtcatttgaaaatcagagcatactgaaaatgtaataaaacataaatattattgaagatttttcagagtcatcattttgaaaggagttcttgtagttctttagataatagaaaataatgaaaactgagtttatgacgcatcttttgcatatatgatattcttatatacttatctgtactgataagtataaaaaggtagaaaataattctactttgtatttcaggaaattgagcttcatatgaaaactaaggataaagtatctcaatgatgtgtgtgtgtgtatatatatatatatatctccagaaaaaatcattataaagctgcatttatgtagaattttcagcaatttagataaataagtcatgatttttttttttttttcctccgagagggagtctcactctgtcgcccaggctggagtgtagtggtgcgatcttggctcgctgcaacctccacttcctgggtttaagcaattctcctgcctcagcctccagagtagctgggatttcaggcatgtgccaccatgcctgacaaatttttttttgtatttttagtggagccgggattttaccatgttgcccaggctggctgaactcctgacctcgtgatctgcccacctccacctcccaaagtgctaggattacagatgtgagccaccatgcctgaccagaagtcatgattcttaagaataaaattcaaaataatctcttccgttgtcgattaggttctgttcataaataaatatttatgcagtcaaaaatgaataattgttttcaaacgaggagctcaaggaattctatgtaattttggtttacttactatttatatataattattttccaatctgtaagtctagtgattaattcttatattacctaaaatgttttatagacatgttagattattacataatgtaaatgtattgtaaatagtaatggtttcattaacttgagctcattttacttatttagtacctgtttggttttagtttatagttgttatttccctgtatagtgtagcttgtacttggaagtagtaaaaccagatttctttataagtatttatggtacagaccttttcctaaatcagactgcagacctttcctgagtatttctaataaagtctgcttacattttttttttggcctgcatagtagtttgtgctatatatactctctagaaaatgtaattctggatatttgtgccataactttcaattaatcaaaatcttgtcaactgccatataggccctcatgttacaaaatgtggaaagttcagttacttaaagagtttggctgggcattgtggctcacacctaatcccagcactttgggaggctgaggcagtcagatcacttgaggtcaggagttcaagacgagcctggccaacatggcaaaacctatctctactaaaaatacaaaaattagctgggcgtgatggcacatgactgtaatcccagctacttgggaggctgaggcaggagaattacttgaaccaggaggcggaggttgcagtgagctgagatcacgccactgcactccagcctgggcaatagaatgagactccgtctcaaagaaaaaaagtttaagccagatgcagtggctcatgcctgtaatcctagcactttgggagaccaaggcaggaggattgctcgagcacaggagtttgaaaccagcttgggcaacaaagtgagaccctgtctctacccacccgccccccaaaaaaaagcaaaaaattgaccagctgtggtgctgcgtgtctgtggtcccaactacacaggaggcagagagaatcccttgagcccaggaggtcaaggttggagtgtgttatgattatacaactgcactccagcctggatgacagagcaagacctaaaaaaaaaaaaaagattttaaaaaagattgactaagtgaatgagtcctcttcttgaatatcagtcattccaggagagtattttcattaacatatttatgtctcttgttgaaagtatccattaagagcaggtagcaaaagctagacagaatatgcttttgaagattctctatgctctttattaatacctttcttaagtttctcaagatctccttttgcctccctcttgatcttaaacgagactgaagtttaagagtctttagccactctgtccccatagggatgcaaatttatgatttcagaagttccagcccccaataagaagcactgtccaatcgtttgcagatgtatcttgtaagccagatttcatgacagataagtccattccactgtcatgtgccatgtttaaagtactaaattaggttactctgtagtcaaaacaagtaagccctggtccagactactctagggcaaaatcccgttgcactgtcccttttgttctgcccatgcattcagttgtagctttcccttttgccagttgacagatagtgacttctttgcaaaacataaccagattaggttatttttagtaaaccaactaaaataaaaaattcttgacattgggaagaagtattttaacagaataatagtaatgtttttattgtgccattgtgattttctataaagaaacacccaatattcattatttatatttttttaaatttacaactctttaactgtatccaacatttcactgccaggaatatagtcaggctcgaagcttttttagaaacccatgatccaatccataccaacacttcctttagtttatggcttctgttcatttgcactgtccagaaaggtactgctaccatttgtagtcactccaaaaaaaagtgtgaactacctaggtataactctcataagacgtatacagcagcatctgtatgctgaaagttaccaaaaaagtattacttgcagatgattttgcaccttagttcccaagtgcccctgtacagaatatggagcttatgtcctgtctctctttgaatgatgagtgatgaaggagcttcagatgttactgggtgagcttgtattgagtgttacaaagagaagtcattctgcctttctttggctctaattgcagaaagtgaagtcactgcttttgctgtcttggatcaagaccagaaagaaattattgataccaatggagctggagatgcatttgttggaggtacagactaatttatttcattcttacttacaagtaaaacattttaacccttgtttctaccatataaccaagatttattcatttagtaacttctaatttcttcttttaaataattaacttctgaagttctttccatatacttctatcattgtcagtattagagggttttaccagaggaaaaatatgtgtttggaaaagataatttgctactatgctgtaccccagtcattttcacaagattaattgtatctgtcagaaaattgcataaacaaactgcatcaagtacagtatatagtatattcatagcccttcaggcttaaatgttaacacatttttgttctttaaaacaagttgtgatgaatattaaacagtatgctaataactaaggatgatgtcttttgatgataatcctttggttaaaacatctgtttcaaacacaatagtggttgtttgttatactaaaaagggttaaatttttgcctatttttggctcaataagaactggcaaattttatgtgaactaatgattttggtaatgaatactcaaaaataaaatcaaaacaatagaagacttggcttgatgacttagattgatctaaaatctgattcaaaaattcttttgataagtctaaattccttctagttaagtgtagttaattaagctagtttatagtctctagaaagctttcgcttcctcacagataccccaaaggggtctttcctggtctctgtttctttctcttaacatcaagccagaccaggttaatttaaaaaaaaaaaaaaaaaagcaagcaagtggagctgatgattgtccctttttctctggaggataatttgaatcatgggaaacttatttaagtttgtgtgatggttttaacttaatattttattttaatagtcttttgccaacataaatttttatttttctttctctaaaactattcatgcccagtcttttttttttttctcccaggctggtgtgcagtggtgcaatctcagctcactgcaacctccacctcccgggttcaaatgattctcctgcctcagcctcccaagcagctgggaccacaggtgcatgcctccacacctggctgatttttgtacttttagtggcgacggggtttcgccatgttgggcaggctggtcatgcccagtcttaaatgaactattaaccattaggatgccccatgcccttgttctttggaaagagtctgtaccacagacaacattctacttcactgttatgattgtgttttttatttccttgctcggaaagtcttcattattgataatattagagtacttagcagccaattttcctattttttactttttagagctatagatgtatgtaggctaaaatattttattctgaatttaaccatattctgtaatacattaagaaaaccctagtgatttcttggttagaaattggtcaaaccaggaatcttagtctagaaacttttaaacttatacactgtatgtacattacttaagtactttaaaatctttaaaacatgaagtattctatttctttgacattcagtgggacacataatgaggccatcatagatttgatggtgacctaaatagccactacctctggccttgggttacttggcttcctggcccggcaacaacagattctgttacagacacctaactatctgtaatgctaccgatactaggtgagaacatgtagactttttgagggagggagaggccattcttaggatactgaggtaggaacagctagctaccatttgtattgtggttacaacgataaataaactacttcatcaaagcaattgggatttttttgttagaggatttttcagcctctttttatcctacttcattatatttattgttggggtatagttaggtaagcaaaaaagaaaaagagtatagaacagggatccacagtcgtcttttttaaaggccaaatagtgactattttaggctttgcaagtcatatacaggctgtattgcatatcttcttgttttgtttgcttccttgtgttttgtttttttacagcacttttaatacgtaaaaacctttcctagctctccagctgtacaaaaacataccataggccagagttggcctacagactatagtttgccaaaccctctttaaatcatgggcagcttcctcactttattcatttctagcatttcaaagctccagacactggatttcactatacattgttgaaatcagaatagagaaagtagaaagcaggtagaaactaggcaggactttactggtaatacaattagatagccatttttctcactttgaacctactcagttcccagggtaatcagatcccaaaacactgggtcatgcaatgagatgaacatcctaatgtcagtttattaatagaatacttatgttgccatctttagcacattctgtcaaatgtgaatcaagctacaaagtaatagcaatagataacttttatacagtacctactaaccaaccaatatcttaaacactttatatatatattaactaatttagtgttcacaaaaacttcttggggtagattatttttacccctattttactgatgaaaaaaacagagacaaagaaaggtgagataatgtgcccatagtctcatggctagagagtagcagagccaggattcaaacccagaaagtctggctccaaagtcagtgcttttactcaccacactaatactgcttctctaaacatttatgtaaatctcaccattagaactgagaaccacagaccagccttcctgacaaaagctggttttgccagagaatcttcctgttatctgagtagatgacttactttattgaaaaggatctgttgtaatctgacagggttctggggactctaaggtaagattgttgaggaaaagaaagaaaaactgaaagggaagagaatccaagaactgtagtccctggtgagtttcaaccaagagctttttgctaagcagtagaatcgattgcactacagagatacagaaagccagatgataaacttgcttggttagcatgggctccaaataagagagttatatgaatcagctgtttaatagtgaagcaggatatttccctaagcccttctcaggcagaaattgcagtgtgtgggcgcaggaactagccagccactttggtgccagcaggagcgaacttcactcactcgcttctccactgctcacaggagggtgagcacacgtgagcaggtgcaggagctgggctgagcgcttttgggcactggtaagagcgaactccataccagaccagtggcagcatctaagggaagctgcccgtgacccctggatccccagaggaagcgttacagtgcccttttagctttgctgtctgtagacagcttaagcattaacagctcagttgagtgaccctccattgtcaccaatgtgacagccctttgcacccacactcatggcacccgagttcttgtccggcatccaggataaatgaggtcacacaaacgagttggagatggtaaatgcaggggattttattgccgatgaaagtggctctcaacaggaaggggagctgaaagggggatgaagcaggaagataatcccctggagtccggtcatccccagccagactcctctccaaagctatgccatcaagctgtccctctgaagtcaagccgcttctctccgatgtccaaccgtggtctacaacatccagctgcttctcctcttctttctctgttggctgagcctggggtttttatgggcacaggattgtgggtggggtgggccatgggtgattttggaaaaggcaacatttgagcaggaaaacaaggatgtaagttctcactttgggccatggtattaggctttttggctttaggatggggcgctcaccagagacctaccctcttctgcccagaaatttgcctgcctcctgtccctatcaatagcacccatctaacaactgatgcatctatcttacaacagaaatggtcttgttagttggaaatactaaaagatccattggttaaaaccccctgctccctctccacaccagcaggagcctttctactgggattggaaataacagctgttggcttgacacagtggctcacacctgaaatcctagcactttgagaggccaaggcaggcggatcacttgaggccaggaatttgagaccagcctgaccaacatggcgaaactctgtctctactaaaaatacagaaaattagctggtcatggtaacatgcacttgtagtcccagctactcaggaggctgaggccctgcccgtatggaaaaattaacaaaatggatcaaagacttaaatgtaagtactaaatcagccaggtgtggtggctcatgcctgtaatcccagcactttgggaggccgaagcatgtggatcacttgaggccaggagtttgagaccagcctggccaacatggtgaaaccccatctctactaaaaatagaaaaattagccgggcatggcgttgcatgcctgaagtcccagcaacttgggtggctgaggcaggagattcacttgaacccaggaggcagaggttgcagtgagtcaagatcttgctactgcactccagcctgggtgacagagtgagaccctgtctcaaaaaaattaattaattaattaataaaataattgtcgttgactccttccaccttgggaatgaatctcaggcagtggcaacttttacatttactatgtagtttatttttcttcgcttcattgcccaattaacatatcttctttctgattgacacattctatatttggatggttaatatattcatcctgtaactttcaagttttgctggcctaagagtatttctgtcttttgtgactttgcatatctatattttagtccactttgtggtaatttaactctctgaaggacaataattttctttgcataaatttcaagttttggataaagtatcactccagctaccatgtgctaattatctatatcagtaccagagtgccatgtgttcctttagccagctaaaaagatatatgactacatcatggattttcatgtataatttaaaaatgagtaacccaaatgtacataaattaaattaaattaaattcgtagttccatctcacgggtttagtgacagtaacaaatccctccagcctctacaagcatcgctccttgttctatttggaggtcttaagcactttgtgatatttgttctttatttgtcactgcccagccctgatagaactaatcttttcacattcttcctcaaaagcccaagtgctaggattgtactcttggaaatggatacaattctataatctctaagtatgatttcctaatttcctaggtcaggaaaaaatttcttcctgttgtcctgctgtgctttgtcacagcaggtctaccttttcatttggaaccctctttgtcactgccatagtaacaaatggaaacattgagaacattttgtgacaggcactgtcattgttcccagtgaaatctcttcccctgtgtcttcccagtaaatgaaactgagaagaaaaatcataacaaataacatgaaagaggacctaatcaatatgttcccactgggctgtcaataccagcctgtgttaatctaatatgatttagtcatatgttttatggcagctgtgggaatatggacaggacctacaaatcatctttagactgaaagtgagtacacctttgacagattatgtgtaggcacttatatacaactctcagataaaagactagagacttcacccaagaaccaacattcttagaattaaaaaaaaaaaaaaacaccttcattaagtatggttaaaagccacgtatagattagaagattttactttgttggttttttttgttttgttttcgtttttgttttgagatggagtcttgctctgtcgcccaggctggagtgcagtgacagaatctcggctcactacaacctctgcctttcaggttcaagtgattctcctgcctcagcctcccaaatagctagaattacaggcatccgccatcacgcctggctaatttttgtatttttagtagagatggagttttgccatgttggccaggctggtctcgaactcctgacctcaggtgatccacctgcctcagcctcccaaagtgctggatttacaggtatgagccactgcacctggccagaatattttatttggaatgataataaagtaactgtgctgactcataatactttttttggagggggagatggggtctcactctgtcacctaggctggagtgcaacagcacaatcatagctcactgcagcctcaaactcctgggctcaagccatcctcccacctcagtctcccgagtagctgggactacagggtttttaaaaaatgtttttgtagagacagagtctcactctgttacccagtctggtcttaaactcttggcctcaagcagtcctcctgcctaggactcccaaagtgctggattacaattgattaaaatgacaattcatttgggattacagacatgagccaccacccccagccagaatactctttattttaaaaatcctcacaacagcttcagcagagaaaatgtattacccttaaaaatattacctataatatgcaaatgactctgaaaaccactcagcaatcacaatgcaaataattctcctatttcccatctaataaaaaggaacactaattacattctctaggctgggagcagtggctcacacctgtaatcccagcactttgggaggccaaggcaggtggacagcttgagctcggcagttcaagaccagcctggacaacgtggcaaaaccccatttctaccaaaaataaaaaaattagctgggcatggtggcataagcctgtggttccagctactccggaggctgaggtgggaggattgctggagcctgggaggtcgaagctgcagtgagctgtgattgcacccctgcactccaggctgggtgacagagcaagaccctgtctcaaaaacaaacaaaaaacaatttcattctctaattcatgtttagaaaagaacattggtttacaaaaaatttttaaagagttttttcagaacaaggatgccacttcctcttcatgtggcacctatctatacttctgagaaccatgaagactctctaattatcttcatattttctatcctcaccttgtttctttggtcccaaacatttatagcttccttccccattcttcttaattgctgcttcattgtgctatgcatagaagtggtgcagaattcttgggatttgttttttctacactacccccttcctttgctctccatctcagaagactagaagacaacttggtaagtgttgaatatattgtttctcagacttcttcactcaaaaaccaaaaccttcatatgacccacatctgctgaggatttacttgatggtgaccaagatgacagctgcccactgctaaacaacccaatgtcaacaactctttttcttgtctttctgctctaatgggacatcttctctgttttatttcttgaacagaaatttttcttaaaaccatcaaatgaacagtgaaattggcttggtcattaggaatatgaaacagaccaggcatggtggctcacacctgtaatcccaacactttgggaggcagaggcaggaggatcacatgaggccgggatttcaagaccagcctgcacagcacagtgagaccccagtctctacaaaaaaaaaaaaaaaaaaaaaaaaaaatagccaggcagggtggcatgtgcctgtagtcccaactactcaagaagctgaggtgggaggatagcttgagcccaaaaggttgaggctgcagtgagctgaggtcacgccactgcactacagtctgggcaacagggggagaccctgtctctacaaaaaaaaaaaaaaaaaggatatgaaacattcaccacagatagtagttcaggttcatgcaacagaaagcaagagagagctatacccttgcacagtgataggatgctttattacatgccacactagtgttatacatccagagtcttagtcaagctgaagctagaccagcaccaaatttcataaacactgtctatgattatttgagccttcgttagttaaaaaaatgtaaagattatcctctccagccatgatttaaaaaaagagagagagaaatcactttgttcatgtgaaatacaggatgattttagagtgaagcctgtaatttctcatcaacgcaaatgttccctcaaagacctaatatcctgaatggccttcatctagaagcaattgtaaatagataatggaattgaaaggagtttatcttctgggaatgtggataagacacagacagtctgaaccatgtaggctatcagactccaaagctcagatgtgaaacttaggtttcttatatttgatgattattgagaaatatttattctaagaaaatgatgttgatatggaaatttttatttagttgcagaggtccacaggaaatgtagtaagtaaaatttctgaagttcattttcttaaacagaattgtgacataacaaaatatatgtgtgttagttccctgacctagaatattggtgagccaattggaagtaatttgaatcctaaaattctctcagctgctattaaatgaatctggtcaattttacctgtctgatacatccaacatgtatcagttagcttttactgcataactaaccactttcaaaacctagttacctaaaataacaactcatttatttagctccacaaatctgtgggttgacagctgggcctgtgcttacctggacagttcctctggccttagagtgttgagagattaagtaatttgcccaaggtcatattgaaagctaagattcaaactcaaaatttggcctcaaagttcttagccctagccattttgctatactcccttttattactacaacatcttagcttcctctctaaaggaggagaaatagccaaagtggttttataaacactggtctgtcgactggtaccagtctatgacataagagttttcatcagtcagtatcaaaatgtaaaaaggcaggggcaagaaagtaaatttccataaaactaaatgtattcagttttaaatcttgcccttcctactttgagggagttcagttttctttctttatgaataatgttggtaatagtggattttttaaaaatgttcttatctagcagaattaaagtttgccagctctgtgtttatccctaaaatcttttgggcaagtttcaatgttctgtgaaatcccaaagtctgggattcactgatcaaccatattttttcataaattctacaaaattatttggccttttttttttaatgccagtaaaaaattactgatgacgtgaatgccattcatgttgggcttttctaatatctggcccacttcttcatataaagaagatgagtataggccaggcgcaggggctcacacctgtaatcccagcactttgggaggctgagacaggtggatcacttgaggtcaggagttcgagaccagcctgaccaacatgatgaaaccctatctctactaaaatacaaaaattagcaaggtgtggtggtgggtgcctataatcccagctactcaggctgaggctggagaatcgcttgaacccaggaggcggaggttgcagtgagctgggatggcaccaccacactctagcctgggcgacacagcaagactccatcccaaaaaacaaaataaaaagtaaagaagacaagtatagaactgtaagttctatacttactgtaaacagatgagtacaggccgggcacggtggctcacgcctgtaatcccagcactttgggaggccaagacgggcagatcacgaggtcaggagatcgagaccatcctggctaacaaggtgaaaccccgtctctactaaaaatacaaaaaaattagctgagtgtggtggcagacgcctgtagtcccagctactcgggaggctgaggcaggagaatggcgtgaacctgggaggcagagcttgcagtgagccgagatcgcaccactgcactccagcctgggcgacagagcaagactccatctcaagaaaaaaaaaaaaaaaatgatgagtacagagcaataagtataatatgatgtgatttgtattttgttaaaaatggtcttatgtgtgtatgttgtaggtatacttataaaagcatataaaagttccaggaagaaacactccaaacagctaacagtggatgtactgggaggtggctgaatgaaataatcactttctactctgtatgtctgaatttttttttttttacaatgtgcccttattggctttgtaattagtgtaatctttaaataaataaaatcacatgtgtgtagcactgatgcagagcctagccaaccttagtacctagcagaaatcttcactgtggtaaataagtcatcagacacagcatttcaaactatacgataatttacataaaacataacctctgatgttttaaggctacttatcagcaaaggtctgaataaaacaaaattagcagcatgattgtcaaattaacagctactctctcttcagatatataagttctgaaaccaggggtataaacacaggcttttaatttatttttcatttaattatccaattaacgttgacattttatagaatttagatatatttctagcccacaaagtaaatggcaaattaaaaactgatttctgtcatcaaatgctcttaaaattttagaaccatcatgctatgagaaattttcagttgatcaaatgtaggtttttgaattgagttaaataataacaaaatgatccttcttatgaattagggcataagcacagcttcacataaacaatgttaccatcatcttatcccagcagctattactttgccccattgaatcttttgtttttaactatatcatttagagtgtttgtgctgaaaggaaaattttaaaaaatcatattttctggttttcagtttccagtagtgaaactcttttcaaatgagatcttatctgaatcagaatgaaatgaacccacaaaaattaaaaattaaaaatgtttttaagaaagaatgaaatgagattaaacaaactcccatttgtccctatccacattttatttggtggctcatgatgtcacgtaggaaaaccatgacctattcaaaagcccctatttgatgaatgaagaaagtaaggcccaaagaaaggtaagatgagttgtccaagggagttaattgcaaatacgagacaagaagccagattactgaattcatgaagcagcagttacttgtgttcataatccaaatgaaagttgtcagttaaggctgagcgcagcagctcatgcctgtaatctcagcactttaagaggccgaggtggacaaatcacttgaggtcaggagttcgagaccaccggccaacacaacatggtgaaaccccgcctctactaaaaacacaaaaaattagccaagcctgatggcgggcacctgtaatcccagctacttgagaggctgaggcaggacaattgcttgaacctgggaggcagaggttgcagtaacccaagatcacgccactgcactccagcctgggcgacagagtgagactccatctcaaaaaaaaaaaaaaaaaaaagttgtcagttaagctgtctgttatttagtcctcttggaaacatataggtcaagagtcaatatcccaaatgcacagaaggaggggttttttgttttgttttgtttttgtcttgatgtttgactttaacaataaacagaagcatacgctaaacttttattttgggaaccacatcaaaagatcacacattagctttaaaatcaaatactgactcagtgttgtacatctatgctccatgaagaagaatgacttttaaagcagtgttttgaaagggattagggtgaaagggcatcttatctatatgagtgcaaaatactgcttagcagtactcttcaagagctttcttccgaaattaagatcatttttaaattgatgggcttttggttttgtttttaattcaaatacaatgtcccataccatgttaacagaacttagtaagcttccatttttagccaccacaaagaaggaataagaagttattctcaaagctgtagctataggacaataaagttattctttcttatagctacagtactgaccacttgcctgtatattacacattgcttctcagttgctcactttatgtgggagggtgtgttgtgctgaactatcttaaagcaacctttgctctaaattgacttcctgtacatgtcaacaattaacaccatctgacaccaattaagctttagttttcttttcttttcttttcttttttttttttttttgagacggagtctagctgtgtcgcccagaatggactgcagtggtgtgatctcagctcactgcaacctctgcctcccaggtttgagtgattctccagcctcagcctcccaagtagctgggactacaggtgtgcaccaccactcctggccaacttttgtatttttagtagagacagggtttcatcatattggccagaatggtctctaactcctgacctcagatgatccacccgccttggcctcccaaagtgctgggattacaggcatgagccactgctcccagcctggttttcattatgcaaatacctgctaggtcagaccttaccctggcaggcacagtagctttttcagttatttcaaaatttaatatttattattttccctgaaaaatcagttttctaaaatttgggtcacaagttgttatttgagttcatgactaattggtagtcaatatgaagtcaaaacaaaattttactaactagactacatagaaaatacaaaaagtttacatctgagcacttttcagcagggggaaaccattactttgtcacatctggatattctaagctagccaaattgaagtgggaatttcctgccagatgttagttctttgagcaacctgtgaacatctaagtaagtgaggggttatgagtccttgtttggtagagctatacccactctggaggcttgctcctaacaggcagcagacattttatatgtactaccaccagtcaggaggttgtgcaacctatttgaagtcaatatgatgtgctcttgttaaatgtcaaaacatccaaggcctcattttgaatgtacaacatcagtcttacagatattatatccagggtgaacattgcattgaaatgtcctcccaaatgtagatgacaaaaattttgtttcattaatagaaagaaggtaagactgaaacaccacaggtattccagataacttggatagggccattttgtaaagtcagtgtagaccaaaatatgtctctaaatatgagggaaataaagaatctgaaatgacatgaaaaataccaagtatttatatcaacctcctgttctagacgcacatgggaattaggaagtgaaaatttcattcagaagagctgtgcacaaaaagtggaaatgcattattcaattgaaacaagtaacatttttaagggggataaaatactttctacatgatctcactggttttgtcgtcctccgtaagggaaaatattgacatttaccagactgtttgctccagctttctgatctcctgcagtttatttttataacaaccttatcgatgggcctcttacccagctctctaggtttaactgagttgagtcgatttgttaccacagcttcaagtagctgttacagaacaagcaagacatcctaataaagctgtaaacgtgtttactcaaacagagtattgattttacttggaggggaagaagccggttcttagcacagtgtcagggtggatgaatttcactgcagtttttcattgtcatctgtcagggttgtgaaacactaagtaaagccatcagaggataattagaagtaccagaagtttagcccctaaaatcagttaaccacttgggagttttgtagcttaattagcttttattaaaactttccctagtattaatagccaagcacttttaatggtatttccaagtagatcaagatatcaagattgtgacttgttaaatatatgaatttaatggctaagggtttttcagaccttttctcactctaaattaggctaccactagaacataattagaaccaaaaccaatgtaaagatacagtgatctgtacttatactagcagaataaatgcatgatttttttttctgaaaaatcaacttaaaagaagtagtaaaacaattataaaataatttaagccaggcgcagtggctcatacctgtaatctcagcactttgggaggccaaggcaggaagattacttgagcctaggagttcaaaatgagcctgggcaacatagtgagactcccatgtctacaaaaaattaataaattagccgggcatggtggtgcacacctatagttccagctactcaggaggccaaagtgggaggatcgcttgagctcaggaggtcaaggctgcagtgagccgtgatcacaccactgcattccagtctgtgtgacaaaacaaagccctgtttcaaaaaacaaaaataaaacatgtctttgtagaaaaatccagtttgcgtctttattacacttaaatgtttttgtaacacaatgtgatctaaacacataaaactgtcaatgccacccttatttttaaataccttgattaaagcagattctaaaatattctagcttactttaagttagtcattgtcttaacaataaaagctgatgcacgttgtgcaaaaggtaagcatcagagtaaggagttgcttaccttctgtagaaactgcattagctactgagcttcatgaaaagcattcatgtgaacactacctgacctcttccaaatgtctagaaaaacaaatcacagttgaaaaaaatcacccacctagaaaatgaacaaaaaaactggaaatttattaaaaataagtttgaccttctctcatgatgctgcagtcaagcaaaaatgaaaaataagtttgaccattatatttaaagtacatcttcccatatctaaataattcatttagtgctttatggtaaactttttatgtcttcttgcactactgcctcggcctgtctaaatgactaataaaaattatgatatctctgggatgaccagttctaaagcctaagggtaacagactctgtcagaaagaacagcaaaagatgttgggttttctttgtctttgaaatgctttgtcacgtgtttatctgtgcatatagttctaagccaaattctaccctgaattgctttaagccacaaagtagcaggttgtaaaatattgttgcataagagggcacctctagagcttgctcttctaatttttctaaaggtagaagaaattgacttttcacaattgtatttagatcattcttccatattaaggtattcaaaaacagaaaacataaaggatatggatttatgattatatcatttttatgtgcatttcaaaaggcccacaatacagtaatttattttattctatgcaattttcttgagaatgacagcatgtgagagagctcgttggatggggaggggcagtatatagtagggtagccatatttgagcttcaaggcactgtttactctgactccttcagtcaaaaggagcataaacccatttcacctagttcaggttaaggaattttttttttgtaaggaagatattataacagtggttaagacactgggtcaaaatatgtggggttttttgtttgtttgttttggttttttttgaggtggtgtctcgctctgttgcttaggctggagtgcagtggcgcaatcccgactcgctgcaagctccgcctcccgggttcacgctattctccttcctcagcctcccgagtagctgggactgcaggtgcccaccaccacgcctggctaattttttgtattttttagtagagacgaggtttcaccatgttagccaggatggtctcaatctcctgcctcctgatctgcccgcctaggcctcccaaagtgctgggattacaggtgtgaaccactgcacctggccccaaaagatgtggttttaagtcctggtaccacattaactagttgtgggactgctgtggtttgaatgtgtcccctctaaaattctagcattgtcaatgtgatagtattaagaggtggggactttaagaggtgattaggccttgatggctcctctctcattaatgggattaaggcccttataaaagaggcttcatgcagcatttggctagcttgctcttccactctggcttacccttccaccctcacaagacaccaaatgccaacagcttgatcttgaacttcaaagctgccataattgtgagacaataaatttctgttctttatgtattacccagtctcaagtattctgttgtagcagcacagactatgagagagactatggaaaagttaattctcttttttgtttgtttgttttttgttttttgtgtttcttttttagatggagtcttgctctgtcaccaggctggagtgcagtggcatgatctcggctcactgcaacctctgcctctcgggttcaagcgattaccctgcctcagcctcccaagtagctggcgactacaggtgtgcgccaccacgcccggctaattttttgtattttagtagagacagggtttcaccatgttggccaggatggtctctatatcctcacctcgtgatccacccgcctcaacctcccaaagtgctgggattacaggagtcagccacagtgcctggccgttacttaacatctctaagcctccgtttcctcatttataaaaatgaagataatgagtacctatctcatttgggttattatgaaagttaaatgaagtaatgtttataaagcacaacacctgatacatagtaaggattcattaagtgttacatattataagaggggtctcaaagaagtctcagacaagagccagaatgacaagttttcactgaaagtatagccagatggtgattgtaggttcaagtcagttctggagacctcagcagcagatactggatcttcactccagttcttcactaattaatcctactcagctgcattacgtgtctgcgtcttactgtctcacagtcagcttcccagcctgtctttgttttccattctggctcctaaaagagaacactgggttattagctcaattcactttttatacaatgtcatcagtaggacactaggagaaccataagttgtttgcccttgaacgagatgcctaccctttgttccatttaatagtaaaggttgaatttacgtgcacaaaacattctgcagtgctggaagtgatttttcttaaaagggtaatacgtggatgggctctataaacattgtgtttgcatgccttgtccactaccttcttcccatatttatagttctgaaaatgttccctacaacgtgatccatctatcatacaatacatggaacatcaaacagcttgtatctcaagctagaaacctagacgcccttcctgagtccttccattccctctctccaaaccgtcagtgagttcttttgattccgctttaaggatgtatctcaaatttgtccacttctatttctctgtcatgactttagcttaggcctgttttccacttactgtagtagtttcctaactgatgtctatgccttcactctttctggaactttattccattttctgtataatagccaaaataatcactttaggaagaagttgaattatttcattcccctgcttacaacctttccgttgcttctcactgcacttagcctaaaaatccaagctcctgtggtgatttaaaaaaatctatatgatctgctatgtttgtatctttatttcattccattttcacctttgcctgcatgatgtagctatactgtcagtcttctttcaggccttagacactttgtacagtggagtttactttgcctagaatgttcctcccctactctttaaaagtcaactcttctgtaatcatcctatctaaaatgggtcccttgactaatattctctcctgttactcagttctttttcatagtagcacttaacactctggaattgtcttatttacttatttgtttacttgtttttgtctatttcccccattacaatgtaagtttcagaagaacaggaactgtaagtgtcttatttaccagcgtatccccgggacccagcacagtgcctagcatagaagactcagtaaatattagttaaataaatgaatatatcaatcatatgcacagctgcaaaccgatttgcccctaccatcaagtaaagaccatttagtcggtatttctaggaatttggttattgaggtatatcataagaaggggttagaataagtcaggaaacagagtaggccatactttaggatcaggtcaacttggtttaagagtaacccacgctaggccaggtgcagtggcttacgcgtgtaatcccagcactttaagaggctgaggtgagacaataaactgagcccaggagttcaagaccaaccagagcaatatcgtgagacccccattggtatcaaaaattaaaaaattagccagacctggtggcaaacacctgtagtcccagttactcaggatggtgagataggaggatctgttgagcccaggaggtcaaggaaacaatgagccataatcatgccactgcactccagcctgagtgtgtatgtgactaatccagaaacagagagactgatcatactacctttagtatcacttaaaataaaggatgctgggctggggggcatggtggctcacgcctgtaatcccagcactttgggaggccgagaccggatcatgaggtcaggagatcgagaccatcctggctaacatggtgaaaccccatctctactaaaaatacaaaaaattagctgggcgtggtggcgggcgcctgtagtcccagctactcgggaggctgaggcaggagaatggcatgaacctgggaggtggagcttgcagtgagccaagatcatgccactgcactccagcctgggtggcagagcaagactctatctcaaaataaataaataaataaataaataataaaataaataataaaggatgctatggagagaatacatgtgttaggaaagaaggtagtatttaataataattgtactaagtagttatagtacagatacaaaaaatttattctcaagatcataatcctgaacatcagttcctgctgtaataggcagtaacatacaggtcagagactccagtcaagatttcataaaatatattaaagttatccagtagatctccaagttgattcctgacatcactctcaagtcccctaatacacacatcacactctcaaacttacaaatttggtttgccaaaatgtccagtgggaagggtttaattcagcagataatagaaccttgccctgtcctacctaggatctttgctgccattccttcgtttataggtgtgagtggggtaaaaagtagctcatccataaaggaggcagtgaaaatctctagtgaagagcactgagcctgggacataacctgtttcattttccacagcttctttacctcaagccacagaattgttcttagctctttaacttttgtcagcacccacatcaaatcaacaaacttgtttatttttcttctttccttactatctatcacccagaatagtggttctcaaacttgagcgtgcatcagaatcatctgaacacttgttaaaagatctgttgctggaccctctcccagggcttctgatttagtaggtccgtgatggggcttaagtgatactgaagcagctggttcagggaacacgctttgtgaaccatttctggaaagaattttacagtagattcccatttgatctctctgcaagcagtctctttcctagtaagttcatattccacacttctgccagagttagctgcccaaaagcaatgtaatatgcctcccctgtatcagagtttggttggctctctatttattatagtataaaatccaaatcaggctgggtgtggtggctcacacctgtaatcccagcaatttgggaagctgagatgggtggatcgcttgaactcaggagtttgttaccagcctgggaaacatggggaaaccccatctctaccaagaatacaaaaaattagtcaggcatggtggcacacacctgtggtccgagctactcaggaggctgaggtgggaggattgcttgagcctggaaggcagaggttgcagtgagctgagatcacaccactgttctccaacctgggtgatagaatgagaccccgtctcaaaaaaagtccatatcacatcatacaagatccttgacgatatgtccccattttgtctttcccgctgtgtccccaactcagctgacctttgactatattgcaaaataagctttgtcctgtcaacagcatggctttttttcctgcttataatgtctatctctgcaaaatgttattcattcaacacccagctcatgtcaccttctccaagatgcatttctaaatgtcccccaattgaggtgttatgttatttttaaagtgcatacgtggctttctctcctaaagctataaaaccctcaaggacaaacactgtgttttatccatctttgactcctttggtgcacccaaagcccagtacctagacattcaatagctgttggttgatggaatgaatccaggtacttctgacagattccagattttcactttcttttgtttcttataataaaaatgtagtatagaagcagtcatggcatgagtctagtaaactgaggattcagatcagtcaaagttataatttatcttattccctttcctaaagcagctagagataatgaaaataaaacctttaaaaagaatgtaacacctttaagttgactgcctcgtgtacactgtggcagcatatatctggtaatcattggtataggaggtaagtttaacaggccagtttaagacagcatataaatcatcactaaaggacagatagctaagaaagatggaaaataaacaaataattgaaaaaccagattgacccagaaatgactaagaacaaagtttgtgcagggagacagggagaattgagtttagtactgttagttgctgtaaaatatatcaggtttgctttaattacatggtaatgcttctaagaacaaaggtaattacatgataacttatgttactactcccatattatctctaaataactatgtaattagcttgtcactactatacagtgtgaagtttgatattactcatggataaagaacattggtaacttaagtgagtgagcaagggtggggtgagggatggaggcagcagggaaatcatagaattattacaatcaggaatgcaaatggttaattagatcattgcacccagtccttaaggatctgagccagagccatggagaataccaaacgagtctgaggtaaattctccatggcttgtcacagtgtcttctgaagaccataaacatacaacaaagtaagttgacaaagcacgcaacagatcaatgagtttgggatataatgcatgtaattttaaacagttccttttatttggggaggtttttcttttaagtaaatactaagaattttttttaattgaaaaatatttcactcatctcattttccaacatcctgaggttatatgtgtggcctatggggtgaggatgtgtagcactgggaactctcatttattgctggtaaaaaatgcaaaatggtaaacaaccactttggaagacaatttggcaatctcttacaaaactaaacatacttttaccatatgatctagcgatcaggctccttcgttgcccaaatgatttaaaaacttacgtcttcacaaaaacctgcatgcatatgtttatagcagttttattcataattgacaaaacttggaagtagctacatatctttcactaggtgaatggataaacattatcgatacaataaaatatgattcagccaacaaaaagtaatgagctatcagctgggcatggtggctcacacccgtaatcccagcattttgagaggcaaaggcgggcagatcacttgaggccaggagttcaagaccagcctggccaacatggtgaaaccctgtctctactaaaaatacaaaaattagctgggcatggtggcaggcgcctataatcccagctacttgggagactgaggcaggagaattgcttaaacccaggaggcgaaggttgcagtgagctgagatcgtgccattgctctccagcctgggcaacaagagcaaaactctgtctcaaaaataaaaaaaagaaagaaggaaagaaatgagctattaagccaagaaaagacatgagggaaccttaaatgcatgttgctaaatgaaagaaggcagtcttaaaggctacatactgtgtgattctaactacagtcatgcaccacataacattttggtcattgacagaccacatatatggcagtggtctcataagattataaaaccttatttttactgtaccttttctatgtttagatatgtatagatacataggtacttaacattttgttacaattacctaaaattcaatagaataacaggctatacaggattgtagcctgggaacaataggctataccatctaggtttctgtaagtacactctgatgttttcacaatgacacaatcacctagtgatccatttctcagaatatatccccgttgttaagcaactcaagactgtatatcacattctagaaaaggcaaaactatggagactgtaaaaaagtcagtagctaccatgggctggagctgtggcgcaaggagagagggatgaataggtagagagcactgaggatttttagagcagcaaaactgttttgtgtgatactttaatggtgtatattattatatttgtcaaatcccacagaatatacaacacaaagtgtaagccctaatgtaaactatagatattatttaatgataatatgtcaataatggctcatcgattgtaacaaatacacccactaactaatgtaacaggttaatcataggtggaactggggagtaaggggatgagggaagatttgggaactctctgtattttctgcttcattgttttgtaaacctaaaactgcccaaaaatataaagtctaatttttttaaacccaagtgggaaaacctttcttcgatccatcttattctactgacatcttgggtgtgtatgatggtctgtgtttcccagtgtcatcaatttcactgccttaaggtgctatggcttagacttgtgtcctgtggccagtgacctcacagtttttaccaaaatacttgttttcattgctatcacgtgatagctactctaagtatgattatccttcttaattctgttaggaatccccccggcattccctgtgagggaagtattagtccttgaatttccgtttcaaaagatgcgtactgatttacttggtatatagcttctgtaagaggaagtttcatttgggaaagaaaggttgtgctaaggttccctcagaaactttctaaattgccttctctaaaattgcctgtgtttccctaagcctaagagtaaaatacaggaaatagtgatgatttttatgtgcttgaggaatcttctaagaagagtgaccaattttattctacttatactgatacttgtactgatttaccttgtggaaaattcatccagtggctacaattactaactcactccaaaggcatgagtgggaaactattaaaataacacatcacttagctgaaactcttgaatggttgctcttaataaccatttttctgaataatttaaagttcccatgttttttaaaaaggtttattgacttagatctgatttgaaaagtgtaatgtagcttattatagaatatttaaaacataagaaaaacaaacaggaaaaaagtcatcccaactctagaaacttaacttttttcaaacacattttttttttttttttttttttttactattttgactaaacatgtttctaaatgtacttcttggatctgactaaagactaaaaatggaaggaaacacaagtagaaattataaagtcaggatcaggccagtgtggtagctcatgcctgtaatctgaaaaccttgggaggctgaggtgggaggatcacttgaggccagaagttggagaccagcctgggcaacctagtgaggccccatctctaccccaaaaaaaaaagaaaaagaaacttatttatttaatttcctctctttaaaggtatcatatgcaaaacagaaggtttgggggttttggggttttttgtttgtttgttttttgagacagggtctccctctgtagtccaggctagagtacagtggcacaatcatagctcactgcagcctcaaactcctgggctcaagcagtccccactaccttagcctcccgagtagctaggactaaaggtttacaccaccatgcccagctaatttttctattttttgtagatacagggtcttgctgtgttgccagggttggtctcaaactcctgggctcaagcaattctcctgcctcaacctcacaaagtgctgggattacaggcatgagctgctgtgcccagccagaagttttcattttagcacagtttaatctttcactttctggtttctgctttttgtgtgtcttatttaagaaatattttctacctctaggacataaagatattttttattttcttctaaaagtcttactatttttccatttacatttaactcattgatagacctggaattctttttttttttaatatagagtgaggtaatgttatttttccaaattgaaaactagttgcctaaacactacttttctaagaagccatcttttccccatgaatttgcaatggcaactctgttgtagctcaagtttccaccttttctctatttatttatagctatgccaacaaacactgcatttattattatagatttttagaagtatttaatctggtaagactagtctctcctatcatttttacttcagtaagtgtatatgcctgttcttgatcctttgctttttcatataaattttagaatcaacttatcaggttcccaaaaacattgttgagactgtgattgaatttgtattgaatgttatcttcttctccaataacccagcatatctctccatttaggtcctttgtaatatctttccataaagttctatagttttctttattagaggctggcataacttgcatcgcttttgtatttttaccaaattacatttttaaaactgttgctcttgtatatatatatgtgtgtgtgtgtgtgtgtgtgtgtatgtgtgtatgtgtgtatatatgtatatgtatatatgtatgtatattctatatacaaagctgctctcaatgaaaatattgacaaatttatttcttcttttacaattcctgtgtatgtgtggggtgtgtgtgtgtgtgtgtgtgtgtgtgtgtgtgtgtgtgaagatctcgcactgttgcccaggatagaatgagtacagtggcatgttcacagctcactacagcctcatccttctgggctcaagcaatcctcccacctcagcctcccaagtagctgggactacagtcatgtgccaccatgcccagataatttctgtattttttgtagagccgaggtttcaatttcttacccaggctggtcttgaactcttgggcttaagcgacctgcccaccttagcctcccaaagtgctggaattacaggcacaaactactgcacccagcctccctttacaattcttaaattttttttagtcttgttactcttgttagggcttccccactatgttaaatagtattgattttttattttattttattttttgatacagagtcttactctgttacccaggctggaatacagtggcacaatctcagctcaacacaacctccacctcccggattcaagcaattctcatcccttagccaaccgaatagctaggattgcaggcacacaccaccacacctggctaatttttgtatttttagtagagatggggtttcaccatgttggccaggctggtctcgaactcctgacctcaagtgatccaccagcctcggcctcccaaagtgctgggattacaggtgcaagccattacgcctggcctgattattattattttatttttattttttatttatttatttttgtttttgtttttgtttttttttgaaacgaactcgttctgtcacccaggctggagttcagtggcccgatctcggctcactgcaagctccacctcccgagttcatgccattctcctgcctcagcctcccgagtagctgggactacaggcacccgccaccacccccagctaatttttttttttgtatttttagtagagacaggttttcaccatgttagccaggatggtctcgatctcctgaccttgtgatctgcccgcctcggcctcccaaagcactgggattacaggcatgagtcaccatgcccagccctcattattatttttaatgggactgtgtatgttttctatttatttgtaattttactgtttccctttttccacattttctgcagttattgggtatgacttttataatcagaaaaacaatattttcacttgctttcttaaaaataaataatctcttagtgaaggcctgaggggtccttataggtgtaatatggatggccatggagctgctatggcttcaggctttatatatatgaggtattgctgtctattcacagtattctctgacctttaaatttatgtggcttaaaatctattttcaatgcataaacatttgtatatttttccaggtgaacaatgtactacctagatgtataataatttaaatttagtgtaaaatgagattttttacaacaaattatatatttccaaaaactttaaaatgtttaaactctacataggcatatggtggtctactatatataaaaggtttctgggaactatttaagaagataaaaatagagccactgacatgtatttgtactgtatctttgggaaaacaatttcagcgtaatatatacttgtaaaaagtgaattagtaaaactattctggccgggcacagtggctcacacctgtaatcccagcactttgggaggctgaagtagaaggattgcttgagcccaggggttcagaccagctgggccacatggtgagactccatttctacaaaaaatagaaaagttagtcaggcatagtggcacacacctgtagttctagctactcaggaggctgaagtgggaggattgcttgagcccaggagtacaaacaaaaacaaaaaaaactttattcctccaagtttaaaaagtgcagcttgcttacttgttgacaagctgctgaatatagaatgaacagtaatagagtctactgggttttaggttccagctaccatgaaaaactattaaggaactataaatagaaaagaaaaaatggactcataaagactttgttcatttccttctaaaatatccctagcttattaagtgtctccattaaggcttccgtacccactgacaatatttcttgattctctgtaaatgacactaagaaaattctagatgctatagctcttctatagtaactacatggaatagacagcttaagttaggaaattacattgccttttgagcacaccagcaatcctacctctgtgtgctttgaggaaactagtgtagcacctcctctttttgtacaactttaacatatgtttcaggtctcatgtcaaataccagatacaatttgtcaatttattgatcacattttgtaacatcagtaaaagtctaaataaaatcaaccagaagataataggctacaccaattgttaatgaacagaggtttatttggaaagattgttccaggattcagagccagctaacaatagctctaggaacccaatttattgtcgatgagagattctcaccttatgcctcgtcagctagaggacctaaagtctataacgtctcctaaagctgggaaaagcctgagaggcccaggttgatacgcctatgtgtaacaggatagagagaaggaaccaaagtaaaaaggcaacaacaactgcctcagcatatgagttcttgatttggaaaaacctgcactgatggttcttgttctctggtgtaatgcctcctatgcctgctctcttggctgtgttgaaaagcatacatacagagctgtgctcttcattttcaagatgatgtactgataaggaccacaagccagtggcactgggaaaaagggatcctaagagactttttcttattaaacatacattcaaagtcagttatttaatattttgctttttggactcttggtaagcccaaatcttgttctaaaaagagcagacttttttgttttgttttgttttgtttgagatagtgtctcactctctctcccattctggagtgcagtggagcgatatggctcactgcagccacaacctcccaggcttgggtgatcctcccacctcagcctcctgagtaagtagctgagactacatgtatgtaccaccacgcctggctaaatttttgaatttttttgtagggacggaattttgccatgttgcccaggctggtctcaaacttctgggctcaaatgatctgggtgcctcagcctccctaagtactgggattacaggcatgagccaccaggcctgacttgtttttgtttttttgttgttgttgttgcccaaactagagtacagtaggctcaatcacagctcactgcagcctcaacctcccacctcaagcagtccttccacctcagcctcccaagtagctgggattgcaggtgcatgccaccacgcccagctaattttttttttttttttatgtagagacgagtctccctgtgttgcccaggctggtttcctgggctcaaatgattctcccatctcagcctcccaaagtgctcagattagaggtgaggcatgagccacccaacctagccttttttttttttttttttttaatacctgcaagccacatttatctgctatagtgtttaccaaccacactctggggcctgaggctgtgtttcagtgaatgaaatattaaaaagtactttgtttacttgctgacacagtacagtatttgtatctattaatagcatattgttattgttggttttttttttcgaaaaacactttattggaataatatacttaaaatgcagggaacttttaaaaatagagtgaggccaggcatggtggctcacacctataatcccagcactttgggaggccgaggcaggcggatcacctgcagtcaggagttcaagaccagcctggccaacatggtgaaacccgtctctactgaaaatacaaaaactagctgggtatagtggtgcatacctgtaatctcagctactcaggaggctgaagcaggagaatcacttgaacgctggaggcggaggttgcagtgagccaagatcacaccagtactccagcctggatgacagaggagactctcaaaaacgataataataattataaaatagagggtgaaagaccaaacatcctatagaaaaataagcaaaagataaaaattaattcacagagagatttgttctttaaagatatataaaaagatgttcagcttcacttaataagagaaatccagattaaaattatactgaaatatttctaacccatcggactggcaaaaattcaaaagctggacagtgtactatattggtgaagttgtggggaaatgggcactcttacattactagtagaaatagaaaatccttaaacctctatgaaggagaatcactaataaaactatgtatgcatatagttactcattaacctagcagttctacttctagaatttatcctgaagatacgcccctaataacacaaaaatacatatgtaaaattttattcattgtagcattgtttatatttccaaaacattggaaactatgtaaatgcccacacataggagatagattaaactacagtgtatttatacatggagatactatgtagctgtaaaaaagaatgaagaaaatctctaccaattgatgtataatgattaccaggagattttggtctctgactacaggagtctcgctctgtcacccaggttggagtgcagtggcgtgatctcggctcactgcaacctctgcctcctgggttcaagcgattcttctgcctcagcctcccaagtggctgggattacaggcacccgccaccacacccggctaatttttgtatttttagtagagacaggatttcaccacgttggccaggcaggtctcaaactcccgacctcaggtgatccacccgcctcagcctcccaaagtgctgggattacaggcgtgagccatggcacccagcctccaagagatacttttaagtggaaaaaaagcaaagtgtaagagagcatatatagtgtattacctccttttgtgttaaaacaaaaaaaaaaagaaaagaaaaagaaagaaaaggaagaaaatgtacatacatctgcttacctttactaaaagaatacaggaagataaaccagaaaacagtgaaagtggttgcttaaagggatggtgaggaggacatggtaaagagagtcactcttctttgagcatatcttttatagaatttttacttttagaaacatgttaatgttctacatattttttaaatattaaatcaataaggatagaatgtaagaaatgggactaaaactgaaagcaaactgaaaaacatgaacccaactatttccaatcttttcttaagtaaaatgagctccccaaagggggtaaaaaagagaaccaatctaagttacatgctgaacacagtatttgactacaccagagaacagaaaattaaccctaaactctttttagtagatttggatttttttcttttaaagttagggatgaagtgacttggaaactattttagatgtattacaaaagtgagtaaacaaataaatttgttgatatttttgggagctaggttctcactataaaagaaggaacatacaaataatgggatgaggaaaggcaagaaagaaccctgtggagatggactagaattggaagtactggtgtcagctcaatttctaaaataggtctctgtacacatgtatacgtatacagttatggatgtaagtgtgtgtgtgtgcatgactatgtatacatgcatacttcccagctctgttcattaacatggtctagaagcaaagagcacagctgccacccagatcttggtctctaataccattctgtgctaaaaagaaccagttatcctcagataaatggctgattccagggcatagtagagcccagaacattatgccagaacataaagaagggatcaaaaataatgtgatggcatatccaatgacacgggagccaccagcctgaacggctcccactggcaaaaactggaatattttaaggaccaaattaattaagggctgtaagggattataaaccattgatttaaaaagaattgtgggccaagcatggtgtctcacacctgtaatcccagcactttgggaggctgaggtgggcggatcaccttaggttgggagtctgagaccagcccgtccaacatggtgaaaccctatctctactcaaaatacaaaaattagccaggcatggtggctcatgtagtcccagctgctacttgggagactgaggcaggagagtcacttgaactggggaggtggaggttgcagtgagctgagatcgtaccactgcactccagcctcggtgacagagcaagactccaccacacaaataaaataaaaataattgtgcattcttattgataataaatagattttaaaataataaatgggagaagaggtaggctcttgtttatggtagaatggtgagggctgactggtaaatgtgaaaatcatttcacagctgcagttggaaaatcatcacagtatgagttgcttcagttaaaaattatgagtggatactcaatctgggagggggttgggacttttgataaagaacagaatatttatgtgatttttttttttttttgagatggagtctctgtcgcctcggctggagtgcagtggcgtgatctcagctcactgcaacctctgcatcccggattcaagcgattctcctgcctcagtttcccaagtagctgggactacaggcacccgccaccatgcccagctaatttttgtatttttagtagagacagggtttcatcatattgaccaggctggtcttgaactcctgaccttgtgatccgcccccctcggcctcccaaagtgctgagattacaggcaggagccaccatggccagcctaatttgatttgaggatttgctcagtctgtcttccttccttctttccttccttccttccttccttccttccttccttccttccttccttcctctctctctctctggtctctttctttcttttttctttttttttgagatggagttttactcttgttgcccaggctggagtgcagtgacatgatctcggctcactgtgacctctgcctcctgagttcaagcagttctcctgcctcagcctcccaagtagctgggattacaagcaagtgccataacacctggcaaatttttgtatttttagtagagacgaggtttcaccatgttggccaggctggtctcaaactcctgacctcatgatctgcctgcctcggactcccaaagtgttgggattacacgtgtgagccaccgtgcctggcctatgtgatcttaaattgtctattcacaaactgcttgttagatgcaagggaaaaaataggtactatacaatggagaagtaggacaacaccttgatcaggtggtcagaattcctatcaccagtgcacagcagatggacatgatgtgcctctaaatgtgacactttgagaaggatccatcataatgtgtgtagtagtctgcctgggtgtgcatagtctgaacttaatcatgagaaaatattagacaaatccaaaattagaatcagtctattaaaaatgggaaaataaataagtaatgggataagcgcgtcagacacagtggctcacacctgtaatcccagcactttaggaggctgaggcgggtggattgcttgagtccaggagttcgagaccagcctgggcaacatgacaaaaccccatctactaaaagtacaaaaaaattagccaggcgttgtggtgtgcacctgtggtcccagctacccgggaggcagaggtaggagaatcacctgagcctagggagttgaggctgcagtgagccaaaaaaaattatgccactgcactccagcctgggcaatcagagtaagaccctgtctcaaataaataacaaataaattaaaaatgaggtgaggtaagttatgactatattcttcaaaaatgtccgtatctcaaaagtcaaaatctgaggaaatgttccagatttttaaaaactataaagataccacagttaaatcctgaactagactctgttccagaggagaaaatttccataaaggatattattgggtaattgactaaattgaaatatggacagtagattagataacagtgttactgaagttgatgttgatgtccacactgtagctatgtaagagaatatccttattctcagaaaagatacactgaagttttcagaagtaaaaagacattgtaaatgtaacttcctctcaaatagttcagggaaataaaattgtatgcagagaaagagtacatgcaaatggtgcaaaatgttaacaatattgtgcacctgggtagatgatatgcagatgctttttgtactatttttattcctgcaacttttttctgaatttggaatccttttcaaataaaatacattttaagcaggctaataattaaaaatctaaactaagattatattgggaaacattatgctaagtgaaataagctagacacaaaaagacaaatattgtatgatctcacttatatgaggtacctagaataggcaaatttatagagacaaaagtagagtagcagttaccaggggctagaagtaaagaggagtggggagttattgtttaatgggtacagagtttcttttggggtgatgaaaaacttctaaaaatgcatagaggtagtagttgcacattgtgaatgtacttaatgtcactgaattgtgcatttaaaatttgttaaaatagtaaattttatgttacgtatatttttcaaaataaaaaagtatcttggggatgtttacttccattataaaaggattccctacaattatttaaatataagctccctttgtttatttaaacaattttatacagctttcaagattcacatcagatactttttgaagattccacttataactgattatgtagtatctgtatttcattttagttggtttttaaaaatagattattgaaaaactgacattcaccttgggcaaaggtcttagcttttttcagcatccaggttctccacttgtcaaagcaaaagattcttcagaatacttcattcatcatctagttctcttagaaaaaggatgctggtggttttgcttcacaaaaatatttcataaacatgagctttttctttttctcacaatgatcataccaggcggaatgaagaaaacagatgttgcttataaggcgtctaatagacatgtttgcattgtaagctgatctgactctgaatttggcatctgctccattcactgtgtggactgagcattttcgcctcacagtttggcagaaaagttaatattgacttttgactgttacctgaaaacttggtgataaaatactcttactaaacctcttgagagagtgattttacagtctcagcaaatgtctttaaaatacatcattctattaaccattttaattttattctttggttgggaatacttatttgtttcatctaatacagagcattccccaaatctgactgggaaaagtctgtgtggtcagaatggtagaagaaggaggacataaatcacttataatgttctctacaggtcattataccacagcttctcaattaaccttcatccccctcaggctgcccagggcctcagggaaggcccagaagcctagctgcagcacagtttctcattattatctgctcttctgagtatttgagtgttaactgcagcagctcagcagctcaggtttcccctaaggggaaggtagcccagattcttctgctcttgacctgtcttatttgcaattatcctttttttcttttttcacagttttattgtggcataatagacatacaataaacggtatgaatctaaagtttacaattgtataactttggacatatgtgtacacccatgaaaccatcactatggacatatccactgctcccatggccttttctaatcatgccttcctgctccttctcatccccttttggattgtttccagtttggggctattacaaataaagctgctgtgaacattcatttacaagtctttgtgtggatatgtgctttcacctaccttgggtaaatacctagaaatagaacggatcatatgatatgcacatgtttagctttttaagactgacagatggtttgggaaagtggtcttagcattttacattcccacaattagtgtgtgagagttccagttgatcacacccttgccaacacttgttatagtcagtcttttcagttttagccattctgcgagtgtgcagtggtatctaattgtgattttaatttgcatttctttaatgaataatgatattgaacattttttcatttgcttatttggcatctatcttctttgctaaaatgttaaatacttttgcctactttgtgttgagttgtttcttgttattgaggtaccaagtatttaattgtgacaaagttcagattattttttcttctataaaagttgcattcttagccaagtgtggtaacttatacatgtaatcccagtgctttgggaggccaaggcgggcagattacttgagcccaagagttcaagaccaacctgagcatctctacaaaaaaatgcaagaattagaggaaagctgaggtgggagaagagcttcagcccagaaggtcgaggctgcagtgagccatgagtgtgccactgcactccagcctgggtgatagtgagacactgtctcaaaaataaataaatttttaaaaaagaaaagttcatactttttacctcttactaagtgatctttagcaaacccaagatcactaagattttcttctatgttttctcctcaagagttttaggattttattccttacatttatgtctgtgattcatttcaagtgaatttttgtagatagtgtaaggtaaaggttgaaatgcttttttttcacacaatttgttaaagtgtcctttcttgatgggattgtttgggcacctgtgtcaaaaatcagttggctatacagaagtaggtttatttctggactctgttcagttccattgatctatttgtctatatgctaataccatagtgtcttggttattatcattctataataaattttgaaatcaggtagtataaatcctctggctttgttcttctttttcaaagttgagtttttgctaacctaggtcctttgaatttccatataaattttagaagcagcttgtcagtttctataagaaaaatctgctagaatttttattagtattccaatgaattaatagaaaaattcctgcagaactgataatattgaatcttctgacctttgaacactttatgtctatttatttaggcttcttttatatttctcagcattgttttgtcattttcaatgtgcaggccctacacaacttctgtcagatttattctaaggtacttcaaatatttgaagtatgtgaagtaccttagaataaatatggataaatattcttaactttttaatcaatttttgtttttgagacagggtcctactctgttacccaggttggggtgcagtgatatgatcatagctaaccacagccgcaaccttccaggcttaagcaatcctctcacctcagcctcctgagtagctaggtctacaggcatgcaccaacatgcatggctaatttttgtattttttgtagagacaggatttcgccatgttgctcatgctggtctcaaactcctgagctcaagcaattcacccatcttggcctctcagagtgctgggattataggcatgagccacgatgcctggcttattcttagtaacttctaattgttcattgctcgtatgtataattatatatacacattaccagtatagataatttacttttgtatttttagtagagacggtgtttcaccatgttgattttgagaccctatcaacatatgcttccctggctgggtgtggtggctcacgcctgtaatcccagcactttgggaggccaaggcaggcggatcacctgaggtcaggagtttgagaacagcctggccaacatggtgaaaccccatctctactaaaaatacaaaaattagctgggcgtgatggaaggcacctgtaatcccagctactcgggagcctgaggcagaagaatggcttgaacctgggaggcagagattgcagtgggccaggatcatgccattgcactccagcctgggcaacaagagtggaactccacctcaaaaaaaaaaaaaaaaaggaagaccagattgacttgatggcaagttgttgtgtctcaacttgagctctttagaataaatattaggggaagctcatgatgtttgggaaaagatctcccgaccgggcacagtggctcaacacctgtaatcccaggccaaggcaggcagatcacgaggtcaggagtttaagaccagcctggccagcatggtgaaaccccatctctactgaaactacaagaattagctaggcatggtggtgcatgcctgtagtcccagctattcaggaggctgaggcaggagaattgcttgaacctgggaggcggaggttgcagtggccaagatgatgccactgtactccagcctgcgtgacagggcaagactccatctcggggaaaaaaaaaaaaaaaaagacctccctaacggtaacgcacaagactttctcttactgtcaaggctgaagaatgagacaggtgcttagatcatatattggtctgacccaatatgacatttctgctgctgttatacaatactcatgtgtttttttttgcctgtgttctaggttttctgtctcaactggtctctgacaagcctctgactgaatgtatccgtgctggccactatgcagcaagcatcataattagacggactggctgcacctttcctgagaagccagacttccactgatggaagagctgaaaacacaagcccaggagtgcagacactgccctaattgcttcctgagaattcccatattaataaagaagaaaattatctgccattttttcctactataataatgctgaatcttaatttagagggtacaagggtatggtaatgcttgtagaatctttattatctcaacaatctaaaaaatgatgtttatttccatagtttgatagtgccacttaaatgccaattaaacaagaatataacatttcaatagaaatttttatttcattttcaattactttgtaaattcgtgtgtatttagtacactgatttgtttttttacatttctgctttgaatgcagatgcaatttaatataatagattttttaatgaattaatcttaacatagtaatctttagctttttatacaaatatatttaatttaggagtatatgtgtgtctatacacacacatacataaatataccacatatacacctgatagtcaaataaggtacagaaattttatcttgtcaattatgccaaataatctctttaatgtgcactcaaacatgtaataaactttggataattaaataatgtgccaaatttaagttgtaccacaatattcaaatcatagtcttatggaactctgtaattggacacaaacaaaaacttgtcatataggaatttttttctgtcttttccctgtgtacagcaaactgaggaagaaagatcattatttaatactgggccctgaaatgacacccaatttgttaatggaattatgaagaacagcaatataatacactgaagaataacttagtatcagagaccaataaatcacttttttaaggatgacaaaatggtataat

SEQ ID NO: 692 - DNA, 532817 bp, Homo sapiens
gcggccatttttggggcgggcacccaatctctcgccctgtaaactgcggggtgacgggacgctgttactaggactcaagatggccaccgcgcccgctagtcatctcgctagcccgcgcgccagtgagctggcacgagacacgcggtggcccacggcgtctggggacgatctccagcccttcgcacggggcggagcgcccgccttccctccaatcagcacgccgggccggctagccaggggccgcccgcgcgcggggtgtgtgaggacgcgctcccagtcgctgagtgcctgagccgggaagcagttgctgtggtacctgctgctgcccgagcggacgtagagcatcggacgcgggcgccgtggcgctgggcaggagggcgaagccatgacgtcagtcaggtaacgagcgggcggctgccttgactgctccgagctgggcgttagcctcccgagcgcgtgagcactgtcgctccttctcgcgggtggtctggagcctgcctccgcctctggtccccctcgtgttgggggttccctccgcacttttcatttgggcatttctgctttcctcagaagttttcgggtctgtggcacattgcggagttctgtgtgtcgctgcttggtcgaggtgaccctcgcccaaattccagggttgcaagcgttcttgggtgtgtagtggatttcccatgaaaaatgtgccccacccgcgcccccgggggcggcccagggccggagggagcgtggcgtgcacagtgtgtgtcatgcctgcgtgtcatgccctctgacagaacttcattgttggccgggagcagacctgcaaagttggcccttctctgatgcaggtatattgccctcaagttgtgaaattgtgtgtctctaaaatgtttgctcatgactggaattaggaccctggttcccgaaggtaccatcttgtttctttactccttttatctcagagtcacaagtgaaatgagttgagagatactgggcatgtagcgaaatccatgaaactggagactttcccccaattgctcttccagtttggaaggttctttttttgttaatgaggacaggataatgggcttgtccactttctcccagtagccttgactgaatgtttaatttacgctagttcaactatttataaaaagagataaattgccttatatacccagtgttctgactggcctttttaaaagcagaacttgggctttgttgtcccagagaaagggaggccccagcacaaaaatgtgaagagaaataaaataagctcatttttggtctatgagctttccaggctccacccgtcctggtgatttgagggcttctcaatgccaatttttactacattgtgtttaagagacagcttgggaacctaaccctcagtaagatctaactgtgctgaactcggacatagtctgtctcttaaattgcataattatatatatatatatatatatatttttttttttttgagacagagtttcgctcttgttgcccaggctggagtgcaatggcgcgctctctgctcactgcaatctccgcctcccgggttcaaacgattctcctgcctcagccatccaagtagctggaattataggcgccagccaccacacccagctaattttgtagttttagtagagatgggggtttcaccatattggccaggctggtctcgaactcctgacctcaagtgatccacctgccttagcctcccaaagtgttgggattacaggagtgagccaccgctactggtctaaattgcttcattctgtactaacatagacaaagtacttatctcattatgcagaaggagattcaggtgctgaaacatggagacccacatggaaggatttcacagtaaattatattggggcatataaatctagcttttaaagctaacagtattttaggatgaattagaattaggctattatacccagagttaattccccttcttcccattcccactcttattatcacagaatgctactaattaggtgtaggggtcaaatactttctgtgttaagaatcagttgttatgtggattcagttttaattgactatcatcttcctgaccgtgcctcattggagaaacatccaaatctaaagcttctgctgtttaataagtgacagcaggatgtatcttttactgtaggggttgatagttttttttaaaagactgatgtaaaggttgacaccagccttacttgacatgttttgaaaggatggataactgataataaaatttatttatgcttgtttcttcagatgtcagtctgtattttacataatcttgaactatggtaacatggctcgagaaagctcttttagatgttatttaaaccagctattacattttacacctgaggaaactgagacaaaagttgagtgccttgtgcaaaatcagcggcaaaattaggaattgaatccagatttccatgatttagtgctctgcatggtgcctttgtagaaacaatatactatttaaacttcctgaaaaagctgtttctgtggacagaaattgtaaagtatcatgagagacaactatagtaactcttttgctttcttcttatcctgcaacgaacttgataactggggtttagaagtaggcagggttagccaagagaacacaactactgggtgttgggaagtgcagggaggccattgaaagtgaagtgactctgtatggtgatagttttgaatgagttggtcatcctacagataccagccatttcctggtgaacactacatttaatacaattatgtcatatctttagtttttgcaataatgatgtcagacatgttcctatcagaggcatttgagccagagcgactccatcttgaatagggtctgggtaaaataaggctgagacctaccagggtgcattcctaggaggttaggcattcttagtcacaggatgagataggagatagtcagaagatacaggtcacaaagaccctacaacaggatgcagtaaagaagccagcaaaaactcaccaaaaccaagatggtgatgagagtgacttctggtcatcctcactgcttattatacactaattataatgtattagcatgctaaaatacactcccaccagtgccattgacagtttacaaatgccatggcaacgttcagaccttaccctatatagtctaaaaaggtgagagaccttcagttctgagatatcagaactgatttcttcctttcctggaaaactcatgattaatccaccccttgtttagcatacaatcaagaaataacaagatacttagttgagcagcccatacccgtgctctgtctttggaatcgtcatccttttgtttctttatttctctaataaacttgctttcactttatggacttgccttgaattctttcttgcatgatgtctaagaaccctcttggggtctagatcgggacccctttctgttaacattcccattttgtgctcagtctaacagtagcctaaaaggtaggtattattgacccccttttactgataagctgaatgattacaagatatccaactctgactttgtgtccaatgttcttgttttataccacccttaattgttgctaaatatagtagtatgtgactcttttcatagcaatggctatgaaagaatacaggattggaaatcaatgaggaccaatggtcagaatatcttgggccccactgagggccttttctgagttactgagcttccatttctcttttctttttattattattattattattattattgttattattaattattattttgagacagtgtcttgctctgtcgcccaggctggagtgcagtggcgcgatctcggctcattgcaacctccacctcctgggttgaagccattctcctgcctcagcctcccgagtagctgggtttacagacgcctgcctcacgcccagctaatttttttctatttttggtagagacggagtttcatcatgttggccaggctagtctttttttttttttttttttttgagacggagtctcgctctgtcacccaggctggagtgcagtggtgcgatccggctcacttgaagctccgcctcctgggttcatgccattctcctgcctcagcctctctagtagctgggactacaggcgcccgccaccacgcccagctaattttttgtatttttagtagagacggggtttcaccgtgttagccaggatggtctcgatctcctgacctcatgatctgcccgcctcagcctcccaaagtactgggattacaggcgtgagcaaccgtgcccggctggccatgctagtcttgaattcctgacgtcgtgatccccccacttcggcctcccaaagtgctgggattacaggcgtgagccaccgcccccagccccatttctcttttctattctggacatttgtttaatgaaataactcagtagcagagatactaatatgcatcctaccagtgttgttggataagtgtaaaagtgcttttaaattttaaagcattttaaaaatagaataaaagcactttgagccctctagagaatggtgtcatctgaggaaaaaaatgtttaaatcttaaatttttagacaggaaacaaatttacctatctaattttctcattttacagttgaattaaagcccagagatagtgtgacatgttcaagttcacacagttacatatcttgaactagatatgagatctctagataccttgttcagttccctttctagtatagcattcaactctgaggaattcctaaataatgatttttttttggggggggtctctttaggaattcctaaataataattttaaatgaaaacttttctttttttttaacttaagatctttgaatttggctggagttagtatttcatcatttgtattctattctacttaattactgattaagagtctaaatttacagcctctgaaaccagatatccttggggaacaacttatatcctttgttatgtatatcagattcctactggtcttcatttgggaaatgatagaacatatttgataaattgatgcttttgtcattttaaattggcccaatagttaagttggcgcctgagttaagttcaggagacagaggaagatgcagaatgtcaggattcaaagaggatcttagcattttactttttttccttttctatactggatcttgtgtccaaagtaaagtgaaatgtcctacttagacctagtggtagagcctaagatagaatttagaccttctgactcctaatttatgtatttttcactgagcaacactatttcaaaattcccctctgaatattgccttgttttcctaacatcagtgtctagtctggttttgggcatcgcttacagcttgggtttgcgccagggaagactaggaaatggagttggggaatatttgttgtagagctaatgagccctattctttggtctgcccagataggtcaggtttggtctaaaactattctgggactctggacatcactgtgccctacatgatgattctggaacccacttttgtgggttaagcctacattggaaaatttatgtgggcagtgggtggggtcgtggggtattttccttctaacactcgaaactttttgaggtatgtccaatagaatctgccaagccactcagaacattcatatggagactaaaatctggctaagattgaaactgtctttgttgagttggtttctttagagccttaaagttttcaaactcatttttacctgtgtttttaaaatacgaattgtaaattcacattactgcacaattttttttatgctgtgggatgtttttagagaggtaagtgagcttttaaactaaaattgtttcatttatggaatattttgaagaagtaaaacagaaatctttttatttatttatttatttatttatttatttatttttgagacacagttatactcttattgcccaggctggagtgcaatggcacaatatctgctcactgcaacctccgcctcccgggttcaagcaattatcctctctcagcctcctgagtagctggaattacaggcacatgccaccatgcccggctaatttttgtatttttagtagagatggggtttcatcgtattggtcaggctggcctcgaacttctgacctcaggtgattctcctgccttggcctcccaaagtgctcacaggcatgagctaccgtgccggccaggaatcttttatgtgcaacgttgtcagctgttaatgctcctatttatgaataggtcacctttgtttgaaaaaagcgtacaaggttttctaactccaaatctttccagccacaatattgctacgttaagcagaactgtcaaagataaaacttgaaccaaagtgattttctagactgtttgaatgttaaccctttcctgcaatattggttaacagtcacgtctccctacctcttcatacctccttggttttattttattatttttattttttgaggcacggtcttgccctgttgcccttgctggagtgtggtggcatgaacacagttcactgcaacgtcaacctctgggcttaagtgatcctaccacctcagcctcctgagcagctgggagtagtcccacttgtagtccctacagtcccacctgtagtcctgtagtcccacctttgtattttttgtagagatggggtttaaccatattgtccaggctggctttgaactcctgagctcaagtgatccacctgctttgacctcacaaagtgctgggcctcccaaaatgctgggattacaggcatgagccgctgtgcccagccacatccttggttttaaattgttatttaaaaaatactgttgctgggcacggtggcacatgcctataatctcagcactccgggaggccgaggtgggaggatcactttgaggccaggagttcaaggccagcctgggcaatatgataaaaccccgtctctacaaaaaatacgaaaatttgcagggtatgatggtattgtgcctgtagtcccagctacttcagaagctgagtcaggaggatcccttgatcctgtaatgaaatatactatttttttttttttgagatggagttttgctcttgctgcccaggctggagtgcagtggcgccatcttggctcaccgcaacctccacttcccaggttcaagcaattcacctgacacagcctccctagtagctgggattacaagcgtgtgccaccacacctggctgattttgcatttttagtagagatggggtttctccatgttggtcaggctggtctcgaacccagcctcagcttacccacccacctcggcctcccaaagtgctgggattataggcacaagccaccacgcctggccatgaaatatactactaataaaataaaatactgtgataaaacataaataaacatttttattttttactttttacttttttagctggcattctggtctgagattattttattttatttttattttattcgagacagagtctcgctctgtcacccaggctggagtgcagtggcacaatctcagctcaccgcaacctccgcctcccggattcaagcaattctccctgcctcagcctcccgagtagctgggattacaggtgcccaccaccacgccctgccaatttttgtatttttagtagagacggggtttcacaatgttggcaaggctggtcttgaactcctgacctcaggtgatccacccaccttggcctcccaaaatgctgggactacaggtgtgagccactgtgcccggcagagatttttattttttaaatggcaaagctaggttatgaacaggatgaccatatgttccagtttgcccaggacaattctggatcatgcctgttatcctgacattattatttattattattttttcttttgtagacacagggtcttgctctgctgcccagctggagtgcagtagtgcaatcatggctcactgtaaccttgaaatcctgggctcaagtgatcctcccacctcagccctccagagaggctgggactataaacacacaccaccatgcctggctatattttgtgtgtgtgtgtgtgtgtgtgtgtgtgtgtgtgtgtgtgtgtcaggggggtgggtaaagatggggtcttgccatgttgcccaggctggtcttgaacctcctggcctcaaactcttggtcaagtgatcctcccgcctcagccacctaaagtgctgggattataggcatgagccattgtccccggctatcctgacacaattattaatagacacataaatgtgtctcatttactctcaaaagtgtcccatttggataataaattatctggtcacctacatatgcattacaatcattttgttgtactaggttttgtttgttgaaatgttatttgaactaggaccataagataatggaattttggcctattttgggtacatttggatgtttttcattggtcagacatttttattgtatggagagttctgagtgtacaaatgtatattaaatagtaatgcacatgatttgaaattagggattatttgttatcttacttttgggaggttacataaccttgaggaacctcttgtttcctcatccgttaaaaagagataatagcgatacctatcctacatgggtgttttgaagatattaaagaggtgacataccaaaaaatgcattttaagttgaaaattgttatataagtgttagtcatgtcacacatgtgcctttctgcaattgaatttaaaatgaataattttacctagtttggggaacttactatttgatagagcactggtagtgttttgctgtaaaggagagcagggaaataatggtagttggaagtacatgctgggctaaggttttctgcggggaggttttgaaattttcacatttgtgtgctgaaaagagtggtccaatagaaagcagaaaaaatagatgatgcttgacagaaggaagaaatcaatgttgagtaggaaagaaggatagaatctagaatacatatggaaggattggctttacgtaaccaagaaacacatttccctagtctgttcactttaaaaaaaaatgccaacaatataatttttttttttttttgaagcagagtcgtcggccgggcgcggtggctcacgcctgtaatcccagcactttgggaggccgaggcgggtagatcacgaggtcaggagatcgagactatcctggctaacacagtgaaaccccgtctctactaaaaatacaaaaaaaaaattagccaggcgtggtagcgggcgcctgtagtcccagctactcgggaggctgaggcaggagaatgccgtgaacccgggaggcggagcttgcaagtgagccgagatcgtgccagtgcagtgcagcctgggcgacaaagcgagactccgtctcaaaaagaaaaaaaaaaaaaaaaaaaaaaagaaacagatcctccctctgttgcccaggctggagtgcagctgcccgatctcggctcactgcaacctacctctcctggggtcaagggattcttctgcctcagccccctgagtagctgggattacaggtgcgccccaccgtgccaggctaatttttgtatatttttgtagagatggagtttcaccatgtcggccaggctgctctggaactcctgacctcaagtgatctgcctacctcggcctcccaaagtgctgggattacaggcgttagccactgtgcctggctctctcagtataatttacctaaagtcaaatcagccttccctttccttcccttcccttcccttcccttcctttcccttcccctcctttcccttccccttccgcctttcccctttcccttctcccttctcccctttcccttctcctttcctttccacagggtcttactttgtcgcccgggcttgagtgcaatggggcaaacacgtctcactgcaaccttgacctccccagcccaagccatctacttgcctcagtcccccaagtagctggggctacaggtgtgcaccaccacgcctggctattttttttgtattttttgtaacaatgccgggggagtggggtgggggtggggtcttgctatgttgcccagggtggtcttgaactcctgagcccaagtgatccacccacctcggccttccaaagtgctgggattacaggtgtgagccactgtgcctgatccagcctctttttaattaattctgtcccccttctcacccaggcaaccacttttggacttcttttactatagatgttagttctgcctgttctagaacttcacataaatggaatcatacagcaaggagtattttgtgtctgattacttttgttcaatataatattttttagattcacccattttggtgtgtgtatcagtagtttttcccttttattgtgaagtaatattccattatatgtatgtagcaacaagtcttctattgatgggctttgggttatttccagtttttggttactatgagtaaagttgctatgaacatttttgtatatatctttatgtggacttgggtaaatatctaggagtgaaattgctgtgtactagggtagatttatgtttaactttagaaaccactaaacttttccaaaatggaaaatttaacactttttacattcccaccagttttttttttatgagagttcagttttccacattcttcacaatgtttggcattttaaaatttaggcattctcctgagtgtgtacttgtatttcatcatggtttttgtttatatttccttgatggctaatatgtgattattggccatttgcttatcttttattttgaagtgtcaattcatttctgaaatattatcactgaataatatttcattgtatagatatgccacaatttatccatttatcacttgatagatatttggattattttcacttttgggctattatgaacaatggtgctataaacatttatgtacaagtttttattaaacttttatgtgcaaccctattttattgggttgtctttttgttgctgatttgtaggagttctctttatatctgaatgcaggttatttgccaggtttctcagattttacacgcacatacacacacacacacactctttctctctctctctctaaatattttctcctggtctgagctatgttgttgcattttcttaatgccttttgagagcagaacttttaagttttgagcaagttgaatttgttgatttattttattttatggtattaccttttctgttctaagaagtctttccttactctctgctaggcttgtgaaactattctctcatggtttttttctagaagctttatgtttttgtcttttgtatttaggcctatgatctatcttaaactactcttttgctatcatgtaagggtttctcaaaaggattttcaattaattgattagatagctgtgggtcttttcttggatttgttctattctgttgatttatttgtatcttcttatgtcaatgccacactgtcttaattattgtagctttataagattggtattgttactttaaattttgatagaattaatcagtgcagccgtgtgggcctggagtgtttttgtgggaaaaagcagaaggttttaaattagtgtaattacttttacaggtttaattactttagctgatatataagcattcaggttcttcactttttcctgtggcagttttaagaagttgaatttttaaatgaatttattctcaattgttgagttgttataaagttcataaaatttcctaatattctgttattgcctgtatgaactgctgtatgtctccatttgcattcttgatgttggtacttcttttgaatttttggatcagttttgctaggggtttagcaattaatcttttcaaaaacccagattttgttttgttgaatttctattttggacatgtatttttaatttttttttttttttttttttttgagacggggtcttgctttgtcacccaggctggagtgcagtggcgcgatcttggctcactgcaagctccgcctcccgggttcacaccattctcctgcctcagcctcccgagtagcagggactaccggcacccgccaccacacccggctaattttttttgtgtgtttttagcagagacggggtttcaccgtgttagccaggatggtctccatctcctgacctcgtgacctgcctgcctcggcctctcaaagtgctggtattaggggcatgagccactgcgcccggccaccttgctctcctcttgtggatttgatttgctctcttttttctaccttttttgagttagaagtttagattattgtttttaaacctttcttgttttctaatgtgcatttcatttcattcattcattcatacattcattcagagacggagtcttgctctgttgcccaggctggagtgcagtggtacgatcttcgtttactgcaaccttcgcctcccaggttcaagcgattcttctgcctcaggctcccgagtagctgggactataggcgtgcaccaccacgccaggctgatttttgtatttttagtagagacggggttttaccatgttggccaggctggtctctaactcctgacctcgtgatccgcccaccttggccccccaaagtgccaccgctcccagccacatttctttcattattattattttttctttgctaacccctagtagtcattctaatgtacatttcttatataattaacattttcttctaagtactcctttagctgcagcatacaatttcgatgtgttcaattcaaatttctatttccattgtgatttttctggtccacaggtcatttagaagtttattgtttcttaatatttggggattttttagctattttcaattttacatggtgttcagggaatgcgttgttgacatattgtgtacatatctgtaccatatatctgtaaatgataagttgtttatcattttaatcctttgatagctactgagattagttttaaggcctaccctgtggtggtctgttttggtgaatgttacctgtgtctctaattccgctctgcaatattttgaggttttcagtgtagatattttatgtatcttttattaaatacggtgtatactgcagttattgaatttagtgttctataatttatcaattaggtcagatagttttatgtgtttgttactatataactgagatataattcagctactgtaaaatgcaccacttaaaaattgcacagctcagtagttttcagtatattcacaaggttgtacagccatcggcactatttaattccagaacgtttttgtcccccaaaatgaaaacccatacccgttagcagttactcttcatgtctccctaacctctaacccctggcaaccactaatctaccttgtccctacaaatttgcctattctgaacatttcctaagtggaatcatataatatttggccttttgtagctggcttttttttttaactaagtatgttttcaaagttcatacatgttgtagcgtgtatcagtatttcattctttcttatgactgaaataatatttcattgtatagatatgccccaatttatccatttatcacttgagagatatatgggttattttcacttttgggctgctatgaataatggtgctataaacattcatctacaagtttttgtggtgttctatttttctatttcccctaagggtagaattgctggggcatgtggtaattttatgtttactttttgagcaactgccaaactattttccaaagcggctgaatcactttataatttgcaacagcaatgtatgaagattccagtttctccacattcttgtcaatacttgttactgttctagtcttcgctgagaggctctgtgtgcttgttggagcacactttcagcactcaaccaggctttcagttcatccatagccttgacttcctgttttgccgagcttcatgctcagtcagtggtgattgcttagggccttctcaggtctttcttgagtatgcccataggcctgggcacactgttttcatcttccagggtcttaggaatttcagaacttttcaaaactccctatggacatctcattctcctacttttccttttgtgttttttggttagcttgtttgccccagctgcttcagggagctgaaatgttaagcaattgtagctgattgtttttgacaaataaataccttgggggaaaagcctgttagcaatgggcaagctctgaatcaggttaaatattaggaagtcttgggagtggggtttttcagggaattgctagtcagctcaaataataactgtactctgaaaatgggactttgaaggaactctagccctgttctgtcacctccactggctgctaggctccaggattccacagattgtggtttgctgcttttcagggctagcctggagctgggaagaggggcatgggaataaggcatgttaaaatgccacaaagcttgctattcttactgagatgcagccatctttttttgaataaatgctccttggattgttgcaaactttttggttaatattcagagttctgaaaaaggctatttttgactttttttttttttttttgagatgcagtcttgcattgtcgcccaggctgaagtgcaatggtgtaattttggctcactgcaacctctgcctcccaggttcaaacgattcccctgcttcagcctctggagtatctgggattataggcacctgccaccatgcccagctaatttttgtatttttagtagcgacggggtttcaccaggttggccaggctggtctcgaactcctgaccttgtgatctgcccgccttggccttccaaagtgctgggattacaggtgtgagccactatgcccggcccaagtcttgacatttttttgccagtgttcttgttggttttatggaagagaggatttttggaggtccttactctgccattcccaatgatgtcacccaatttgttttttaagcattaaaaaaaattattttaaaatataaagacagggtctcactatgtcaattaaaaagacagggtctcgcccaggctggtctcgaactcttgggctcaagtgattgtcctgccttggcctcccaaagtgctgagactacaggtgtgagccaccacacctggcctaaacatttttaatatatctgtttttatatcctgttcctcccttttcttttgaaatacaactcacagaaattgcaaaaatagtacagaaagttcctgtgcaccattcactcaacttcccccaatgatatatcttttataactatagtgtgttaccaaaaccaggaagctgatttcggtgttatacaatagtattaaattaactatagacgttattagaatttcacgggtttttgtatatactgtttttaattgaggaggtggtggtgtatagttctataaagttttatcatgtccagattcatgtagctattaccacattcagggtattaaactattctgttaccacaaagaaatttcttcatattatttctttatggttatgcttttctctgaaccctaacccctggcaactactgatctgatttccatcactgtaattttgtaacttcgagagtgttatataaatggaatcatatagtaggtaacccgtagatacggcttttttctcacttagcacaatgcctttgagatccgtttaagttgttgtgtgtgtcatagttcattcctttttattgtttctcttttatgggtgtaccatagtttgtttacctatttacttgttgaaggacatttattatgtttccagatttttaccatttttttttctttttctttcttttatttgttttttttgagacagagtcttgctctgtcacccaggctggagtgcagtgccgcgatcttggctcaccacaacctccgcctcccgggttcaagtgatttttctgcctcagcctcctgagtagctgggattacaggcgcacactaccacacccagctaatttttctgtttttagtagaagcaagttttcactatgttggtcaggctagtctcgaactcctgaccttgtgatccgcccgcctcggcctcccaaagtgctgggattacaggcgtgagccactgcacctggcccattttttttttttttcaaacagatatggttttgctctctctgtcactcaggccagagtgtattggcatgatcattgcacactacagtcctcctgggcttaaagaattctcccacctcagcttcctgaggaactaggagtagagacatgcacaactgcacccagctagtaattttaatttttgtagagatgaggtcttactatgttgcccaggctggtcttgagctctggcctcaagtgatcctcctacctcagcctcccaaagtgctgggattacaggtgtgagccaccatggctggcctagtgttttacaaataaatctgttaggaacatttgtgtacagatttctctgtgtacttaagtttttcttcctctgggataaatgctgtgtagtgtgattctttaatttttggtgtgtctgcctgttttactaattactgaaagaagggtgctaaactaagattatgtatttgcctatttcttttgtttctaagtttttaaaaaagtattttgaagccattttatttggtgtgtacatattttgtattgttacctttagcatttcttttcttgatgatttgacctattttcatgaaatccctttgtatctggtgatactctgtattttaaagcttaccttgtctgtgtcttaatatagccactgtatagtgtctatatagtgtcttaatatagccactgtaatttatgattagtgttttctttttttttcttttttttattatactttaagttttaaggtacatgtgcacaacatgcaggtttgttacatatgtatacatgtgccatgttggtgtgctgcacccattaactcgtcatttaacattaggtatatctcctaatgctatccctccctcctcccgcctccccccaccccagtgtgattagtgttttcatggtgtgtctttttgctaactttttattttcaaaacttctttgtctttataaaagtgtatcttgtgctaggcatgctggctcatgcctgtaatcctagaacctagggaggctgaggcagaagtatagcttgagcccaagagtttgagatgagcctgggcaacagagggagacccagtctctattaaaaagaaaaaaattaactgggtatggtggctatagtcccaacttattgggaggctgaggtgggagagcttgggaggttgagcctgcagtgagctgtgattgcaccactgccctccagcctgggcaacagaacaggagcctgtctcaaaaaaagaaagaaacaaaagatcagaacctataatcacagaatcactgaaaacccatggaattatcatatgctagccattgggaatacaaatgtaaatgagatttcaaaaaaatctttaccctttgttgtctaggtggttaagatcagttgattgagataaagttcaaagcaacccctaaaatcaactaaaaagttcatcaaaggacttttagaactgagcaggagggaatgaataaatctttgggagggagggatgcagtgccttgatatacagtaccaggagccattttctacattgttaacagcactcttgagtgatgttggtggcagcttgtatatcttatgtggaagcccttgggtaggagtcgatcaggaaaaacttcccaagacaggtagcatacagggaattttaaaaagatgaatgggagtttgccaggcaaaggaagcaggagaagaactttacaagcagagtcttattcaaagaacagtaaggcattatgattaaaatagtttgtatatattagaatggtgagaggtaaggttaaagaattactgaattttgattatcttagtgtgcacatttcttcccattttaacaactctgaaattggcatacatcttacaactgattgtgttttgcatcaccattggaaattgggattattttatgaataatggcatcttagatatgatgaaatatggtaagtttgagtagattcaatgtcctttaagttatgcttttggattttatcctattaataatcagaagctaggtagattttaagtagaaaaatattatgtctagaattgtttaaaataatatgattttggtgatattgtgcaggatttattgtggctaaaacaattgctaacaatgtagaaattcaggcaatgtctgcagagggcctagtgctagtgggtgtattgtgggaaatccaggtacaggaagcgtttgataaaaccaagatgatgtcgttactagtaagatggggctagttgacgtagagagaagagtcatataaagctgaggtttctggatttaaagagaagatgactggtgtaacagttaaaggcagtcattgttagtgtttattctggcatcataattaaatgtttctattactgagagggctaatcaacattcaaacattaatatatcaatagccaagaaaagattttctcaggaactcttactgtaaaatatatgtcagtataaaatttgttgactgtccaataaaataataattatagtgtaggtttatgttggctgcaagcctaaattatgagacatttataaaattactgaccgctcccccccccaaaaaaaaaagattgttcagaatctctcatcctagcatccattccaagaaaaagatattgctaacatttggaataaaaagtaatcccagtacgggttagtcatagtttttggctatagactaaacctcatcttgttcacattctagtagaacaagataaaaacaaatgcttattcatatagtatgttcatcatttaagaaggtcatagtatttactggcctggacactagtttatatgtgtttgtatttaagaaactagccattataatctcaattatgtgcagtgaaggagagagaaacgtgacatgagcaaagttttatttgcttttgaaaataattgtatcttttttacttaacttactatttcaagatatcttttatatgctactttatttaattaatttgtttttaagacagggtcttattctgtcacccagggctggagtgcaatggtgcaattacagcttactgcaacctcgaccttccaggcttaagcgatcctcccacctcagcctccctggtagctgggattatgggtgtgcaccaccatgcctggctcaattttttatatttttctttttctttctttctttctttctttctttttcttttctttcttttttttttttttttttttgaggtagtagcatactcatggctcactgtagcctcaacctcctgggctcaaggattcttccacctcagcttccctagtaactggggctataggcacatgccaccacacgcggctaatttttgtattttttgtagagatggagtctcgccatgttgcccaggctggtcttgaactcctgtgcagaggcaatgcgcccgcctcagcctcccaaagtgctgagattacaggtgtgagccactgtgcccagccaattttttgtagagatggagttttggcatgttgccctggctggccttgaactcctggactcaaaccatctacatgcctcagcctcccaaagtgctgggattacaggtgtgagccaccacgtccagcctgtgctaatttaaattattttctcctcactgctgtactagccacaacttctgcaaccagtttcatgtgggctttggacaattgcagcctaacagcatcactcatcagggtctatgttgcatacgttctcccttggggaactgtaatgttaagattaggctgggtgcggtggctcacacctgtaatcccagcactttgggaggccaaggagggcagatcacgaggtcaagagatggagaccatcctggccaacatggtaaaaccccatctctactaaaaatacagaaattagctgggcatagtggtgcgtgcctgtaatcccagctacttgggaggctgaggcaggagaatcgcttgaacctgggaggcggagtttgcagtgaaccgagattgcgctactgcattccagcctggtgacagagcgagattctgtctcaaaaaaaagaaaatgagcactaataatcttttctatattacagttttataataaaaatgcattacatattaaacagattcacaaagtgaactaatgacaatttacgtctgtccctatactttcagttgtaagtaactaaaaaccagcctcaaatggaaataaacaaaactaccgacatatgtaattgaaaagtccagatacctgggtgatgaaataacctgtacaacaaacccccatgacacaagtttacctatgtaacagacctgcacttgtacccctttacttaaaaaagcaaaacaaaacaacagaaaagttcagatggagtataggtttcaggtaaagctttattaggtggtccaacaacttcattaatgacctggtttctttcagttttcgcactctgctttctgtggtgttaaatttatcccaaggcagccacattgaagccattaggtttttaaggcttctagcaccttcttcatttatatctattagggaaaaatatgttctgtatctgagcatcatagaaaaaaatcttgggttcattctgattttcctggcttaggttacatgccagtctctgaactgattactaaggctagagaaatatattgtgctgattggcttaggtttgccccagggatcaattccacccaaattccattcttgagtgaggaaatttggggtaaaagagggaggatagcaaggaaaagatgacagacacacaattccagtttattataagaatgacttcaaatgaccttaactgaattgtaatattatttgggaacaagtcaaacattattaacatttaggcccagagatggtagatggcttgcttaagtctcccagcaagctacctcaagaactgagacttgggctgggcgtggtagctcacacctgtaatcccagcactttgggaggcccaaggcgggtggatcatttgaagccaggggttcgaaaccagcctggccaacatggtgaaaccccatttctactacaaatataaaaattagccaggcgtggtggtgggcacctgtaatcccagctactcagcaggctgaggaaggaattgcttgagcccatgaggcagaggttgcagtgagcagagatcatgccattgcactccagcctgggtgacagagagagactccgtctaaaaaaaaaaaaaagaaaaaaaaaaagaactgagactcagaagtgaattatttgactcttgaattgtacttcattcttagaatcaattattggcctctctgtaagactgtctttactgagtttttaaacggagtataataaactcttttgggaatgcggtagatgttcaaaggtttgacttcttaaaaagaggtgtaacaattatattccttaaaactgagaggggaccaattgagggtagagggattgatgtgggggcaggaggatacttttttgttgttattgtgatgaaaatgttccatagttttgtggttatatgactgtatacattgaactggatgcttacaaacggtgataaaaagggtgaaggaaaataaaaaaccaagtagcccaataacactgctcatccttgtttttttgttttgttttgttttttaaataacaagttctaggagtttttgtttgaataagaatatataaatcaggcagagtagtcccagtgaaatcatggttagattttactgtatttgtctgttgatccttcaccttctaagcacttaaaatacttttttattagacttgctttgatcacatatgcaatttaagtgtgaataagtaagtgtattatctttccctcctccactcagctttctttaaatagaaaagggacaaatatctctttattgcatattcagccatagttgctcaatctatggtgttaataagagactgtaattttatcttctaaaaatcattacagattataattataggctgtacctcattctcttaaagaaatattggcatgttagtccattgatattactgatagttgccaaatggtgagaatggtaactggtttggaggcaactgaaagggagggggaatcatcagtaaactggagaccaataaaaaattacacagaaacaaatctttttggataaactagatgaatgtctcttattgagactgatccaacagtattcactggcccatttcttgctgctagatgagcttctgtttaaggcatcacttgtggtggagttctttcttttatttggattggaaccatactgtgatctcttatggaaaacagacttcctccaagtctgttaaatataatttaaaattatatcgtttcttgttgatttgtttgtttttgttttgctttatttcatgttataggcatctgaaatgaatccttatatatataacatacaagtatatgtatgagaagacatgaatataagaagtataggaaacataagacatgaataaaagttttagctagacatttttagatgaaaagatgtgcatttaaatttgtaaaagttacaaatcgttctataaaaagttagcatatatttaaattttttggatacataataagagaattatatcacttctgatatccattgtgaagaccctaccacagtcatttttttgtgaagggtagatagggctcttgcttgtactcttccaggatgtgccacgggctccctaataacattcaggggagtgcatgtgcaggtttgttacatgggtatatcatatgatactgaagtttggttttgtaatgatccccatcgtctaagtagtgaacatagtaaccaataggtagtttttgagcccttgctttcctgtctccctccctgattttggaatctccagtgtcttttgtcccgacatctttgtgtctctgcgtacccagtgtttagcttccacttataagtgaaaacatgtgatatttggctttctgtttctatgttaattcacttaggataattcagctgcatccatattgctgtaaaggacatgatttcgttctttttttatggctgcatagtattccatggtgtatatgtattgaattttctttatccattctaccattgatgggcacctaagttgattccatgtctttgctattgtgaagagtgctgtaataaacatatccctttttggtagaatgattcattttttttcattttttttattttttaggcagagtctcgctctgtcgcccaggctggagcgcagtggcacgatctcgactcactgcaacctccacctcctgggttcaagtgattctcctgcatcagcctcctgagtagctgggactacaggtgctcgccactacacctggctaatttttgtattttttatacagatggggtttcaccttgttggtcaggatggtcttgatctgctgacctcatgatccacccacctcggcctcccaaagtgctgggattacaggtgtgaaccaccgtgcccagcctagaatgattcatttttctttgggtatatacccataatgagattgctgggtcggatggtaattatattttaagttttttgagagatctttaaacttcttttcacaggggctaacctaatttgcattcccatcagcagtttataagtattaccttttctctgcaaccttgacaccatctgtttttttttttttttttttttgactctttagtaatagttattctgggctgggcacagtggctcacacctgtaatcccagcattttgggaggctaaggcaggtggatgtgctgaggtcaggagttcgagaccagcctggccaacatggtgaaaccccatctctactaaaaatacaaaaattagccaggcatggtggcaggcacctttaatcccagctactcaggaggctgaggcaggagaatcacttgaacctgggaggtggaggttgcagtgagctgagattgcaccattgcactccggcctgggcgacaagagcgaaactccgtgtccaaaaaaaaaaaaaaaaaataggtattctcattggtgtgagatggtgtctcattgtagttttgatttgcatctttctctgataatcatctttttttctaaatgtctttatgctacctctaaaatgttctacgtataataggcaaatcaaatgtttaataaactggtgtgttaggtttattttcaggttgaaatgaagatagttatttttattttgtgtaccttttacatatcaacttacttttagaagtatttctaacttgtgttttgtgtttttttagagaaaatattctctttggaatgggaaatcctctgcttgacatctctgctgtagtggacaaagatttccttgataagtaagtattaaactcttcatatgcactatgtggaacttacatttgaagaagaatggatgaaaactttagaagtgaatttaccaccgaatgtcttcaattaaaggaaaactcaggaaatttaagtttggtgatagcaagtgtgctatcattaactattgaataactgagtacagttttccttgggaaaacttatatacattgctatttttacttaaaacttttttgcttattatttggaaggagaaaagtttatataatttacctaattatttaattccccaacttttaaactactgtcagtgagctacgtctataatggtatcataatctacagacattctaccccgaatgtgcccagtctggtttcctctcagaagctataatgggagaagaaagatgattagagaagacaagagaacgtgcaggatataattcagaggatatgaagctctgctgtttccgctttattagtaacttccaatgtttcaacttagctgagaaatcagtttgtttatttacctaagtatttgaggccatttcgtacaatagtccccacttgtgtccttgttttcagtttctgaggtctcagttacccataggacagtgtaataagacattttgagagagagacatgcaccacgtccacataacttttattacagtatattttaatagttgttctatttttagttagttgttgttaatctcttattgtgcctaatttataaatgaaactttatcatagtatgatgtgtaggtatgtatgtgtaggaaaaacagtgtgtgtgtgtttgtgtgtgtgtgtatatgtatgtatgtatgtatgtatgtatgtatgtatctatctatctatctatctatctatctatctatctatctatctatctatctatatatggttcagtactatccatggtttcagatacccactggtcatcttacaatgcatctacctcggataacgggggcactactatatggcaaatttaagtagtaaaaaagattaatgatgagaaagcaagatcccccctctcctcacacaccctgatttctgtacccaagagtaattactttttaaaaaattgaggcaaaatttatatcgcataaaattgatcgttttaaccattataaagtatacaattcagtgactgccagtatattcacaaagttgtacaaccatcaccactatctaattcaggacattttcatcaccccaaaatgaaatcccatacccagtaagtagtcattcgctattccctcctctaacccagtctcctgggaactactagtatacttagtttttctatgaatttgtctattctgagcattttatagaaatggaatcatataataatatatgatcttttgtgtttatatatatgaccttttgtgtttgggcttattttacttatgtaatgctttcaaggttcatccatgttgtagcatgtatcagtccttcattccttttaatagtggactattccattgtgtggatagaccacattttgtttatccattcattggttgatggacacttatgttgtttttattttttgtctattaggaacaatgcttcttatgaatattcatgtataagcttttgtgtaggaatgtgttttcatttctcttgggtatacacataggagtggaactgctgggtcacatggtaattctgtgtttaacttctagagaaaccaccaaactgttttccaaagcagctgcactgttttgcattcctaccggcagtgcataagtgttccagtttctctacgtctttgccaaagcttattttttattttttaaattatagccatatgagtgggtgtgaaatgatgtctcattgtgattttgatttgcatttttctattgaaaacttttgatgttagcatcttttcatatgcttattggatatttgtatatctttgggaaaatgttgaagctctttgcccattttttaattgggtcgttgtctttttgttaagttgtaaaagttctttttatattctggatactagaccctatcagctagcatatgatttgcaaacattttctcccattctggggatttactttaattttttgatagtatcctttgatgcacaaaagttttaaattttgatgatgtccattttatttttcttttgttgcttatgcttttgctgtcatatgtaagaatctattgttaaatccaggatcacaaagatttgtgcctgtgttttcttctaagagttttgtagtttaaggtcttagatttaggcatttgatcaattttgagttaatttttgtataaggtatgaaataagggttcaactttattcttttgtgtgtggaaatccaattgtctcaacatcatttgttgaagagactattcttttccccactgaatgatcttgatactcttgacaaaatcaggtgaccatagatatatgggtaaatttctggactccattctattccattgatacatatgtctgtccttatgccagtatgacattggtgtttttgtgtatgtgtgttttgttttttgttttttttttggagacagggtcttgctctgtcacccaggatggggtgcagtgatgcaatcatagctcactgaaaccttgaactcctgggttcaagtgatccttctatttcagcctcccaagtaactgagactatatgcaggtaccaccatccctagctattttaaatttttttttgtataaacagggtctccttatgatgcccaggctggtctcaaactcaagtctggcttgatcctaggcccaagttgtcttcccaccttggcctcccaaagtgctgggattataggcattagccaccatacctggcctgtacgacactgttttgattactgtagctttgtagtaaattttgaagtcaggaagtgtcagtcctccaactttgtttttcaagattattattattattattattaatttttaatttgagatccctcacaattccatatgaatttttggggatagctttttcatttctgtaaaaaaggcagttggaattttgattggaattacattgaatgtatagataaatacatgattaagtcttccgagttatgaagacagaatgtctttccatttatttaggtcttttttttttttttttttttttggagacagaatcttgctctgttgtccaggctggagtgcagtggcatgatctcagctcactgcaatctccatttcccgggttgaagcgattctactgcctcagcctcctgagtagctgggattacaggtgtgtgccatcatgcctggctaatttttgtatttttagtagagacagggtttcaccatgttggtcaggcttgtctcaaactcctgaccttgtgatccacccgtcttggcctcccaaagttatgggattataggtgtaagccactgtgcctagccttaggtctttttaaaataattttagcagtgtttagtaggttttcagtgcataagtcttatacttctttggttaaatttaattttattatttttgatgccattgtaaattgggattgttttattttcttattgttcattgatagtatgtagaaatataagtaattatgggggacaataatttttttgaaacttttttttatatcctggggattacccctgtaagtatatttggctaaactcaaatgtcaaagggtaaggcaagaatttataaatgtgtaaatttgacttacggtaatataataggaaatgtgctgggggtctaggataaactgggagatgtgttttatcctaagacattcagatagaaactttaaaacacactttcccagtcagaaaatactactatatacagttactttaatgattttagttcttttggttaccttgtacttttaaataatatactatacttacatttcttaaaatttctttttctgtcaaatttcaggctgggcgtggtggctcacgcctgtaattccagcacttttggaggctgaggcaggtgaatcacttgaggtcaggagttcaagtcatgccaacatggcaaaaccctgtgtctactaaaaataccaaaaattagccaggtgtgatggcacgcacctgtagtcccagttactcgggtggctgaggcaggagaattgcttgaacccgggaggcagaggttgcagtgagctgaaattgcaccattgcactccaacctgggtgacagagttgacactctgtctcaaaaaaaaaaaaaaaaaaaaaaaaaaaaattaaaccaagccaaaccacaccaaaacaaaaaaacccaaatttcaatggaatccattgacttctcattatggagaacgagattactggtgcccctattctttcctatgctacttcttctatctttctattctattaactgtgtttttaaggttgatgttttcattctgttatctatctataattgttttcccaactttgaatacaaattcataatgaaagttgaaaatgacttacccacattatcactctgtgtatcatttattgcagaattaagtagtgtaccaggaatgtagagcaggttaacatttgaaatgtaattagaagactgggcgtggtggctcacgcctgtaatcccagcactttgggaggctgaggtggatggatcacttgaggtcaggagtttgagaccagcctggccaatagggcaaaattccgtctctattaaaaatacaaaaattaactgggcatggtggtgtgtgcctgtaatcccagatactcgggaggctgaggcaggagaatcgggtgaacctgggaggcggaggttgcagtaagctgagattgcaccactgcactccagccagtgtgacagcctgagaatctgtctcaaaaaaaaaaaaaaaaaaaagaaatgtaattagagtaattcactatagtaagaaactaacataacagtctaagaaaactccatataattatctcaatagacaaagaaaaaccttttgacaaaatctaatatctattcctgatgaaaaaaaataacttaaagcaacctaggtaactatgtcgataactttcttaaccctataaaggttacgttaggggaaaactggtagtgtgatgcttatatgggtatataacgtatcaaattgtatactttaaatgtctacagtttattgtatgtcagttatatatcaaaggctgtaataaacagaaaataaaatcagttggacatgaattcatgggtttaaaattagatctcttttgtttgtgtagtgtgagatattttgttcaggaagtcaactaattcatggtcactattttaaaaaaatcatgatgtataaaagtaaagagcaacttaaaaatttgaaattttatcgtgtatttcaaaagtaaaataaagtatagagacaaacccataaatgtagaacattttatatgggaagcaagaattgaaatttgggatatacacacagaccaggtggtctttgctatgtctgaagaagaaagataagattggaagttttataaaaaggtgaaatgttttgtattgttttgaaagaaagctcattggcactagttttggggaggtggcaagctttgattggtgagtgactgcagtgagtagaactagtcttttagagtcacagctcattgtttcagtagctactggataaaactgttttcagatgacaacaggcagtttcagcagccaggcttgcagagaattaccttcttggagcaatgttatgtgtgctgagtgctcttccccccagcctgtcacctgttttagtcagatatgacaagaatgacccaatttatatgattagctttcacacatatataatcagtgttgttattttggtgaacatgcctccagatgtttgttaggcatatataacctgaagatgaatgtttatgggctaatactatgtgtagtctttgttagtatgctgtttttcactcaacattatgtttttggatcactgtttttaaaatttcaggcaaatgtgatcagagtgattatgacttggcagctgtgtgatgatgtcacaggatccttagggtgtcgcttttccagccagaagccactgtggttggtggagcctttgcctgaggtttgcttgtgcctgccaggcttgttctgcttgtttggcctggcaggctgcgttcggctcatgctaccagcctggatcccacacctgccaagggcgagccaggtgcagagtggcgtggcaaagagtgtgtgagcaagcgaatatgggatctggccactgtgtacagccactcatgctggctgctgtggtggggtgggcatctccaggcactggcacaggtgctggcttcatgcaagcttgcggctggatctgatgcatctcaagtggcttccactgtaggaacccacgtctggacgaggataatatggtggtgcccagaagcttggagacaccagaaaccacagagccccaaagagagtgtcacagccctggattgggaaccccctaggtctgggctctcagaagggctgcagctcttctttccttcttgttgcctgcaaggtgctgagtggggtgaggcatattttagctctgtttgtgttacagctgtttcagtcctgccacttggtgggtcttcttatcctgcatccatgaacagtgaggtatggggacaactggagggtgagcaaggtggagaggagcttcattgagcaacagaacagctctcaggagacccgaagtgggtagctcctttctgcaggcaggtcgtcctgacaagtgttcacctctcagtgagatgagaccccgagggggtaactcctttccacagttggtagtcccaggtctcttctgtaagtctggctgagtccagggtttttaatgggcttcacaagggagaagtgtgtgctgattggtccatgggcggctatgggtgggtctggaaaaagcaccatgagtctcactcccctcagtggaccccacctggaactgatagcctggcccccatgcttcaggctgtccctggcttgaaggcagggcttcacctgaacccaccccttttttcccaggagagtgtctgcctcctgctgccatcaatcatgttgtccacagtgtgcaggctgttggtgatgagggtacttgctggccccattgagctgccctcagtcccaccttggcctccttcccatgcttctctgcacctaaagtccagagggggctgagggggcagggggctggtatgtcagtgctgccccgagcacatgcacacctgctgggttgtgacagtgcctgggcttggccacgactttgctccaccctggagcaggtgctgggatcgaggagaggccaggcatgggaacaggcacttctgagtctgcaggggaaagggggacttcccgggccccagagagtgcagggatacctgggtccacagccatggctgggtggctgcagctgcactcaggagggtggggctccagccctgccaacttggaagtgggtgtggctcccacctgttcccagctcccatgggctctgtggagcatgcagccctggctgcatctccccaattgtagccagtgtctttgcagcagctgctctagacagcctgctgctgccatcaatgacgctgctgggagctcgagtaacttctttgttttacatgttttactagcagctggtcctaagtggctagctgaagttctattttatatttggaaggttttaatctttaactttgattttcaaataagtacttgaagataaaaaacaagtctttggaccctaacaataaaagagtcttctctattgttactcctggctatttcttccaaatatatttaaaaacttaccttatgatataaacgaatcgtgtttagcctacattttgagccaccattagataagtatttagataagtactatgtatatatatattttttatttttttatttttttattttttatttttgagttggagtcttgctctgtcacccaagctgcagtgcagtggcgcaatctcagctcactgcaacctctgcctcccaggttcaagcgatcctcttgcctcagcttcccgagtagctggaactacaggcatgtgccaccatgcccggctaatttttgcagttttagtagagacagggtttcaccatgttggccagggtggtctcgaactcctgacctctggtgatctgcccacctcggtctcccaaagtgctgggattacaggcatgagccaccgcacccagcatagataagtggtatattgctatggtttgaatgatggtatcctctccaaaaattcatgttgaaacttatccccagtgtagcagtataagaagtgtgactcttgggggttgaccaagttatgaaggctctgctcttatgaatggggttagcacacttgtgaaaggactcaaggttgaagggagagctctcctgcctttacattccttctgtcatgtgaggacacagtgttcctcccctctggaggatgcagcaacaaggttccatgttagaagcagagaaaagcctcgccagacaccaatcttgctggtgccttaaccgtggatttcccagcctccaggaatgtgagaaatatatttctattgtttacaaattaccccaaacaaaataagaaaaataaaacaacaacaaaacataagtaagtaaataaataaatagcctggtctgtggtatttttgttatagcagcacaaggggaccaagacatataccaaatgaatgagatatatactgattagtatcttacactgtgaaagtgagttctaattgtcaaaattcatttgataaaatatttttctgattctgatttttttttttttagagacaagtttttctgtttcccagactggagtgcagtagcacaatcatagcctagtcactcactgcagcctcaaactcctgtccctcccaccaaaaaaagaattgaaagttattaggaacacctgtggcagaaagtacattattgaaaagaatcttttctagtaaactgtagggacacagtgggcatgaggggataggaaatgtggaacatatgaatacctccagttgagccctggtctgtaattatggaggtatgtattaatagggatgaaaaaggcagggaaggaatgtgtaaggtaggtttgccttggtttttcctgacactagataaatatgaaagtaagaggaatgagagaatgaatgaaatggtaattgagaaaggaaaaccatcagtagaaatgaaaatactcagttttggctgggcgcggtggctcacacctgtaatcccagcactttgggaggccgaggtgaacggatcacctgaggtcaggagttagagaccagcctggctaacaaggtgaaaccccatctctattgaaaataaaaaattagctgggtgtggtggcacacgcctgcagtcccagctactcaggaggctgaggcaggagaatcgcttgaacccaggagcggaggttgcagtgaaccgagattgcgccactgcactccagcctgggcgacagagtgagactccatctcaggaaaaaaaaaaaaaaaaaaaaatagaaaatactcagttttatgacaggagtagttgaggagacgtgtttttcttacagatctaaacctttaataaacatacaaaccttacatgagtttttattaatctgagtatgcatgaaagatgttacttaatgttcaaacctaaaatgcccgaagtagctggctgtggtggtgcttgcctgtagtgccagctacttgggaggctttagctgtagtgcatcatgattatgcctgtgaatagccactgcactccatcctaggcaatatagtgagaccctgtctctaaaaattaaaaaaaggaaaatgctcaaagtaattggccataaattttagtgctgattattcagtgccaataatttacaactgaattatttctataaataaaaatttatttcttctacaaatgggtgtatgttagctttgaaagtgaaaaaaatatttagtgtcaagtgagactgcatgtgttaggttaaaagctagacatttaattgttttgctttaaaatgaattgtaaactgctctgacacttttgtagttaattttttttttctttgagatgaagtttcactgtcgctcaggctggagtgcagtggcatgatctcagctcactgcaacctctgcctcccgggttcaagctattcttatgcctcagtctcctgagtagctgagattacaggcatgtgccaccatgcctggctaatttttgtatttttaatacagacggggtttcaccatgttgaccaggctggtctttaactcctgacctcaagtgatccacccacctcagcctcccaaagtgctgggattacaggtgtgagctaccgtgcccggtcttttaattaattctttataaagctattgccatatttttttctacagctttcaacattatgttttgtatatttaggtctttaattgacctgaatattctgtctgggattttgtttagtatttatggattaatttggaaaaaagagatctttaccaacaaattttcttatccttacaaatatttctttctgtattttaggtattcttctattatcttttaataacatgtaaaatttaaatacatttaatatgggttacaaaatggttaggctgatttttttaaaaaacgtatacatcttatggtagtgatcatttgctaaatctgttagattcaaaaattctaaaagtaaatgctttttagaaaaaaattcagaccatgtagaagtcaataaagtacaaatgaaatctggggtcagtatctttgcagcagtgtgtgctgtccactagaatgtttcatgattatggaaatgttgtgtatctgtgctatccaacatggtaaccactagtcacatttggctttgatcatttgaagtgtggctagtgcaactgatgaatttcaacattttatttcatgttaattaaattttaatagatataattagcatatatgatattaaccagtacagcttaggtttattgtaaaattttacatttctttttatatgtttatattttttaaaggtatcttcaaaaaaagttgtatctattgtgtatatgatatatttttctacaacatattctagattattggtggtgtttggaaatgcttcttaagtttgaatattttctcttatttgactaccttgtgacctacattaacagatagtctttggttattctgcttctctccttcaaaattctaaattcttagaatttgaaataaactgctatttgaatctttatgtcatttcacatattgagtgattggtcctgagttgctctggggcttcctcaaaaaacaacctaaattatggatactaaatgaacacagactactttccttcattttgcccaaatagatgctgttctttgggttctttgatgttcaaacttaactttgaatattgaaggaaatggtacttctaaggataagtaaacatagattcttttttaacagttcatttcacagctcaacacacactttttggagcatatgttttatggttactcttttgccaaatactgggaatacaatattaaataactgttttgcctttaagcagcttgtaatctaattgaggagacagatgtggaaagaaatcacttacttcttcacagtggcattatagaatagaggttaagagtgtgctctggagctgtgtgaccttggttatctatggaagctcagtttccttgtgagtaaaataaggttattagggttcttgtgaggattgaatgagattatttgaatgtttggcatatgttagctaatattactggctactgagcttgaaatctctcgtgcctctattattggcaatggagagcacttgagagatttaagcaggcagatgacatggttggattcatattttaggattatgtgaattgctttgtctgtagtggatcaatagatttgaggaggctatagtgataaacctgttgcgagatgatgacttgatcactttagttatgatagaatggttgggaagagagtgcagtaatacttttcgtgttatcaaggtaagacttgattgatttaatgaagagggtaaaaggagttagagataacatttgaatttttggttttggtgactgatggtggtatttacaaatgagttagggagtataggaggaggatatggaagaggggcttgaaagattgaattgagttttgttcaagcttgagatgactatgatatccaggcaggcatattcaggagacagttggatttatgtttttggtgggtagaagagtcatggctggactccttttgtttctggagacagggtcttgctgtgttgcccagtctggagtgcagtgagtggtgctgtcatgcctccctgtagcctcccaggcttaagcgattctcttacctcagcctcccgagtagctgggactacaggcatgtgccctaccatgcccagctaattaaaaaaaaatttgttttttagagatgggtctcactatgttgcccaggctggtcttggaatcctctgacctcattctctcaaagtgctgggattacacatgtgagctacagtgccttgcctggactctttaattgtatttaattttacatagtttgacgcaatattattcaataaatggtagctattactagcactatttttattattatgtggctggtatttaaagcaaccagtagatgaaactttctaaaaaaaaagaaagagtaaaaagtaaaaggagtgggctggaagctagaacatttaatagatggatagataaagaatgagtatagaatgagattaagaaaaagcagaactaagacaagctctgatgaagtatgatgagtttatataagaatagtcaataatacctgatgcaacagagatatctagtaaagtaatgcctaaaagggtcccctgtatttgaatgggatgtcagtggcgccctctgccaggcaaatcacagtgcaaatatggagacagaagccagaaataaaatgtattagcaaataaatgggaggttgatataacatgggccggttttgctgatgtgacccaagagctaagcagtgatatcaatatcttccaattccaaattttaaaatgtcctttaataaaatatgtggctagtcattttgaacaattatcagtaaaatttttaaaataaaaagcataagaaaaattaagaatacaaagagtatagttctattttaggtatttaggtttaaatctagtttaattctttcagctttctctaattgagttttaatcctcgtttactttgctaatgagatttaaaaatattattttcataaaccttgtaactttttgcttttttattctaaccctgtgatttactcttaatctatttctttataagcttcttaaatttcagtccagctttagtctcaaacattgttgtagtgattaatggttttgcccccccattttcttcctttgtaatatattttaatcaacttttttttaaattggaagagccaattaaatatgttgtttaaaatcttgccatatccacactgtctacctgattggttttgccaattctgtaaaactttacttgatactgttgggattctttggactatgtggcaatatttgtagatttatagaaattttactgatttaattcttggaaggcaattttagttccaagtatttatagaatattttattgtcatctgctatgtaccaagtcttaacttgacattaactgtgcaacattaggcatggcacctctcttatgactgtcctatttcagaacttcacagtctgttcctgcgcctttcaaggcactaagctctgtgctatgctgatcttcagaggaggagcacatttgaataaaaagtgtttgtttcagtctcattaaaaggctcttataaaagttatgaacatttaaaagtgccctttcctccctttttgagctaattgaattcttcattttataggggtagaagattccaggaagagggggcagggatgagtatttatcataattgttaaataatgcgctggacactttttgtgtaatgttatttgatctggatagcaaccctgtgacataggcaggtttatcctcattagagaaattaagtggcttgcccagttcagaaaacaagttaatgtcagaatcaggatgatattgcaggttttttgatttgtatctagtgatttttttcactcagttgttctctttgtaggggctagaggcagaataaagaggccccttccctgtgctccctcttgcttccccgtcttctattctttggagtgtatgtcatttttctccagtaatttagggcagaaaaaaatgttgaggactaccactgtaccattttgttgtctctgatttttaggaactatgttcatggtaagaattgattataaaagaatacctatctatgccattagaaaacaaaacatccaaaatataggctgtgctttgcatcattctatgaaagccatggtgggaagttgggttatagctttctactaagttgaaagtaggctctgtcgcctaggttggagtgcagtggcacaatcttggctcacttacaacctccatctcccaggttcaagtgattctcctgcctcagcctccccagtagctgggaccacaggcgcctgccaccacgcctggctaatttttgtatttttagtagagatggggttttgctgatggggtttcgctgtgttggccaggctggtctcaaactcctgacctcaagtgatctgcctgccttggcctcccaaagtgctgggattataagcatgagccactgcgcccagctaatgatttttaataactttatataatactgataaatcactcttttttttttttttttttaagacagagtcttgctctgtcacccaggctagagtgcagtggctcgatctcggctcactgcaagctctgcctcctgggttcaccccattctcctgcctcagcctcccaagcagctgggactacaatgcctggctaatttttttgtattttttttagtagagacggggtttcaccatgttaaccaggatggtctcgatctcctgaccttgtgatccgcccgtctcggcctcccaaagtgctgggattacaggcgtgagccaccgcgcctggcctaaatcactctttttagtggactctaaataccactgtgatttgataccccttttattcatttataaaaatacataaacagcttccttttttgatgtttaaaaattttatagtcctttctgtcttgaatttgcatttctgttatacttttcacaccagattctattcttatatgatgtattttatgcataagttatattttgcctgtaacatgcatacattatgaaggtagtatatttttatgcattacagtctttcatgcatattgattaccctattatatgtctttgcagccagccaaaatgtgtaaattttaaaatatctcttagtcattaaattgtaattagcacacggtaaaataacaaatgtattaaaatgttgctaaattattttttatttattaaaaaaattttttttctccttctctgccttcaaaatgttgcttctctgccttcaaaatgttggtacattattaaacagaagaaaataggccaggtgcagtggctcgcacctgtaatcctagtactttgggaggacaaggtgggcggatcacttgaggtgaggagttggtgaccagcctggccaacgtggtgaaacttcgtttctacttaaaatacgaaaattagccgggcgtgggggtgcatgcctgtagtcccagctattttggggactgaggcacgagaattgcttgaacccagcaggcagaggttgcggtgagccacaatcatgccactgtacttcagcctgggtgacagagtgaaactctgtctcaaaaaaaaaaataaaaaaaaaaaagtttcacagacaaaatatgaatcattccttgtttaacacttaaaaggtttttatactcaggcaatagaatagtgtatagtttcattcacaataggtgaggagtatgtcatcctttttatattaataaaaagtgagaggagcccagatggccgaataggaacagctccggtctacagctcccagcgtgagcgatgcagaagacgggtgatttctgcatttccatctgaggtactgggttcatctcactagagagtgccagacagtgggcgcaggtcagtgcgtgcagcgcaccgtgcatgagccgaagcagggcgaggcattgcctcactcgggaagcacaaggggtcagggagttccctttcctagtcaaagaaaggggtgacagatggcacctggaaaatcgggtcattcccacccgaatactgcacttttccgacgggcttaaaaaacggcacaccaggagattatatcctgcacctggctcggagggtcctacgcccacggagtcttgctgattgctagcacagcagtctcagatcaaactgcaaggcggcagcgaggctgggagaggggcgcccgccattgcccaggcttgcttagctaaacaaagcagccgggaagctccaactgggtggagcccaccacagctcaaggaggccttcctgcctctgtaggttgcacctctgggggcagggcacagacaaacaaaaagacagcagtaacctctgcagacttatatgtccctgtctgacagctttgaagagagcagtggttctcccagcacgcagctggagatctgagaacgggcagactgcctcctcaagtgggtccctgacccctgacccctgagcagcctaactgggaggcaccccccagtaggagcagactgacaactcacatggccgggtactcctctgagacaaaacttccagaggaacgatcagacagcagcattcgcggttcacgaaaaaccactgttctgcagccaccgctgctgatacccaggcaaacagggtctggagtggacctctagcaaactccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagagcagaaaaactggaaactctaaaaagcagagcacctctcctcctccaaaggatcgcagttcctcaccagcaatggaacaaagctggacggagaatgactttgacgagttgaaagaagaaggcttcagacgatcaaactacgagctacgggaggaaattcaaaccaaaggcaaagaagttaaaaactttgaaaaaaatttaaacgaatgtataactagaataaccaatacagagaagtgcttaaaggagctgatggagctgaaagccaaggcccgagaactacgtgaagaatgcagaagcctcaggagccgatgtgatcaactggaagaaagggtatcagcaatggaagatgaaatgagtgaaatgaagcgagaagggaagtttagagaaaaaagaataaaaagaaacaatcaaagcttccaagaaatatgggactatgtgaaaagaccaaatctacgtctgattggtgtacctgaaagtgacggggagaatggaaccaagttggaaaacactctgcaggatattatccaggagaacttctgcaatctagcaaggcagccaacattcagattcaggaaatacagagaacgccacaaagatactccttgagaagaccaacaccaagacacataattgtcagattcaccaaagttgaaatgaaggaaaaaatgttaagggcagccagagagaaaggtcgggttacccacaaagggaagcccatcagactaacagcggatctctcggcaaaaactctacaagccagaagagagtgggggccaatattcaacattcttaaagaaaagaattttcaacacagaatttcatatccagccgaactaagcttcataagtgaaggagaaataaaatactttacagacaagcaaatgctaagagattttgtcaccaccaggcctgccctaaaagagctcctgaaggaagcactaaacaaggaaaggaacaaccggtaccagctgctgcaaaatcatgccaaaatgtaaagaccatcaagactaggaagaaactgcatcaactaacgagcaaaataaccagctaacatcataatgacaggttcaaattcacacataacaatattaactttaaatgtaaatggactaaatgctccaattaaaagacacagactggcaaattggataaagagtcaagacccatcagtgtgttgtattcaggaaactcatctcacatgcagagacacacataggctcaaaataaaaggatggaggaagatctaccaagcgaatggaaaacaaaaaaaggcagggcttgcaatcctagtctctgataaaacagactttaaaccaacaaagatcaaaagagacaaagaaggccattacataatggtaaagggatcaattcaacaagaagagctaactatcctaaatatatatgcacccaatacagaagcacccagattcataaagcaagtcctgagtgacctacaaagagacttagactcccacacattaataatgggagactttaacaccccactatcaacattagacagatcaatgagacagaaagtcaacaaggatacccaggaattgaactcagctctgcaccaagcagacctaatagacatctacagaactctccaccgcaaatcaatagaatatacatttttttcagcaccacaccacacctattccaaaattgaacacatagttggaagtaaagctctcctcagcaaatgtaaaagaacagaaattataacaaactgtctctcagaccacagtgcaatcaaactagaactcaggattaagaaactcactcaaaaccgctcaactacatggaaactgaacaacctgctcctgaatgactactgggtacataacgaaatgaaggcagaaataaagatgttctttgaaaccaacgagaacaaagacacaacataccagaatctctgggacacattcaaaatagtgtgtagagggaaatttatagcactaaatgcccacaagagaaagcaggaaagatccaaaatttacaccctaacatcacaattaaaagaactagaaaagcaagagcaaacacattcaaaagctagcagaaggcaagaaataactaaaatcagagcagaactgaaggaaatagagacacaaaaaaccgttcaaaaaattaatgaatccaggagctggttttttgaaaggatcaacaaaattgatagaccactagcaagactaataaagaaaaaaagaaagaagaatcaaatagacgcaataaaaaatgataaaggggatatcaccactgatcccacagaaatacaaactaccatcagagaatactacaaatacctctacgcaaataaagtagaaaatctagaagaaatggataaattccttgatacatacaccctcccaagactaaaccaggaagaagttgaatctctgaacagaccaataacaggctctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcatcctgataccaaagcctggcagagacacaaccaaaaaagagaattttagaccaatacccttgatgaacattaatgcaaaaatcctcaataaaatactggcaaaccgaatccagcagcacatcaaaaagcttatccaccatgatcaagtgggcttcatccctggatgcaaggctggttcaacatacgcaaatcaataaatgtaatccagcatataaacagaaccaaaaacaaaaaccacatgattatctcagtagatgcagaaaaggcctttaacaaaatttaacaacccttcatgctaaaaattctcaataaattaggtattgatgggacatatctcaaaataataagagctatctatgacaaacccatagccagtatcatactgaatgggcaaaaactggaagcattccctttgaaaactggcacaagacagggatgccctctctcaccactcctattcaacatagtgttggaagttctggccagggcaatcaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcatttttatacaccaataacagacaaacagagagccaaatcatgagtgaactcccattcacaattgcttcaaagagaataaaatacctaggaatccaccttacaagggatgtgaaggacctcttcaaggagaactacaaaccactgctcaatgaaataaaagaggatacaaacaaatggaagaacattccatgctcatgggtaggaagaatcaatatcgtgaaaatggccatactgcccaaggtaatttagagatttaatgccatccccatcaagctaccaatgagtttcttcacagaattggaaaaaactactttaaagttcatatggaaccaaaaaagagctcacatcgccaagtcaatcttaagccaaaagaacaaagctggaggcatcacgctacctgacttcaaactatactacaaggctacagtaaccaaaacagcatggtactggtaccaaaacagagatatagatcaatggaacagaacagagccctcagaaataacgccgcatatctacaactatctgatctttgacaaacctgagaaaaacaagcaatggggaaaggattccctgtttaataaatggtgctgggaaaactggctagccatatggagaaagctgaaactggatcccttccttacaccttatacaaaaatcaattcaagatggattaaagacttaaacgttagacctaaaaccataaaaaccctagaggaaaacctaggcattactattcaggacataggcatgggcaaggacttcatgactaaaacaccaaaagcaatggcaacaaaagccaaaattgacgaattaaactaaagagcttctgcacagcaaaagaaactaccatcagagtgaacaggcaacccacaaaatgggagaaaatttttgcaacctactcatctgacaaagggctaatatccagaatctacaatgaactcaaacaaatttacaagaaaaaacaaacaaccccatcaaaaagtgggtgaaggacatgaacagacacttctcaaaagaagacatttatgcagccaagaaacacatgaaaaaatgctcaccatcactggccatcagagaaatgcaaatcaaaaccacagtgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtgtatacccaaaggactataaatcatgctgctataaagacacatgcacacgtttgtttattgcggcgctattaacaatagcaaagacttggaaccaacccaaatgtccaacaatgatagactggattaagaaaatgtggcacatatacactatggaatactatgcagccataaaaaatgatgagtttatgtcctttttagggacatggatgaaattggaaatcatcattctcagtaaactatcacaagaacaaaaaaccaaacaccgcatattctcactcataggtgggaattgaacaatgagaacacatggacacaggaaggggaacatcacactctggggactgttgtggggtggggggaggggggagcgatagcattgggagatatacctaatgctagatgacgagttagtgggtgcagcacaccagcatgtcacatgcatacatatgcaactaacctgcacaatgtgcacatgtaccctaaaacttaaagtataataataaaaaaataaaaataaataaaaagtgaattttaggccattttctgttacttagaatacctgaaactgggtattttataagaaaaggaatttatttcttacagttatggaggttgagaagtccaaggtcaaagggctgcacttggtgagaaccttcttgctgatagtgactctacagattcctgaggtggtgcagggtatcacatggcaaggggcctgaacctgctaatggtagctcaggtctcttctcttcttttaaagccaccagctcccctcccatgataacccattaatccatgaatggattaatccatttatgaaggtggagctctcatgatccaattacttcttaaaggccccagctctcaatattgccccgttggggattaaatttcaacatgagatttgaggggggtcaaatattcaaaccatagcagtgggtttaaaggtacttgtgaaagaggagaccagagaggaaaatcaacatgacctttcaaatggacctatgatccattttcaggcagattaattttaaattttatgaaagggttgagtatgaatgagaattgaagacctgggaattgttgtccattgttgtttatctatttctgtgtacccttcagaaagtctgtttaccttcagcagtacaaatatatggtactgtgaaagatccctgatctagtatttatagcaacctgtattttatgaccagagaaactgagacttaaagatgtagagtacttgcctatggtcacttagctagtaaatggtcaatcaaaaactccaaaacttgaggccgggtacggtgactcatgccagtaatcccagcaatttgggaggctgaggtggttggatcacttgtggtcaggagttccagagcagcctggccaacatgttaaaaccccttctctactaaaaatacaaaaattagccaggcatggtggtgcgtgcctgtaatcccagcttctggggaggctgagacaggagaatcgcttgaacaggttgcactgagtcaagatcgtgccactgcactccagccttggtgacagagtgagactctatctcaacaaataaacaaacaaacaaaaaacacacaaaccctccaaagcttttctttccctcctgtgtcatgctacttagtacatagcctggttcacagtatatgattactatatatttaatgaatgatttacatattatttgtgaagtccaaaatacttaacgttgtagttgttccatcagttttgaactgctgaataagtgtgacattacagatgattcactacagaagaatattgaagatcttcaaagcattgttaaggtgatctcctttcagttcctggagtggtgttcctggaaatgactaatagaacagcaaaaaaccgtctacttgggcattcttggtgttttatcaattaagtcagagacctataacagtgttggagtgcttgttttgaagaggtcagctaacttacgttgacactgtgtgtgtatgaagagtgtaattttcgtttctgttatacaggtattctctgaaaccaaatgaccaaatcttggctgaagacaaacacaaggaactgtaagtgcattaaaccattggttgtaaatagtttactctgtctatgaacttgatatatgtatatgtaaattatctgattttcaaaattatataatgacaaagtataattaacactatgaccttaatcctaacaattatgataacctacactatataatttacactacataaagtttacacaggacataatttctcctgtattcacattaaaagatgtagtgttgtattccatcatctagactaaagtcttactgggaaatatgtcatgctattttctctttccagataaaatattaaattgttcctattttctttctgactgctctaccagaaaaaagtaaaaaataaaaataaattgtcactcttaatttttgggtcttactccggtggatcacccaccttcatggtaatgatagacaaatataattttgtttctgtcactggtttatgcaaaagtaaatgtcaattgtttggtacaaggtaaaacactttattttatttttatttttttgaaacagagtcttgttctgctgcccaggctggaggcgcaatctcggctcattgcaacctctcattcctgggttcaagcaattcccctgccttagcctcccaggtagctgggattacaggtgcccgccaccatgcctggctaaattttgtattttaagtagagatggggttttgccatgttggccaggctggtctcagactcctgacctcaggtgatctgcctgccttggcctcccaaagtgctgggattacaggtgtgagccactatgcctggctgaagacattttattttcacatctaactcaggtcgctcttggtttagtttaatgtaaccttcacttgtactcatttatagggacagtaattttttttcgtagaggacttcaagactattattttcttcttgagattaagtaataatttttttccaagtacttttaaactgctttttaaaaactgtcttgaaccttttgtaaattattttcttctctcctatttaaggtaacataaattgttaattataaaatggcaggaccaatgttcagggaaaggattttcttatgcgttcttaccgtttacacattccactattatgctaacctttcatcagtatttttatatttggcctatccttatttgagtataatctccatagtgggttctcaaatatatatattgtcaagaaatttttttgctctttctttatttcctagtatagtcagtgagggccggtgattgttactgtagcattggttggttattatttataggtctggtaacagagcttcttttgctttgggaattaagtagttggtgagccttaaaagttcctttagtccttagactatgaccaatattaaaaataccagaaatctgcttttaaagaatatgttatttaatatgtaacccattttaatgttttaattcatttgaaagtttttttaactgtccaagatataattcatctctatgggtataacttggcgaactgatacttttttcttacctttttttttgtttttttgagacagactcttgctccgtcacctaggctggagtgtggtggcatgatcttggctcactgcaacctctgcttcctgggttcaagcgattctcctgcctcagcgtcctgagtagcagggattacaggcacccgccaccatgcccagctaatttttatattttagtagagatggggtttcgccatgttggccaggctggtcttgaattcctgacctcaagcgatccacccacctcagcctcccaaagtgctgggattatcacaggcttgagccaccgtgcccagcccctacattttattacgaaaagttttaaacatatgttatgtgttcacccatatatttaccaccaaggttttatcattaacatattactgcacttgttttatctatttattcttctgttcgtgcattacttcatctgttttttggatgcatttcgaagtaaattgtagacatcaatatgcttctctctaaatatttcaacacatataccattaactagagttttatatttcaaagttttttttttttagtttcacctgttctaaaatttcttataaactgagtcatatatatgtcctattttgtataaggcttctgtcactccctgtgtttttgaaattcatcagtgttgttgcatatatcagttaattccttttcatttttgcagattaacattctgttgtttatttgttctattattgctaagtattgccacttgtttgatttgtcattattgatggtcttgatatttttggctgctggctctcttccttgtagtttttgacctacataccaaagaaaactttcagttgaatatggcaccataaaagcagagtattaattttaaaaaattaaaacagttattgaattaatgaatttcatgaattatgaaagctgtttataaataatctcatttgtgtctttgcaactcaaatagccaaaatcttggtagggtggtggtcatggaagtcagagtctgctaaggagtgtataacaactcacctgctgtattaaaaacaaaaaaatctttttgtgttcaagactaagctttaaacaatataagagatatggatataaaacaaaattttatctaatcagtaattccatgctttattctcataaaacattattacaacttcttaatttcagtctgttaaagcttgattaattataaaattgtaaaaatgtgttggcaccatcacattgacctgctctttgaaaattaaccctaattctataagagtaccaataagagagtacagtgatagctctaattatcttgatattaataaataaagagtggcctggcatggtggttcacatgtgtaatcccaacactttgagaggctgaggtggaaggattgcttgaggccagcagtacaagaccagcctgggaaacatagtgagaccccatctctacgaaaaacttaaaaaaggccgggcacggtggctcacgcctgtaatcccagcactttgggaggccgaggtgggtggatcacctgaggtcaggagttcaagaccagcctggccaagatggtgaaaccctgtctctactaaaaatacaaaaattagccaggcatggttgtgggtgcctgtaatcccagctactcaggaggctgaggcaggagaattgcttgaatctgggaggaaaagttgcagtgagccaagatcacgctactgcactccagcctgggtgacagggcgagactctgtctcaaaaaaaagaaaaaaaaattagcctgatgaggtggtgtgtgcctgcagtcccagctgctcaggaagctgaggcaggtagatctcttgggcctaggagatcaaggctgcagtgaaccatgatcattccactgagctctggactggacagcagagtgagaccttgcctttaaaaaaataaaaaaagaataccaataagagagtacaatgatagttctaattatcttgatattaatgaatattaagtatgttttcattaaaacatttttagttcctgaaattttgtgattcagatttcatatacacttagtcactgatgcttcacgagtatacttgtttctctgtctgaggaagattggcatgggaaaacagggaaatattggtcagcagtgacacttgtttttctaagcaaagtggtttttctcaacttcctgtttttcattattctacatactgaagaccttgggggatgattttaagtagagaaagctgagcaattcaagttgtgatgtgatttatctaaaactataggatttatagtttgttctatacatgatccagtaatcaactggtttcattagctttctagtttttttcagttttagttttgtaaatggaataatttaaaataaattaggaaaacatcactattttactaagtattttttcacctactttccattgtgctaggcattaaagaaaagatagtgtgcagctttttatatgtcaattatacttcaataaagcggtttaagaaaaagtaaaagatactgattttatttataaatggaatcttactctccaatagtggcttttcaaaatctttggacacatctgcagttattgaaaatagaaccattttgtttccatgaatatctattttatgaatatataaattttgtattaccttggattatgagatctgatcatatagatttaggtaaggaaagttaaaagttgtctggagttaggggtgaattccaaatgcaaatataaataaattcagaagtatccatactacttaacacagagtaacctggtatctgaagattttttttttgtttgctataaggcaaggggaaaatctctttaaaagggattcacatttatttacttggctttttaagatagctaccaaggtaaacagtgaacttttgtaagcagtgtatactgttctaaatatgaagtgtattttcccttctgatagtgaatgaattccattatgattttttaatgtcaaaaattaaattattttgtcagaataaccccttaaatttttaaatgttgtcttataaaagttaattatattgtgatatttaaatgcttgccaatttacgattatgatgagatggaagaaaataaataaattatgcaataggcatgaaccttcaagggtattaggacgtgctcaggatatgatctttggtgcagtgtaaaaatgtaatttcttagtgaataggtcaatttccaaaccagcaggaaagttataagtatttaaatggaatgtgtagggatatgtcagggaagttagagacaataacatctggtatgctttttttttttttttttttttggtgagatggagtctcgctctgtcgcccaggctggagtgcagtggcgtgatctcggctcactgcaagctccgcctcctgggttcacgccattctcctgcctcagcctccagagtagctgggactacaggcgcccaccaccacgcccggctaattttttgtattcctagtagagaaagggttttgccgtgttagccaggatggtcttgatctcctgacctcgtgatctgcccgtcttggcctcccaaagtgctgggattacgggcgtgagccaccgcgcccggtctggtatgctcttaaattaattgttaatgctgtgacttagcagttctttgaaatcatcaagatcatagactgggcttgtgcctataatcccagcactttgggaggctgaggcaggaggattgcttgagtctacgagttggagaccagcctggacaatatagtgagactcttgtctctacaaaaagttaacaaaagtagccggatgtggtggtgcctgcctgtagtcccagctacttgggagactgaggtgggaggattgcttgagaccaggaggtccaggctgcagtgagctatgatccgtgccactgtgctccagcctgggtgacagaatgagaccctgttaaaagaatcttttttttttttttttttggtaagaatgagctaagaactggatatctgtaaagctaatagaaaaaaatcctgtgaagcaaaaagtcaaaattgaaataagctaggaccgacagcaaggttaaatgcttatttttttttagtgttcataaataaggtacagttttaaaaatatcataaacatttttatgatcctattctcagggcccggttttttttgtatctttaaaattatagtattttgattctagaaatgaacccttgaaccaatatccgtattttatcatgaataaggtgagagtaacattgataaaatgacttgctatagtttacattgctacttaaggacagtactagaccagaaaccaagtctcctgagtcccatttaagtgctgtttttgtcacaccaagcagttctctaagtatatagtcttttttttttttttgaaacagggtctcgctttgtcacccaggctagaaaacagttgcatgatcatggctcactacagtcttgtttttagagatgaggtctccttatgttgctcaggttggtctcaaactcctgacctcaagcagtcctcctgcctctgctcccaaagtgttatgattacaggcatgatctactgcacccagccagtaacttttttttttttttttgagacggagtctcactctgttgccaggctggagtacagtggcgcgatcttggctcactgcaatctccgcctcccaggttcaagtgattcccctgcctcagcctcctgagtagctgggactacaggtgcctgccaccacgtctggctaatttttatatttttagtagagacagggtttcaccatattggtcaggctggtctcaaactcctgacctcaggtgatccgcctgcctcagcctcccaaagtgctgggattataggcgtgagccaccgcgcctggccgccagtaatttttttttttaaagggattaatatccattgcaagacttggtaacggatcacagagaactcattagttaattaaatcagtttcacagtattgtgttttggttttggaaatcacttcagacctataaccaatattgagtgagttgaaaagaattaattacttccaaatacaaggcactttacattcttctaaggagaggatgcaacacaaagctatttggtcagcttgatacaaaagctcttaggtgtgctcatgaagtaagtcaaatgtatacattttacaaccacatattaaatagaattagttttttctttttccttcccatttctttgaacagtcttattcagaatcttcatcattagcaactttgtcatcattggagcccttttctctagaacacatcagcctctttctatgtatgatattttcgctggaaattttatcctgagctataaatgcctctcatgtaagaaaagttttttttttgttttttttttgagacaagatctaactctgttgcccaggttggagtgcagtggcgtgatcatgactcactgcagccttgaccttgtgggcttaagcaatcctcccatcagcctcctgagtatctgggactaccactgtgcaccaccacacctggctaatttttgtattttttgttgagatggggtcttgccatgttgtccaggctggtcttgagctcctgggctcaagtgatatgtctgccttggcctcccaaagggctgggattacaggtgtgagccaccatgcctggccaagaaaagttttttttaaagtttatttttgtatgtagtcataatacttgtaaggtaaccttttcactgtattgctttttaaactaaggtttaaatagttcattgtaataagagttaccgtttgtgcttataaggctgcatctccaggagtaagtactaaatctgtgttagatttctttgctgcttttttttgtttgtctttttttttttcttttactgatatggtcaggtggtcaggttacttccgtaaggatccaaaactagagttgattgagatcatttcaggcttatacataatctacaaatgattctcaaccaattgagatctgagttcacctcttttgctgaacttttaattgtgatcttactgtaaaattctaggatctcataacttctatgaaatttttatacctggattataaaacttcggaaagatttgcttaaatattttgttgcttaaaagaaaataattggccgagtgtggtagctcacgcctgtagtcccagcattttgggaggctgaggcaggtagatcagttgagctcaggagtttgaaaccagccttggcaacgtggcgaaaccctgtctctactaaaagtataaaaaaaattagctgggcatggtggcactcacctgcagtcccagctactcaggaggctgaggtgagaggattgcttgagcccaggaagttgaggctgcagtgagcaaagattgcacaactgcactccagcctgggcaatagagtgagaacccgtctcaaaaaacaaacaaacaacccccccgcaccccccccccccaaaaaaaaacaaacagaaaataattaacactgtcatcaaggaaggtaactcattataaggatttaaaaaaaaaatttttttttgagacggagtcttgctctgtcacccaggctgaagtgcagtggcacaatcttagctcactgcaagctccacctcccgggttcacgccattctcctgcctcagcttcccaagtagctgggactataggcgcacgccgccacacccggctgatttttctatttttagtagaggcagggtttcactgtgttggtgaggctagtctcgaactcctgacctcgtgatccacccgccttgccctcccaaagtgctgagattacaggcgtaagccaccgcgtctggcctataaggaataattttgtgattaaacatggtcttatattcatgaacgataggtgaatgaaaaatgtgtgttattggtggtaaaatcttaaaatccttaaagaattaatttaaattgctaccttctacttatgaagcactatatggtgccctggacttagcattagaagaaacttagtttatgtatgagttttgccataggctgtagtcttggggtattagttagaattcaatgccactatgatattaagaaatttattacaggaattaaatcttattcaatcatgagaaaaactggggatattaaggtccctaaaatgtgagagaaaaatcgctaaactgccttttgatgtaggttaatgaattgcgtgttctgttaatagggaaactgtgaaggaggttcgtgtgttgtgggctctttgcaactaccacctttatgggcctttagtgaaaaatctggtgataggcttggtcctggtagttgtggacgtaaggtagagtggggatgagtaaggacagattacagttctgcccatacctttgtgtctgtccttcctgcctctaaccaatgactgcctttggaatgtaatggctactgcttcaattgcatcccctaaattttttgcaaatttctcttgtgacatatcttaagctgaaaccatataggagaggaaattaggggaagtgtactccttcttgacatagtttaataccttaactttgtttaatcacttagtcttccaaacttaagttcctccgatatcattttgggtttagattagtgcttttctgtcattgtccattaaacaaatgatttctttcattacctacttctcttttagtctgttcagtgatccctctgggtatagcttctgaatttctagcataaaactcttcaacaataacaaaaaaggataatgatctttcctgtcaatttttagggggaaggataaggtgtttcctagaaactttattcagagcactttagtcaaagtgtagttcattgatccttaactgcaatttacttgacaagatatatttatgggatgaaatttattgagggtaacagaatggagagagaaactgctggtgtgatgaattctctttcttcttggtctacaacaaacagaaatattttgagaatgtagctatggcagattttaatgtaagagttatgccaacactatttccccttaagggttgagtcagaccttttgggaatgatatagacttgggggtcttgagtgaacttttagtatttattagcagccaatctaaccttgaaaactctatgttgatttctttttggaaagtgttgaacaattaaataatacatgttaaagaacaaggaagaagggcattgttttaattattttgtgatctaatttaatccccacagcaactctgtgaagcagatattgtaatcattcccattttacagatgaggaagagacttcgtaacttggtttatataagaaaaggatagaactgtttagatctttttgattgctttccattttgtataagttcagtgacttaggaaccttttttaaaaaacttctttggaggagtgatattgttcattatgaacatacctacttgaaaagtatttaaaggtatttttcatggaaattatattttataagttttagtatggttcactagaaatacgtcacaatttgtaggtaatactgtgttttattttgagttggctaattgttaaggtaaaactttagaggataaagtgagctcatattgatgaatggtaatctgatatttccaacagactaggtctttttttgaagttcatgtattataactttattctttgtgatactagctccctctgtagaacttcaataagattgcaactggactttttcaataatttagaaaagtgatctaaacattatctataacatttccctgtaaaattttactttgtattctaatcagttgcaagtgggtttttaaaagtataaatgtaacatttataaaaatgtttcactttgtacacacaaagttttaataacatatacaaaataaaactttcttcaaacattcctataactttaatgcttttttatttaggaaggctagagagaggtgtgatttctaggtctgtaggtctgtgttgagtaaagcctgatggaagccctaggggaaaaataaattttgacgtttagctggatacttgaaattatcccttttttttttttttttctgaaactttccggtttgacttgggtgggaaaatgttcataagggattttttttttttatcttgtagagaaggggaaagcaaacttctacaacaggtagaaagagcaaagagaaaatcttagcaagatccagaaatttagtggagaattgcaggaaaacattcttgacatttacggtttaaaaaaattttcctttttctttttttcttaagaggtggtctcactctgtcgcctagactggagttgagtggcatgatcatagtgatcgttccacctcagcctcctaagtagctgggactacaggtatgtgccaccacgcctggctcctttttgtatttttagtagagatggggttttgccatgttgcccaggctggtcttgagctcctggactcaagtggtctgcctacctcagcctcccaaagtgttaggattacgggcgtgagccactgcaccctgctcacatatatgagttctatgagtttatgctgttgttggaaaatcctttgttatcaaagtctaccaattttcctgtgtgggagtgagcttacttattttaccaccactttttctcctttctttctgctatggtttgaatgtttgtcccctccaaaactaatgttgaaatttaattgccattgtaacagtaataagaggtggaggcctttaagaggtgattagatcatggggctctaccttcatgagtgcattaatgcaggagtgggttagttatctcttagagggttgttataaagtgagtctggcccctcaagcacttgcttgctgtttgccttctgccatgggataatgcagcaagaagttgctgagcagaagctggcaccatactctaggacttcccagccttcagaactgagaaacatattaatgtttctttcctttataaattacccaatctcaggtttctgttaaaagccgtagcaatcaaactaagacactcccctaaaccattttatattaaattgtaagttgtataattagctcttcaaagatgttttctcagacataatgtaagctcaatgaaggcagaggaaatatgattgacttgcaacatggaatttagaaaaatgagcgaactgatttcaaccataaagctagggactaaaacatacaaatgaggataagaaagaactgaagtacatatgctctttcagtttctaaaaatttaactgtattttcttctaagtagattgaaggatgttcttaggattatgcttgagtaggcttttaaacaattttgtgtggataattatctttgaagcctttgttagtactaaacatctttattctgttataatacagtttattcaaacagacgtacagtgtgtattgtggcacaaagaaattcaagaatgattcttattctttttgtttgttggccttgactaaatttgataccagataattgctttaaaggataggccaattttattggtataacaaatctacccttcattatccataaaccacttatatagtaatctggttttcctatacaggcacaccttggagatattgggggtttggttctagactatcacaataaagtgaatatcacaataaagagaaatacatgaagattatattccccagtgcatataaaagttgtggtgatatcacactgtaatctattgtatacaataacattgtgtataaaaaatgtatatgccttaatttaatgtaatctattgtatacaataacattgtatataaaaatgtatattccttaatccataaaaatactttatggatgaaaatgctaacaatcatctgagcctttagcaagttacaatcattttgctggtggagggtcttgcctcagtgttgatggctactgactgatcaggatgttggttgctgaaggttggagtgtctgtggcaatttcttaaaataagacaataatgaagtttgctgtgtcagagccttcctttcatgaaaaatttctctgtaatatgcaatgctgtctgatagcatgttacccacagtagaatttggaaaattggagtcagtcctctcaaaccatgctgttactttatcaacttaagtttatggaatattcaaaattctttgttgtcatttcagcagtgttcacagcatcttcaccaggagtacattccatcttaggaaaccactttttttgctcatctataagaagcaactccctgtccattcaagttttatcatgagattgcaacatttcagtatccatcttcaggctccacttccaattctagttctcttgctatttctaccacatctgcagtgacttcttccctgaagtcttgaagcgctcaaagtcatccacaagggctggaattcacttcttccaaactcctgttaatgttgatgttttgacctcctcccatgaatcacgaatgttcttaatggcatctagaatgatgaatacgttgcaggaggttttcattttagtttgtctgatccatcagaggaatcacggtctatggcagctatagtcttgcaaaatatatttcttaaataataagacttgaaagtcaaaattacttcttgatttgggggttgcagaatgaatgttgtattagcagccatgaaaacagcattcatctccttatacatctccatcagagcacttgggtgactgggtgcatcatcaatgagcagaaatattttaaaaggggccaggcatggtggctcatgtctgtaattccaggactttgggagactgaggcaggcagatcacctgaggtcgggagttcgagaccagcctgaccaacagggagaaaccccgtctctactaagaatagaaaattaggtgtggcagtgcatgcctgtaatcccagctactcgggaggctgaggtaggagaatcgcttgaacccaggaggcggaggtcatggtgagccaagattgcaccattgcactccagcctgggcaacaagagtgaaactccatctcaaaaaaataaaagcctagcctcccaaagtgccaggattacaggcatgagccaccgcgcctgtctgtccgcccgtcttcttttttaagagcaagaaaaggtttcccagaagtactctggtagattcttatcacacacacattcctaaaccagttactggcaaagaaaatagaattatcatgattaattagcatattctgaagtacatgcttccttataactgaacaaaaattagagctccactggcaacgcggaaatggctgttgacttggcaactaatagtgaattgctcacaatgtttaagtgaaatggcctgtcagatttcctgggaacacaggaaccagggccagacttagaaacggcctcagtaagaggttttctaaaactattttctggtatcgtaattattcctaattaccttgtgcactaaaaaaatttaaaaattttaaatttagaattttaaacacatttcctgacagtaaccaagatataaaaatgtgtaaaattgagtgaatatattttaaagcatggaagatttgtgttaccctcagacttgaaagggaacctgcaaagttatggtctcatgggaaatattgtttctttttgccttgacataattttcaggctctttggttttattctaagcaacccagcagggcacctttaaaaagaaacaaacaaaattactgtctctaaaccaaagaagatagaaaaatacattcaggagaatagtatacattgaaaactgccactttagctagtgcttttttttttttttttttttttttaagacggagtctcgctctgttccaggctggagtgtagtggtgcgatctcagctcactgcaacctccaccttccagtttcaaatgatacttatgcctcagcctcctgagtagctgggattacaggggccagccaccatgcccagctaattttttcatatttttagtagagagtactttttaactgagaagagatgctgtaaagttttaggaaatcacagtggggacagtagtcatacttctactttcttctgaatataatattgtttcttttttctcctgcagttacttattttttttttctttttgctttaaggcttggtagttctgagaattttagattcagttataatcgaatgtaactatcaacacatgttatggagtagtataaattgttacttgatgtttggagttgttttactcagtcactcagcaaaggtaagattagatctccgttagatgaaaagtattatctcttatgcaaagagacattggttagctctggatgaagacaatggctatggggtcagtcaaccttgtagaaagaataggctaggcacagtggctcatgcctgtaatcccaccactttggggtggtcgaagccagtggatcacttgagcccagcagttcgagaccaaactcggcaacatagtgagagccccctctctacaaaaaatttgaaaattagccagggcatggtggtgtgtacctctggtactagctatcaggaggctgaggtgggaggatctcttgacctggggaggttgagtctgcatgcagtgagccatgattgcgccactggactccagcctgggtgagaaagtgagaccttgtctcaaaaaaaaaaaaaaaaaaaaaaaaaagacacaataaaagtaaaattgtataatctctggaaaaaacaaaataggctgtcatgttctaatactcaatatgtaaggatgtttagtatattagtgggtataattattaataaaatattctatttagttatctttgaaccagtttgtaataaccaaaccacaaaaattcaatttgctttgtatgtaaaaatcttttaaaatagaaagtcctgccttaactttcataaatctgaatgtgagcatatatttatgcttttcatttctttgcacagctttttttttttttcctctaagacagagtctcactctgtcactcaggctggagtatagtggcacgatctgagctcactgcaacctctacctcccaggttcaagtgattcttgtccatcagcctcccaagtagctgggattacaggtgtgcaacaccatacctggttaatttttgtatttttagcagagacagggtttcgccatgttgtccaggctggtgcacagcattttgttgttgatgtgtgagacttgtaatataacagtaataatgctgtcatttcttaaagatgatatataatcctatcaaaatattcctgggaagtaggtatttgtcagcctgtcagtgttttccttttattttgtgtgtgtgtgtgtgtgtgtgtgtgtgtctgtgtgtgtgtgtgttttagtacattctcccagatgctgaaattttccctttaaactgttactatgatgtatgtcttatttctttctcttttttggtcctaattatgctctcaggagttaagacagtataaaattatgttttttaaaggaaacttcatcaaatacttggaaattagcaaatattttttagaggtagaaactgtcatttatattcctaagacttgtaggccattgtatttgttgactgactgatttgactgagaacctagtgtgtgataacgtgtcactgtttctgtcaacttatataattgagggtctttttaattgttcttaccttagaccactatatacttgtggtcttataaagtatatttgaaaattatatgcattttcatgttttgtctgggcctgggaaaaatatttattttaaaactgtaacatcttaacctttaaaacccattgtcagttatttggaaaaattagtattatatgatatgaagcacttctttttattgctgatttcaggtttcactatctgggaaactccggtgtggagacataggtctgttaactgtcttctttgttttatctggaatgttttattgatactataaaacaaaacttatcagtaagactgatttggaattcatattgtttgacagcattatcactgtcaataattatccattgtcagtatttgtaaagcagaataaaagaagccattatttaagtttaattcctgagatgattcagcatacggtgtaatatcaatctgtgggaattttattttaaactttttcttagtaaagtttactttttagagctgttttaggttcattcacagcaaaattgagcaaagatacagagatttcccataatcctcctgccctcacacatgaatagcctcccccattttcagcatcccccaccagagtggtacatttgatacaattgatgaaccaatattgacacatccaaataaaactattttttggggaggggagacggagtctctctctgttgcccaggctggagtgcagtggcgagatctcagctcactgcaacctctatctcccgggttcaagcaattctcttgtctcagcctcctgagtagctgggactacaggcacacgctaccatgaccggcaaatttttgtatttttagtagagacggggtttcaccatattggtcaggctggtttcaaactcctgacctcaagtgatccacccgcctcggcctcccaaagtgctgggattacaggcatgagacactgcgcccagccgataaaactcttagaacaagattaattgattgattgagacaaggccttgctctgtctcccaggctggagtgcagtgatgcaatcatagttcacagcagcctgcagctcctggcctcaagtgatcctcctgcctgagcctcttgagtagttgggactatagcttgtgctactgctcccagaagtctcttatttaatctgtctcttctaaagtatagatgtatagttcatacctttagaaatttctgagtttttatggtggttctgcaaataaacctgtttgcttcttatttctgccttcccttccttctgagcctttggtttttgattttctcttatatgctggttcagctatccttgtttctgttgctttaaagccttcaacatattatgaacattttccaccaaacatattgttcttatgagtacatcgtaattttagggcaagaagcagagatgaactttgctttaactcttttgtgttgaagtatgctaatggcaagcatgttttttaaatataaaagttgtacaagttgagatgtttaattcctttactttaagaaaaagcatcataattagaagggagaattgctgttatctggaaggtgttcagacagtttggggagaaaaaaacaaccaaaacagctgcagtgtaatttccataagggaatgggcttatatctttgtttatttgtgtttgttttccattgtacactcagtgcctagcacggggtaacacagtatgtgattaaccaacagttattggaaaaatatattttagtgtgttattttagataattaaaagtacatttaggaaatatgcaacctttttgtttggctttattaatcagctttaaaatgctgatgatagaagcaggaggcagagaaattataggcaaataggggtgggtccctggtgaaaccccacctccaaggtgaaaagcttgaaaccagcagcccaaagtgagaacttctattcctgtttgcctgcactgtcctgattggttctttctgaataatgtctttttaccaattgaatgttgccttttccaaagctacctatggcctgccccacccgcatcctgtgcctgtaaagccccggactcagtaggtagagaggagagattctgccagactttcgggaaaagagatggcttgacttcggggaagagactactgctgtacttcagggaagaccacctactcttcccgtcccctctccagctcccctctccactgagagccatttccaccgctcagtaaaattctccaccttcaccatccttcaagtgtctgcatcacttccttcttcttggatactggacaagaactcagaacccacggagtgcaggtacccaaaaaggctgtcatactggccctttgccctcgctggcggagggcagccaccccacgcaatgtggtaagggaccaactgagctgttaacatgcacacagacagacggcagagctaaaagaccactgtaacactttctctggggttttggggtcgtgggcaccctcacctgggtgctgctgtgggacctgcatggagctttctctcgctggctcctggagcagccggccaggtcctgcactctcttgctaacatgctccctcctgcagggggttgagcgctgtggcgtgagtaaactgtcgcccttgttgcaagtccaatgaagggaccaagaaaaatcctgcatcactgatatgaaatgtaccaaattaagtaacatcatcttatttcttctgattttgttttcagtttgtttatattcctttccataggtattatgtgtctgttttagttcataaaattgtggcctaatttatattttgaccattattcagcacactgttagtactcaggactaatttcagttgcttatttagacacatcgaaataaatcacattttaaggctgggcgcagtggctcctgcctgtaatcccagcactttgggaggttgaggccaggagttcgagaccagcctgggcaatatggtgaaatcccgtctctactaacaatacaaaagttagctgggcatggtggtgcacacttgtggtcccagctacttgggactctgaggcacggaaatcgcttgaacccaggagtcagaggttgcagtgagccatcacgccacactgcattccagcctgagtgagattacgtctcaaaaaaaattttttttaaacataaataaagaccacactatcttttttgaagattatgttcacatttcattctctccattgaactgtatagatgtattacctgtatataaagaatgtaaatttttttgtattaaaaatcgacaccttaaaaaaaaactaataccaccacaaggttaagctctgaggagatttcagctttacaataattacattgttacaataatgtttaacttctcaataattaaaaaccaaagcaatgttgcaaccttggttcaatattcaaatatatttttcttggtaaccaagctacttcactatttatagtactttataaatgatttagaattgttatgcagttttttcaaagaagtattcataaggtaaatttagaaaattattttaaaacgaaagtgatgcccaccagatggtgctatttcgcctgttttatctgcgacaataagtaggaaaaatgaatatagaacttcaaaaaagtgtatggaagatctagaatatttgggcattgtattttgggtgtagatgagctcagtggaaggaagcattcaaatattctaaacttgtgtttagtactgtatgtttatcttgataaaggtaaagatgaattcccagagttaatatgccagataaccttttatttagtctaaatgttaagtagattttttgaaaagttgacctatatgcaaattttattaacttcatagctgtatatgcatgaaaaatgaaattatttattagatatgtgttaccaaaatttgtttcaagatttctttatattgttaagtaaacaatattactatctcatttgagttacattgtgatttacaaattaagggaaacattttgatttttttatgtgtttgtaattattacccagaaacttaggcttgaattcactatttttacaaaggaaagagatgactcttctaaattaatttttgtattaggaagagggcaaactatgtggtacagtgttcacttagatgcagccattgaatgacgatccattagagtcaaaatggttagttagctaatgaaatacacttttcagtaaagctggaaagatttagccagctcttaaaagtgtttctaggattttaatgtagtctttttcccgctgattttattatcactctgtattcttctctggtcatgagattgaaccataaaagtcatgtagatgcttgttataagtatttgccaaagtcatcattgtcagtgattttattggcatgtgtgaaattagagattaaacttgcttttaaatcttgcatttgaatttttcttctggaagggtacatgtataactttcaatttaatgttcaattattggtaacagaatgaagcatctctctataggccagtaaatatatatagtagattttattgtattcctgtactgtttttgaatgaatattttactaattatattaacataatcctcatacatacccttaagattaggacctactataatgctttatttgaacttgtttcatagcatttgtcttttttaactttggattatagttttggaatataaatcagatccctcctacaaaaacataaagttcttcatgctttctctcattccacttatcacaatactttacatgtagtagatgaccctatatattttttatataaatgaatagttttgtcatgccaagtattgatattagtattagtgacaacaagtattcctcattccatagtttttgtttttgttttttttttttttgagacagagtcttactctgtcacccagggtggagtgcagtggcagaatttcagctcactgcaatgtctgcctcccaggttcaagcaattctcctgtgtcagccttcttagtagctgggattacaggcatgcaccatcacgcctggctaatttttgtaattttagtagagatggggtttcaccatattggtcaggctggtcttgaactcctgacctcaggtgatccactcacctcagcctcccaaagtgggattacaggcataagctactgcacctggtctctgttctacagttttttatcttatgcttttctgaaatgactttttatagttgggtttaaaaggatcatctcattggaatctcatatcacagttatgatgcattctgtcatgatgaggataagtgtatattcaggttaaaaaaaatcaaaatattattgtcagcctgcatcagtattagagattgtctggtccaggagttctcagattgtgattcaagggcctcttgtgggaggggggggtcaggggtccttaagaccttgacagaagttctgtgagggcagaactatattcaaagtaatactaagactgtgtttacccttttcattctcattctctcatgagcataggtggagttttctagaggttgcataccatgccatactgattgaatgtacaagttatatgaaactctagcagttctgtcaaaagacaaagttacaacaaatttagtttaaagatctcagtcagctttattgtgattctagaatcaggcaatacttcattccataaagtagagtgtgtgttctaatgagttgagcagatggttggttttatagacagaaagggctgaagaaagcagattggtcatttcaaagtgaattctcttgtaaggtctggatggggagacaggacaatagaaagactggttaatatcaggttacttcagattagggattaaaacagaggaaacttcattatcatgcccattgaatacttcattatcatgtgcattgaatattgaaaattgtcctgtttgggatattaggctgttatctgtctctcctgattttttagaaagtcaagataacaactcagtttgggtttggtgagcatgggtgactccattttgatttttagtctggtcttcttttggagcctagtgtaggagttttgttcaaaacagtggcctataattttggcttcataagccagacattaaagagatttgcaaagattataaaacagtgcttctcttgtcactaagatgttttttagtttggaaatagttattttcataaaatgttacattaacatttaatgaatttattcttaaaataataaatatttaaaaaagttatattttaacttctaatatgataactagggctagatattaaagctccttgaattactcgatactctttttaaagtgtaaagtggtcctgagatgaaagtgtctgagaacttatgatcctaattctttatcctcatttcatagatgagaatactatgagcccagagaggttagtttagttaagtacactcatccagtttttggcttagctgattcttggatcactgacatctggctttttttgatttttttttttttaagttttttttttttttttttttttttgagacagagtcttgctgtgtcagctaggctcgggggctggagtgcagtggtgcagtcatggctcactgcagccttcactgcctgggctcaagtgatcctcccacctcagcctcctgagtacctgggactacaggcacgtgccaccatgcctggctaatttttgtgttttttgtagagaagggtattttttgttgcccaggctggtctcaaactcttgggcttaagtgatcagctagccttgacctcccaaaatgttgggatgagccaccttgcctggcctgatatattttattagcagttttgctgtttagatattcttcaacctaataccaaccatcagctcctttaacagtttcttcatttgatattttaactaactttattaagtacatgagtaaattaggaatattgacctactttttcaacaacaataaaatggtgtttttttaaactcaaaaaatgtctagaaaaagggaattgatatatgaaacagtgtaaccttagcgtcagaaagaataatgttgagggcaaagaaataggttcttgtgttttagagactcttttactgtcttttttcctttttttccccccttcttcaacaacaaaacattggttacaagcttccctgggcatttatggcagcccacctacagaagaacaagtgttctgttttaaaattttaaaaattttatcaagaggataataattacacatatgctgcttttttgatggatatgtattatttctcaggttgagcctcatggtgggggtggtagattctaaccccctccttttaattgttgaatgaatttaaaactatgtcataaagaaactgcgtaattttaattcaaagaaagataattaggatatacataatatccctcttcctttgaggggcttccttcgtgtagaagacatggactgagtgatttttgctcaataaaggaaaactttctagtagtaaagaaatacaaaaatagaatcagcttgtttggaagtagtgagttccctttcttatgaggcattaaagcatagaccagattattgactgttagtaggagtactagcaaatgaatcagtagatggagggttaattgggttacatgacctttcagattgcttttttttttgaggtggagtctcgcttgtcaccaggctagagtgcagtggtgcaatctcagctcactgccacctccgcctcctgggttcaagcgattctcatgcctttgcctcccgagtagctgggattacaggcacgtgccaccacacctaattttttgtatttttagtagagacggggtttcatcatgttggccagggtggtcttgatctactgacctcatgatttgcctgccttggcctcccaaagtgctgggactacaggcatgatccaccgtgcccagccttcaaattcttttattaagtgtttgagtatacttgttcaaaataactttttaaacaagtataaaaaggcagttggtttagcagatgtattctacttttatatcagctgctctgttaacctaaagattttatggatctgtggtctcaccatgatcactgacatcaattctccttgaaggaggatgagttttgtttgttcattttattgcaaaccatttgaagagatgatagattggtagcagaaatttggcagagaaaaggatgataaacattagaaaggaggataaagcccactggaagacataaatgaattgatgatattttggtgtatattttctcattgctttatgattataaatattttctgctgctttttgccactatctatttttcatgtcttccaataaagtattccatggccaaaatttgtgtgaaattctcttcggttgttgctggttttacaagttatagggttctttggaatataattactgaaatgatgactacactaaaacatatttcttcttaatttaacaaagtatttagtgggaggaaggctctagcttttcttattttctttaatgttttttaggcatgctagaggaaaatagtgttcttactattagttttgaacattttttatgactatagagttgaaagcccaaaacactagaagtaaatggatcattgcaaaatatttgttttgttttcatttgtgagtggggcattcgtgtgtcactgtgtctatgcttctatttttctctgtatatagtttatatccttaagactttcagaaagaaattgagatgttatgttgttttattgtatatgcatgtacatgcatacacacacacacacacacacacacacacacagttttatttgttcatcatatatttaaggcctgacataggtcttacaaagttcaattactatagggcttaagtaggaaatgaatggtaaaatgagccaatttgaagcaataaatactgattgatagattatcaccttcttccaaataagatatgtggcatcgtagaatcttgctcttagatacacagatatgtgtgatgtttaaatagttgagaaattcaaccagaaatgaatgaaagggttttcccgttatcctgtcatacgcaaattaccagatcattcagttcttcaatttatcaattcatgtatttattcatttaactaatatttgttagttttatactatgtgtaaagccctattttagacactgaatacagtgccagacagtaattttcctgcactcatagtttatactctaatagagaatgtagaattgagctttaaatttcctattcaataagtatttttagtaatatgtgaagtacaagagcttctgaagacttattgcgccactctctccctattcatccatttaccagttgttactgaatgcttactctatgtactagaaatgcagagatgagtaagatacaacctggccctgaaaaaaattcagtctatttggagttatagacaggcagtaactagctattatatagtgtgatgatggctatgatataattacaaataatattctgcaagaacagtaattttctctagctgtgaggtatgcaagaagctatcatagagaactaatatttgaggatgagtagaaatagtcgggtatagggagatcaaaggagaagttactcctattccccaaatagagggttcttcatgaacacacagaagtaggcaaggtctgtttggagaatggtgagatattgtgtagtttgggtaaaacactgggtatgtcatggagggagaggtaaaagaagaagctacaacgtaggttcaggccgaattgtgaaaagttttatatacaaggttaaagttggctttttattttacagttagttggggacctgtggaagatttttcagcaggcaaacatacttagtctgcagtttacaaagatagttgatagaatacaggatgaagtagtgagaagttgaggctatggaaaggcaggtataccagtttgaaaacttcataatagatatgaatgaaataatgagggtctcttatagggtagtagtagtagtgactttagaacacagggatggattaaaaatcaaattcagaggtatttttgttttgcttcatttttttgagacagggtcttgctctgtcacccatgctggagtgcagtgacatgatcacagctcactgcagctagggctacagatgtgtgccaccatggctggccaattttttatttttatttttatttttggtagagacaaggtctcattatgttgcccaggctggtcttaaaatcctgagctcaagcgattcttccatctcagtctcccaaattgctaggattacaagcatgagccaccatgcctggtccagagttagaactgacaggatttagtgagtgatccatatggagagagggcgttgaaaaagattttgaagttttgtgtttagtgtctgcataattaaatgctggtactattaacttcaaaaggaaaagcaatatggttgagggaagcaatgaatttggttttgtaatattgagggcaggagtaaacctaagggaatgttggaggcatttaaattctaagtggaggagatgcctattcaagagaaaggaggaggagtagggggaagagatagctgttcagtgtgtcattaaacctctcaaatcctcagtttgttatttatcatatattggaggtagaatcaataatttttctggttttgaaataacctgtgttttagttatcacaaattctaaattagtagtacaaaaattataataattatagtttatatgttatagactgatgataatatttattgattacttcctgtgaagtttaggtaaaatgctaagcattttgcattcatcatccatttaattctcctagcaatatgagttaaatattattactatctggattttcagaaaagggaagataacttgaccaagattgttacagcaaataagtggtggatgggtattcaaacccaggacaatctgacattaaaactcaagcttttaaccactatattatttgcctgtcttgtagaacataagagttgtaatgaatctaaaacatcatctagccctttcctgtaatcagatttatgtcatagctaaggtctgtaattaatgtcaaaattagctatccaatttacttaataagaagcttactccacagccattcattactgctgttttccttgtggcagatacttttttttttttttttttttttgtcgactcacctctttaccgtgtgatgtgagtaaattctgtatagtctaggccactcatgattatcccatttttcttgctagtcattaattaagacctgaacataggactgatatctgaccaataactcatttgtggccaatgagacatgaggggaggtttggtggaggggcttcttggaaaggtaacacctcctctcccctcatttttggatgtttctatctagatgggttcttggaattgtgagagctatcttggaattatttggggcctaggtcaggataaaaccaaaacactggatggcacagtgaaaagatggtgagaacttggatccttaatgatcttgttgaacttctaaattacccattcctaaagctattgtgcctcaggactaggtcttacatgaaattagagggaatttattaggctgtgtgaaacaaggactttttaaggctactaacagtttttttcttttaaacgatacttatcactgaaagaaacctaactgggatctgcagtgtttatctttgtctgaagtaaatagaaaggcactgtagggcttgcattactgttgagacacaattaaaacaggaatagaagacaatttttgtgtcactgcacctaatttaattggtgtagaagttggagatgatcatgctctagaaaacagatcttatatatgttaaaggtagcaaagtgtcattgaggaaatgagtctgattattctgacagtttctgtaggtaaaaggaatagaaagtaagtgttcagattaggttaggaaatagaaatggatttagtttgtagacagttaacctacgtttcagggtccttccaagactctggaagaatctcaagcaatgtgttaacataatattttgggtgaggcggggtaagatttgcaaaagttaggtatttaatccattaaaactgctattccttttcacttagactttccctgtatcataccctcatattgggtggcattagagtggcctgagctaagggaaaattgagtagaggatacatttagagatagtatatggttagcagttgtttatgtgtccagttattttgtaggcattacttccaggaatgttattactgtccactgtgtctacttccctggccttgtgatacatagatgtagttttgcagggcaggtgagccccaaagtggggctcagcccgtgagggttcttggctttgcccagaaaagaattcaagggcaagccagaggtagaagaaaatagatttattgaacaggcagtgttacagctctggtggtgttatagctcggtgactgctcctgcagagcagggctaccccgtaggcagagagtagcagttcagggcagttattaatacccttttttaataacatgcagattaaggagtggtttatgcagaaatttctagggaagggatagtaacttttgggtcattgggtcattgccatggaaagtggtggtaactcctgggtgttctcatagcagtgttgacatggcacactggtgggtgtgtctgatggaaagcttcttctgcctaatcatctttcagctagtcctcaatttaattgggtgtctgaacctgtctctagagtcaagtcctgcctcctaactcagtaggggcaagggtcttagagcattataaatatgttctttgtggtagaggtagaggaagagaaacatcgtttaagtgtttagagtgagaaactagtctggaaaatttttctaaatcttggaacttgattgtggttttcgtaaatttgataatattcctaagaatgtatatgacattatcagtaataagttataaagaagttataaagctgatataaactctctacactgcctttttttttttttttttttaagatggagtctcctctgtcacccaggctggagtgcaggggtgtgatctctgctcactgcaacctctgcctcccaggttcaggtgattcttttgcctcagcctcctgagcagctgagactacaggcacgcaccatcatgcctaacaaatttttgtatttttagtagagatggggtttcaccatgttggccgggctggtcacgaactgctgacctcaagtgatccgcccgcctcagcctcccaaagtgctgggattacaggtgtgagacaccgtgcctggcctacactgtcagtactaaaaattgatcaaacacagtagtaaaaagataaaattatctttctattctcttaatgttgcaaaattgttatatgaagaggaaatcaagaaatgcagccagaaatgtaagaaaataagagcattatagagatagattaggcaattaataaagatatgctcttctttttgaaattcatgtttttggcatttgttagccttttaaagttagtgtttagttgtaatttattttctcattccagatatttacttcacacctaattttgtattcctttccttaaatagagtcccacaaattgtaaaaaaggaattagctcaccaaaaacaccaaatgcagtatttttaatatttacctttcaggttcggttgctggatctagatatgcctcttttttttatttcctcattttttcttctaaaaagaaaattatgtattttaatgtcagattgcttttgattaaaatgtttcatattaaaattgtatacctgaaaaatattattcaataacacacttcaaaaagttgacagttaaaaaaaaaagaatagcccttgttacttttcttatctaatcacagagtttgtgtagtgaatgtaaaaagaaaaaaaaattgttacaagtttggagcaaagagctctgtgtttaaaaggaatctccttctttttttgtgtgtttttccttttgtaccaatggggaacctaaatctgttttagttgcacagacacaatggacaaatagtcattttgtatttgccaagtgtgataccttcctttgtttatttgctattaaactgttgagagttttatggctagtggataatcattgttcaaactttttaataactacagtgaattgtgttaatataaaattatgctgtacagtattttcttgttatgttgatggtcaaagtgaacatcagatattaaaaatttagatgagtaaaatattaaacagcctatttttgtcatgtaacaaaagaccatgagatccatggaggaaaaaaggacagctttatttttctatagaaaacaatagtaggttggggatatgcagcctgtggtgtaaaatgaaaatgaggtcctagttgggggttggagagttagaaattataaaggcaaaaattgtaggacaggggaggtggggtcaaggaagtaaggaataaagtcttgattagatgacctttaatccccaaatcaccagtgtgtcttagttggttgtttccaggtggttggtcagttggcaccaggtggtcttttggtgatcatttggggaatttccaaatgatcaccaaaaggaactgttctttgacttggtggcagaaaaacaggttttgcaacacttttaaggacacagggtataattgctcccttaccctgtcattgcctcttggttctgcttttacctttgagccacaaggagtctatcttgtcaattaactgggggcataatttgacagtccaatatgtataatgatgacaacagctccactaacatgaatgccattcttagaatttctcatagatcctggcatttggtacatctgagttgaataaataaaagtctggggaatgaatgaaagaaaaattagttcaatgtcctataactttaagttaatttattagaattgccaccaacaaaattagctctagcatttagatactaaaaggaatttgttaagcaaacttacttttgcagttatctctccatggacagtcagaacaggtattcttcatttctaaaacatactgctgttctttaagaccattctttggcactgtggaactttagtcattttctagacatttgttagccactaaatgtctcataccagggactcatatttgtaaataatagtgtctgcctttgagaagctcataactgggtagtcaacgaacagtcacagtgcagatctggaatcagtgttgagggagtacaaaatcctttgggtgttgtaatcagagtcaagaaaagcttcacagtggcgataggcttaagcttagttgaaggaagaggaagctttcaagtggaggtggcagagaaagcattctgacatgtgaaaaggcaggaaagcctgcgtgcagcatatttattagttttgtctcccttggagcattttgtaaattttattgagtattcagagttgacagaaaggcagtcagggatcatttcatggagcgccatgctgagaagattagaggattttaagcaagtgatgtggtcaaatttgcagttttgaaagagtacttaacattatcctggttatatgtttagcagatttggcaagaactgattgttatgatttgatagtcatttaatacaaaaaggaacctggaatgctcttcgtctttagtgaacattatgtaacctatcttcatggccttcttagtgaggtaaacattttttttttgaaattgtaaagatttaaactttttgaagggtaaactttctcagataattatgcttagttgtgagcagaagtaaaataatgtttttacaggccagagcatttaattaccagtgcaagactgtccagactactctttccatttaccatgataactggtaaaatgtgagatggtgattgctccatcatcttgggtactgagatgaaaagatgtggggtggagtcctcaaatgacttatgatgaacagctagtgtaagcaagaaaatgaccttattgttttaagccactgatattttgcagttcttacctgataaatggtacatgaacctaacgtgtttttattgatgcaaccatatatcaaaacagtatttttgaaggaatcattgtagaagtacagacatttatagaaaattttttacctctctgatttagagaaatttttgaaagcacaataacttaggtaacatagtaacataaaagttctcataatatgtgtaaaccaaaatgagttactgcaactaagagtcattttgaaagagactaaaattgacttatctttaatttgttaaataaaagtgtgatattaaatccattacaaaaatgggtaaaaattgaagacaactgcaattttataggttactgaactttatattttacatgatattacagtcatccttcagtatacatgggcgggtggttccaggacccaagtctacaaatatgttaagtcccacagtgggtgctgtgaaacctacataaaggaaaagttggctctctgtatgcgcaagtttcgtatcctgtgaattctgtattttcaatccacatttggttgaaaaatttcagcctgtaggtggacttgcgcagttcaaacccacttcattcaagggtcaactgtattttatagtcagtatttgcataataaggaaatctaaatggtactttgatattcaaagtttcataataatctatatgtatgttttaaagtgagtgtggtgatattaatacttaaatgaaaaatatgagttaataaagcaatttataattttatatcaattgagcatattgtttttgaaatttaatttagaataatcatctatacataatctatagatactttagtctttctatatgacattcttatggtggtttattgattatcataactatgaataatgagtaaaaattatacaactatacaagccaatatatgcttgaaattattatttattgatagtaaattagattttgacatgaaatgatttctgtttaggcaataaatttaaactatagaaaaaaatgcagtgtaacttgtactgtaaataaacgattagcaatgaacattacagtgagagctgatagtttatgaattattcactgcaaacttattgtctctgtgtcattaacatgtaagataatgagcctaattaccatggctttaaactcaggggagttagcaatttatgtgtaaaagtttctgggctgtagttaccacccacaagggtattgagagaactgcagacactacttctgtgttttgtttcagaaatgttctttttcctcacttgcttccttcttaataaattagtttttatttatttttatagtgagaattatgagcttttcctcttgcttgaatacctttttaaaggagttatgagaaatatttaagtatttttttagtgtagtttagtgttgtaagtagacaaaatattattagatgtattcttttatttgcttacataagttggcatcacttactatagtaaatgaccactaatagtgtaatttcttggaaaatctagcctaaaaggtcaatattaataattggttttctcctctaaaaggatttgtactaagatgatttactttcaaagtactcagtattagcctatagccttttttctaatctttaatattgtatctttgatcttaatttaaagttttgatgaacttgttgcttctattttctctcttatagtataaattatctgtaataagccaccttaattaaagttggtaaatctacaactgcttcaattatacactaatcaattatacactaatttaattctacttagcaggatacggtacatcattaatcagttttagacttaatacaacagatttagaagtaatcaaaattgaagcattttatttagctgggaaaaaaatgaagggtcataatctagtaattcacatatcaattctgataaaaatcaaagattctttgctaaaaatgaaggaatgtagctgttatgtttactgttgagtgccatgggctgaagctgtgattatataatatctttagatgttaatagcataatagttttgtgctctacctttttctttaaattgttattcatgttactaaatgggttgttttctgtaacatgattgtttaacgtatacataatataagaattccttgagtgaatatcttttttgttgttgttgtttgtttttgtgttttttttttttttttttttttgagacggagtctccctgtgtcgcccaggctggagtgcagtggcatgatctcggctcattgcaacctctccatcctgggttcaagcgattctcgtgccttagcctcccaagtagctgggattacaggcatgtggcctagctaatttttgtatttttagtagagaagaggtttcgccatgttggccaggctgatttcgaactcctggcctcaagtgatctgcctgcctcagcctcccaaagtgttgggattacaggtgtgagccactgtgcctggcatatagaatatttactagtagtttgttttgaacatgtaagcatgtgcacaaatgtatttttttcagaattatgttaaataagatgattagatataattaactcaaaaatctttagcaaaatgatctttgttttctgtgattgaggtggtgacaaatttgccttagaattcttggggatgtgttataaactcgatgtaatcatttttcttttccttttttttttttttttttgagacggagtcttgctctgtcacccaggctggagtgcagtggcgcgatctcggctcaccgcaagctccacctcctgggttcatgccattctcctgcctcagcctcccaagtagctgggactacaggcacccgccaccatgcctggctattttttttgtatttttagtagagacggggtttcaccatgttagccaggatggtctcgatctcctgacctcgtgatccgtctgccttcgcctcccaaagtgctaggattacaggcgtgagccaccctgcccggcccatttttctcaattatctgctcattgaattaaatgactcagattgaatttcattactcattctttctatacatgttcatattattggaaacacttcttgtcctgctcagctttctttccaataaattagtaattctttgctcactcgtcttgtattcctttataagaatgttctagatagggatattctaagttttgaagactatgtatgttaagtgcattttacccttttgagagagttttagtaacaagtttcagggaacccctaggactctgacccattatagctttggccatttaaaaaaaaaaaccttcaaaggtaatatgtgtacatggttaacaatcaaatagaacagatggtctgtctaataatgaaaaacaagaaaaatcttgccctatgtttctctgttcccactccccccaaaatcagccacttgtaactgattctgttttcagtgcttattgtggttgtctcaacctgtagtagaattatagattcttttgtttgtttgtttgttttgctttttaaattagagacaagttcttgccctctcaccaggttggagtacattggtgtgatcacagctcactgaagccttgaactcctgggctcaagccatcctcctgcctcagcttcctgtgcagctgggactacaggcatgcaccactccacccagctaattttttaatttttttgtagaaacagggttttgctgtgttgtcccttgaatgcctggcctcaagtgatcctcctgccttggcctgtgattataggcgtgagccactgtgcccagccttagaaattatttctcaatgcttttgctcttctgtgttctgtgattaggtgactctttatctcacaccacttctaccttttctccatccttccaagttgtgatcactgttttcgttcctaaattggttatttttaaacttcaaataattcaggtaaatttatattttatgttttgttaactgtgttccctgcttactgtttcttccattaatttaaatatcatcgaagttgataatgctaagaacttgtttgtgttaaggtaattctcacatgtggataaaaactgattagtgccaaaagtttacaataaaatataacagtctcctatcctaccctgggttctccagaagcggcaacttataatactgttagtttgttctttctgatactagcttattcctaaataatatgtgtattcagcttttctgattaaccaattttagatgttatctattgacctttttattggggcctgggatacagatcatattatatacctgtgcacccagttctgaaaagttatataataattttggttcaatctataagcagtctataatcgttatttatattatagtgactatgtaagtattgagtgctgtaatatagcacattacattcatttgcttaaacaaatatttggtccccctttcccaccacattatttatagccttgtttattcatttgcttggtttcctattggctaatttgctaatctcccccctcagtgtttcagcagatctctccagcacctcccattaatttttctttgtttatcataggttcgaaactcaataattttttttcctggaagtttctctccttcagccctctattctactttaccaaggagttgtcttactcttttcagctctgatcctgggacttccctttgttgctcttttgggggacaatttgctttttgattgtttttagtcttattagtttatgcccttgttttgctcaagcacattctccagagcttcctgagaaaagaatatgtgagaaataaaatttttccatacatgtaggtctaaaatgtctttattctacctttacataggttggtatttcaattaagtctggaaatgcagattgaaaataattattcctcagaaacttgaaggccttgctccattagcaaccagtgtttcctatgtgaagtttgatgccacactgattgctgattctttatatgtgacctatttttttctctttggacattcttagaatctcctctttcctcctggtattctggcatttctcaatgtgatttttcttattatggcttttttttttcattgttctgagcatgtaatgggcccttatagtccagagacttaaatgttcttcctgccattcatgcaggtttttgaaatttcttctctactattttctttagagctatgagttatttttattagccagttttctattaatagacactggatttttcaagttttccaccacaaaaaacactcatgggccgggtgtggtggctcacacctgtaatcccagtgctttgggaggccgaggtgtgtggatcacctgaggtcaggagttcaagaccagcctggccaacatggcgaaaccctgtgtctactaaaagtacaaaaattagctgggtatggtggcaggtgcctgtaaatcccagccacgtgggaggctcaggcaggagaatcgcttgaacctgggaggcagaggttgctgtgatcacgccattgcactccagcctggatgacaagagtgagacttcatctcaaaaaaaaaaaaaaaaacaaaaaaactcctcacatatattatcttttttgcatgtacttttatataattgtgccagttcttctgtaagatatacatggcttttatcttattactttctctgagaggtagagggtggggcagggaaggcaaggagaggaagaagctttgagattctcctacctgaacttcagattctggtgtgatacctcaatattgagttagaatggctttatcaagcatgtttatttctagtttttcatattatttttgtcttagtcatgaagcacaacaaaccaacatagaacccatttcatactgatgaataaacaggtagcttcattcatgtattcatttattcattcagtcatgttgtgatactctttgggaatacaaaggtgatactgtacttgctgtcatgggatttacaattctagggataagtaggagtgtaattgataaaacatgtatttgtgcttttcaatagtaatattgactaactcaagaaaacttttggagacaggctttctttgaatggactgtgatgcttgcttgtttatgttttcatgaatacatttactagcttttgattttttatattaggagagaacagagtgtcttgttgtggcagaaatacctaatatgtaatcctctgaattcttcaattgttgcaaaacataaacatttactaaagagttcagcagagtagattaaatgttatttaaaacatatgttatattgacctcatggctaaatggcctggtttaggaatccatgaattatcccacaggtaatagcaaagttttctccctgcctcgtctcccaccccaaatatttgatttccacatatactgcacaggggaattgaatttgatgtcgaaagccataagaaaaagagaaactttgctttttactgcttttactaggaaatagaaaacatttttagtgacaggctatgcttcatcatgaaaatacggttgggtgttttaggccttcacaaatttgatttcattgtacttagtgatggatgttagtaagctgtgtgagatggagagaaattaaagaataaacaggaacctctcaaacttgctagtgatgttctacagtttgtagcatgaattttcttacttttagtttttccttatgaaatactttatgtagaacaaactagcagtactaaaacaaacacccatgtacccaatctgtcaacacttagatttgttgaagatttgggtgggcagagtcttccacccaaatggtaaaaggggaatacattacaagtacatctggggttctctgtatacctgtcttcagcccattttctgtcttatttcaaagttcactggtgttccagttttgtttttagctgtaatgcttttcttagtgcttaaaatatatgtgtatatattcataagcaatatgaagtattgatttgcgtgttctaaaacatattttacagtgcctctccttcggctcgctttttcgtgtaacattgaatttttagatttttccctgttaatgcacgtaatttatatgtaatttattttcacctgtatagacttgtatgaatacatcacaatttattctttggttgaggaattacaggtttttcagtattagaaacactactgtgtttaaggttcttgtactgatctgtttatgcatatgtgaaagattcttgaggactgtattttaaatatgtggatgtttaaatttcaattaattaaaattaactcagttcctcagttacactagcaacatttaaagtgtttaatagccacatgtaactagtgagtaatgtattggatattgtggatatggaatcattccattatcataaaaagttttataggctagtgctccttggggtttatacctgtgtgtggaattgttgtgtcactgggcttgcacatgttgcacttcagtagatgttgctgagttgttctttccagtggtatctgagcattccctttctcaattgtcttgctaagaattggtataaacagaaattctaatttctgttttgtaggtgtgaactgtatctcattgtggttttaattgaattttgaaaatatatagtgaggctgagccttttttcttatacatgtgtttaccttttacagttctcatcttgtgattgcctcttaatgtcctttactcattttttcttttgagatattttaaattactgatttgcatgagttttttttgtattttatggatacaaattctttgattatatttgccatatatctgtgcctagtatgtgacttgtctttcattttgtggtgtcttttgcctcacacaagttttaaaatgaaatgtaatcacattatcaatttttaaaaatgctttatcttcttatgccttatttaagaaattacttcctactctaaggtcagagtttcccatatgtgctttgcagaggtagatctttcatctggtagtatgtaatttttgtgtatggtgtgaggtagagttggagacttgagtttttttgcatatggataaccaattatctttgtataattttctgaaaacttcattgccttaatagttttttgtttgcatgggggtcaatttctgggttctaattctgttccattggtctatttgtccctataccaatgtttcagttgaattttcctttttgtcaaagtacctatttttttctttattttttgtagagacagggtcttgctttgttgggtagactggtcttgaacatcaaatgattctcctgccttggctttccaaagtgctgggattacagttgtgagcaaccacacctggccaaattttcttaaaatgaaaataacagtgataatttaggtccaagccctcttcccaaaattgatttagctgatgataagctataatattggaatttataatataaaatactacaatttttttttttttttgagacggagtcttgctctgtcaccaggctggagtgcagtggtacaatctcagctcactgcaacctctgcttcctgggttcaagcgattcccctgcttcagcctcctgagtagctaggactacaggtgcgcaccaccacgcccagctaattgtttttattttagtagagacggggtttcaccatgttggccaagatggtctcaatctcctgacctcgtgatccacctgccttggcctccaaaagtgctggctgagattacaggcgtgagccaccgtgcctggcctagaaaatgatattataaccagcagatgtgaacaataacatttttttctgtgatgatatttgagaaaagcgcaacttaattacaaaagagtgaaaaacaatcactttatcaaagtcagaacttctatacactttcaagtggtgaattgagcctcacttaaaatctaattttcacttttaatgccatttgttttcttttgagatataactgattcatttaccaccaatttttataaattggatttgtagtttggccattgtatgaaaatatttttttaaaaaagtatatgggtcatatgggtagtaatcaggcaaattggttttagatttgcagtacctgttcaattatctgagatttaggggatctagggcatgtgagtagaggttctattaggtttataaagtgcttgtgatgataatataggttaaggaccaagtacctgggaaagatcaagggcatactaaatagttgttcctaaagtaatgggacaattgcagagagagggatgagagaaggagacttaaggatgatgtgttgatgtgtatgtatatataaatgagacataaatgacttttggaaggattactaaagaaaaacagcaatagaagaagactagcctatgtccagcagcaaaaggaagtagaagacagtgagtcagatagtgaccagtacaggacgctaggtggtgccattagtcttagactgcttatttgaagtctctggaggctcagtaacctcagaatagaaagatcgaaaggcggccgggcacagtggctcacgcctgtaatctcagcaccttgggaggccgaggtgggtggatcacgaggtcagcaattcaagaccagcccggccaacatgatgaaaccccgtctctactaaaaatacaaaaattagcctggcgtggtggcgggcacctgtaatcccagctactcaggaggctgaggcagagaattgcttgaaccggggaaggagaggttgctgtgatcggagatcgcgccactgcactccagcctgggtgacagagcaggactctgcttcaaaaaaaagaaaaaaagaagaaaaaaaaaggcactgcttgtatagtaaatgagcgaattgtcttattgagtataacccatagtatattatagttcttgatattttcttctccagtgatcattttgaaaaattttctggaatttgcattgtaaagaagtttgtccaccaaataaactgtgttttaaaagtaatagttcatttctttctaattttaaaggttgtatataaaaaggtattttcatttaaaattcatattaaaaaagataattgaaattttcatattgaaattatataatcagaaggaacttggtgttttaataagctttagtggccttttcctaggtcaatgtacaattccactgaatttttttgaaatacatatccatgggttccacattggtggattaaaccgtggaaagaaaatattagggaaaaagaaattgcctgtgtacagagcatgtacacatttttccttgtcaatattccctaaacaatatgacaaaagtttacatacatttccattgtattagatattgttagtaatctagagatgatttaaagtttggggaggatgtatgcaggttatatgcaaatacagttgaccctcaaacagcacaggtttgaactgcatgcacctacttatattagtttttttccagtaaatacagttggccctctatatgggttggtttggcatctacaagcaaaaatggatggaaaatacagtattcaaggaatgtgaaagttgtgtatatggagagaagggccaactttttggatctatgggttcaacagggccaactgtggtactttagtatgtgtgcattttggtatccaagttgggtcctggatccctcaaagatactgaggaatgactgtattgaagatgattccttgattcctgttacatttttttttaagattccagattgggaataattaagtgcattatttgatttctggagatgagttacaccattaaatttttgttgatatgtgtatcgtgcaggtgacagaaaccctaactcatactggcttaagtaaatggaaattattggatcacatatctaaaaagatgttggtatggctgattttaggtgaagcttgatgcagaggttcaaataattttatttggaccctcttcacctcatcttctagaggtagggtactgccatcagctattggcttatatccttatttgtgtgtgtgtgtgtgtgtgtgtgtgtgtgtgtgtgtgtctgtctgtctgttttagtggctctaaaaacaggtgtaggattatgtcatattaggcctctttggcttgtttgggttccatatctactctgcaactggagatagagttaacactgctggaaatttatggattaagagtgttgaagggatgattccccaaagaaaatttggatcttattagggaaataaagaatggttgtaaaattgcacttatttctttaaggaagtcatcttaaagctgtttttctttgccaggtatggtggctcacacctgtaatcccagcactttgggaggctgtggtgggaggttcacttgaagccaggagtttgagaccgctctgggcagcataatgagatcccatttctacaaaatatttaaaagttagccagagatagtggcatgaacctgtagttctagctacccaggagactgaggcaggaggattgcttgagcccaggagttcgaggctgcagctcgattgcgccactgcactccagcctaagcaacagagcaagtcaccatatctttaagaaacagcaacaccccccaacacatgaaaaacttttttttttttttggctaagctgttcttacactattgattttatttcactagaatttgtttttactttaatctcatttgtgctacttattagttgtgtgacttctcagagtccatttcctcactggcaaaattgttgatacaactattgatatagttatggtgatgataaaataagataatgtgtgtgaaatacctagcctagtgcctggcatatattagatattacagaaatgttagtccacttgtaagcatggttattacccagacatgtttggattttatcagtctttgctatatgttttaaattagcctataatctgtaagtatcacagatgttgtagaatgatcaattttcagattatcagtttgatttattgattaccgctttcagtgctgaaaatgacagttggtagatattgtccaattcatgacttgccagtatttttatcctagtacttaatgtgcagatttagcttctgtaagatttttacaattaatctatgtggggaaatataaattatctttaaggagtagcagtaagtgtagtgaaattatgataaatggttttattgtttggggaaataatatcaactgcttcatgtgtttgaagaataaaaggaagttggcagcaagggagaaagatgaatgattaagtatggcttaaacttgttttttaattaaagtgcttcattgttgtacacaatattcaaattatatttaaatgtaacattaatttttctattaacattcatctttattagaaaatattgcttgtatttatcataatttttttccccaccaactataacactcttataatctatttgggttaatgcgtgtgtagtctcaagaaaagagcctccttaattgtttttaaactgtttgaacactagagatttagtaacctacatttccaataactaacaatacatatgaaactcttgatagtgatggaatagaactaatcatttccttataatatagtgatacatcattatttgacttatggcatatttaactctggttagctacaagcagctttatactggtgtcttttattcagatttgagaagtatcagtgtaacatataaagaacttatttttactaattttcaccatattttatagacacaaaccacatgagaccaaaaatagtgtatactgacctggctggtcattttatggttggttattgtgtttattattctgtactatgtttgttgtatttgtgctttagttgctatttatttttaagaatattgtgttatataggtgtaaaagtgataagaatgtgccaggtatggtggctcactgtaatcccagcactttgggaggccaaggcaggcagatcacttgagctcaggagttcaagtatatcttttgtaatcccagcactttgggaggctaaggcaggtggatcacttgagctcaggagttcaagaccagcctggccaacatggggaaaccctgtgtctactaaaaatacaaaaaattagctgggcgtggtggcacgtgccagtagtcccagctactcgggaggctgaggcaggagaatcgcttgaacccaggaggtggaaattgcagtgagccaaggtcatgccactccactccagcctgggcaacacagccagacttcatttcaaaaaaataaataaataaataaaagtgataagaatgtgacatgttaatagggagagatattagtccgatggtaattaaaagcagagaaagttttaaataaactaaatggtgaagaattggtttgttcaacaataggagttattttgaagaataaagcaagtgattaaacatgtgaaaagtaatgtgcctatgccccaaagtgctattgcttagtgggttatatctattgataattacaatattagaaattaaaatggaaacggttgaaaatattcaatacatttaaagataactgtaataaacccagtatttgctagcataaacacatttttctggaaaataatgatattttctaaaccagaaaaaaatagttaaaagaatggtattgctttttgcaaatctctttaatgtctgacttagtagaagacagctggattttcatctgcttctgcctgccatctgttgtaatatattgaactgatccagaactcctggtctcaagccattgttccacctcggcctcccaaagagctaggattacaggtgtgagccactgcacccagcaaagcaaatagttttaaccttgttggttccctgaaaagattttgtgggacccttgtagtccttagactatgctttgagaactgctggccttagcaattgaacgtaagtacagtaggagacattggtagaaatgcttttgaatttacagtagagtctgggcatcaatattagatgtctattgatcttttattaaaagactaagagtttgagaatttaaaggctaaaacattataggtcctgctgatcagacttttcatagccagatagttctgtaggcttaaggccctttaaatccagataatgtccaagtaagtggcaaggcagcaatttggattccatagctgctaaaaagttttttacggcatttgtacatagatcattaagaagagaggaattatttctcacaaccaatttttagtgtagacaaaactggaatattttggagaaaaatgtcttaatagaatgcatatagcggtaatgtagtcttctatttggcaggaatatatatagggatggtcactttagattaaagaacaaataaaacttaacctacttataaacagaggcttctgtattgagaatttttcttagtataacatatattcaccttagtatcaagttgtgggggtttttgatacccccaaattgacagttattcagctgaaacttggagataggacagaccttgattaatatttggcaataattgtcagttctaatgttggaatttttgctctaaccttgttgattaagcatttaacttatttacatttttatgcttagggattaaaagtatgtctactttacatttatattcaggtatatatatatttttgttgttgttgttgttttttcttattattattatactttaagttttagggtacatgtgcacaatgtgcgggttagttacacatgtatacatgtgccatgctggtgtgctgcacccattaactcatcatttagcattagtatatctcctaatgactatccctcccccctccccccaccccacaacagtccccagagtgtgatgttccccttcctgtgtccatgtgttctcattgttcaattcccatctatgagtgagaacatgcggtgtttggttttttgtccttgtgatagtttactgagaatgatgatttccaatttcatccatgtccctataaaggacatgaactcatcattttttatggctgcatagtatatattcaggtatattttaaggcagtttttaagtatatcttttttctttaatagtacttacaaaaatgtaattatttgatatgacaaagctgcttcatattttcatattagcttgaactttccattgatatgtcaagcaaataaatacttagtttttttctgagtagaaaccaactgtactgcaaaccccattgatagtaaattaattgcagggatttaacatgtagggaaaccttaattattctgaatatacttatgttatgatgtgtagatgatttgtttactgtctttaatgtgactgagtcaaaatatgtgtagttatttgcataaaagggaagtgttgctaatatattttgcattacttaatgttatatataaaattaattttccttgtaagggatgtgagaaatttttttactcctcatttctgtttattctcatctatttctttgaaaatgtagatttaatttatttaaatactgtgtgatgaaaacattacagatatgttcttgctctctttttttttttgagacagggtctcactctgtcatctaggctgagtgcagtggcataatcatggctccctgcatgtcaacctcctgggctcaggcagtcctcccacctcagcttcctgagtgtttgggactacaggcgcgcactaccatgccgggttaacttttgactttttgtagagatggggtctcactatgttgcccaggctggtctcaaactcctggatgcaagcaatcctcctgcctcagcctcccaaagttctgggattacaggcatgagccaccacagccaatatgcttcattttctacctctgattataaattaaaggatagtattataaatgcttaattttataacctccaaatagtgatattgtattgctccttattgtgatggataaattataagacatatgtgtttaactggtttggtggcaagtctgtttacagaaatttgctgttaatttctcagttgttcacatgaacttatctgatttatagctttggccagcaatttacaaagaaagttcagtctgtagggcttcctgttgctctgagtgggggctccttctacccctgttcaacttcagtcagcccatggtctatagtatacctctcacaaggtccttatactgcagatcctctctgctgcagatgcttgggcttttgccttaagcacactggtgtaattagaagaagtagaaaagaagagaaagggtgaataataagagatgagaggatttaaaaatggttgaaacaggagttgtgaagtttgagtgtggtggatatggagatgtgcagccctgatcctccttcaaggaagaattgtggcccagttgtggggaggtcagtcatcagaaaaccttcagctgtctggcctacagaggacagccagaaaaaaaaaaaaaattgccttaagctgtcagctccttcaggctctacctcagttgcggagagcctccttgcttaaggtcacatcctttccagggcagcacttatcctgcaatcaagcaagacatgtttaaaggcccagccattttgttcaggcctgagacaactctgacaggtgatataccaccagagatctgccaggttgcttgaggctttgttgggcctgaattgcaatttgatttttccctctgcccaattcggctttcttccccaaatctcttcttcttctttttttttttctttgagatgaagtcttgctcttgttccccaggctggagtgtgatggcatgatcttggctcactgcaacctctgcctcccaagttcaagcaattctcctgccttggtcccctgagtagctgggattacaggtgggtgctaccacccctggctaatttttgtatttttagtagagatgaggtttcaccatgttggccaggctggtctcgaactcctgacctcaggtgatccacccgcctcggcctcccaaagtgctgggattacaggcgtgagccactgcgcccggcctctccccgaatttctttcacagggattgactgctaataaacatcatatacccaaaactacttcagtgtccattttcagagaatccagcttgcaacaggcaggcgtatcggcttcatgttgtcctaaaccttacgtaaagttctatgcaattttttttgtgaatttgcatttttcttaggaggtctgtggcttccattatcttctttaagatagacttgaaaattaaaggtttttctcatcaaggacttaagaaggaaaggcttaaacattttttttttgactcaagatcaaactaaatacacttggccattgaacaatatgggggttagtagtgctgaccctttgcacagttgaaaattgacatacgactttttactctcccaaaacttaactattaataatctactgtgtaccagaagtcctaccagtaacatagtctataaacacatattttgtatatgtattaaacactgtattcttacaataaagctagagaaaacaaagtgttattaagaaaatcatggccgggcgtggtagctcacacctgtaatcccagcactttgggaggccgaggtgggtggatcacctgaggtcaggagtttgaggccagcctggccaacatggtaaaaccctgtctctactaaaaatacaaaaattagctcgtggtggtggcaggcgcctgtaattccagctactcaggaggctgaggcgggagaatcgcttgaacctgggaggcagaggttgcagtgagcctgaaattgcgccattgcagctccagcctgggcgacaagagcaagactctgtcttaaaaaaaaagtcataagagaaaacctgtttattattcattgagtggaagtggatcatcataaagatctttatccttgtcatcttcatattgagtaggctaaggaggaggaggggttgctttttaagagggggcagaggtgattagtaggagaaaaattttaatgtgtgtatatatatatatatacacacacacattatatatatataattttttgtagagacagggtcttactttgttgcccaggctggtcttgaactcctgggctcaagtgatcagcctgcctcctaaagtgctgggattaccagcatgagacaccgtacctgactggaggaactacgtttttgatatggtactcagagaactgagtgcagtacagaagcttatacacccccttttttttatagggaagtggggaaatggagaatgtagacagttcttttgagggccagtaaatcatttaggtgggaggcagacattgtgggaaggtgagaggtgaagctgcaggttgtcttaccatgcagatgaaggccccctgggtaatctgttggagctgccctgggaagaatagatgaagtctttctgggcagtaatgatcatgacttccagcttcttctcatgtagtcgacctttcctgatcatttgatgagatccctaggaagggagtttaagacaattgcatttcttttggaaagaagcttttttgggctgataaggaaataccagagagagcccctctctgcgctggggtgggggacacgacaagttagagggatcttgattgtgaggcagcttctaaggcctttaagcatgtctaagtgccagtctttgggggtgtggtttgagagaccaaaatagatgcccctttattaactaggacagatcttaaggttaaggaaacaaagttacctatcggtagaaagttcagggccctgctggtgtggcaaatttctaaattcctatggctacaagaaaaatcactcttattaaactctctaacaataggagctttcagacaaattatcacaattctgatttacagcccagactactacaactctggacagaattcccaacttagaaacattcttttcttttcttttttttcttctttgagacagagtctcactctgtcacccaggctggagtgcagtggcacaatcttggcttactacaacctccacctcccatgttcaagaaattctccagcctcagcctccagtgcggaccactatgcctgggtaatttttgtatttttagtggagatggggtttcgctatgttggccaggctgttctttaactcctgacctcaggtgatctgcctgcctcagccttccaaagtactgggattacaggcatgaaccactgtacccagcccttagaaacattcttttctgataagctttatagaccttgagtttcaaccagctttagaggctgggcacaaattgtctttgcatcgtatagtttttatcttttgatgtaaagagccaaattccaccttattttaatgctaaagccccaccccaaagtgagcataggatgtatattacacatatgtttacccattgcacgtgcgctcagctcttctcgtaaatatgaatagctttcccctaaatctgctgaatatatatgattctgttgtgtaatatgggccctgtgaggcataaaacccaacctatccttcccctgtttgaagacagagcacctttggtttgcactggagactttttcttcgctggttgcaaacccatattcccagtaaagctctcctttctactacgtagcttctggttatcttttggatgacaggggtattgctttctgggccccaacactgggaagcagcacttaaccattgtaagcaaggagaagggtgtattaattttctgtttttcagataacaaattgacacaaatttagcagctttaaaacaatacccttttattatcttatagttctataggccagaaatctgatacagtgtgtctcactcagctggttctcagctccaggttttacaaggcagaaatcaagatgctgggaggatagtgtatgttcctttctggaggctctaggggtgaatgtttccaagctctttctggttgttagctgaattcagttacttgcagttgtaggactgaggttcccatttacttgctggctttttgggaagtggtgtttacctgtttaatctcagtggtgtttacctgtttaatctcagtggtatgtgtagttatatgggattgtgtgttttaaattgatctcttttgtacctttcctttctattcctttgatttttgttctttttcatctccttttactttctttgggtttatctattgttccttttcaaatatctttttttttttgagacggagtctcagtctgttgcacagactgcagtacagtggaacgatctcagctcactgcaaactccacttccccagttcaagcgattctcctgcctcagcctccggagtagctgggattacaggcgcctgccaccacacccagctaattttcctgtttttagttagagacagggtttcaccatttggccaggctgatctcgaactcttgacctcgggtgatccgccctcctcagcctcccaaaatgctgggattacaggcatgagccactacacccagcctttaaatatcttaataagaatacttagctcattcatttacagccttttttcatttctaagatgagcacttaagtctatacatttttctcagaataccttttttgtgtgacctggactgtgtgagatagttttttactttttcattttgaagtgttttaaatttcttttgttttgttttgttttgttttgtttttttgagatggagttctcactctgtcgcccaggctggagtgcagtggtgtgatctcggctcactgcaagctccccctcccgggttcacgccattctcctgcctcagcctcccaagtagctgggactacaggcacccgccaccatgcctgggtaatatttttttgtatttttagtagtgacggggtttcaccatgttagcccggatggtctcgatctcctgacctcgtgatccacctgcctcggcctcccaaagtgctgggattacaggtgtgagccaccgcgcccagctaaatttcttttatggtttctttttgacctgttgattgtttgggaattgtttagaaatacgggtttttaaaaagctattttttctttgattgtacattgtggtcagagaataagttccatgtgatatctatgcttagaaattttttagatttatattttgccagtacatgactacttttgtaatgttttatgtatatttgataaaaatatagattatctaattattggatgcagaaattcatatattccatatatcattatatgatccatacatattcaagcttgttaattattatttcctgaatataatctttgtttatttatatgcttgactggtcagtaatagaaaaatgttgtgtcaaaatctactgggaggggtggcgacgtagctcacccctgtaatcccagcactttgggaggctgaggtgggtggtctgcttgagctcaggagtttgagaccagcctgggcaatatggcaaaaccccatctctactaaaaatacaaaaattagccaggcttagtggcaggcacctgtaaacccagctactcgggaggctgagacaggagaactgcgtgatcctgagaggtggaagttgcagtgagctgagattgcaccactgcactccagtctgggtgacagagtgagaccccatctcaaaaaaaaaaattaaaaaaaaaaaaaaaaaaaacaaccctaaaacaaatctactgtgatgttaggtttgtccatttttttccagatttttttggcttgatatattttgagactattttattagatgcacatacttttaaaattactttgtcttactggtaatgtgaacttaaataattttgttatgatcctttctttcctagttgatcatcttttagtttaaagtttatctgataacaattacatgtagttaaacttctttcttttggtcaacatttgaccaatatgtcctttttccttctttcactttttttatttttatttttagagttggggtctggatatattgcccaggcagaagtacagtgactgtttataggcatgatgatagcacactacatcctctaacttgtggcctcaagcgatcttcccgtcttagcctcctgagtagctgggactacagatgttagccatcacactcagcttctttcacatttatacattaggagtccttttgctttttatatgtcttttataatagccattagttggattctttaatcttataatctttattttttaacataatgatttttgatttttgttcatccctcttgttcttggcttcataaaaaaaattgaggccagctgggcgcggtggctcacgcctgtaatcccagcactttgggaggctgaggcaggtggatcacgagatcaggaattcaagaccagcatggccaagatggtgaaacctcatctctcctaaaaatacaaaaattagccgggcgtagtggtgggcgcctgtaatcccagctactcgggaggctgaggcagggagatttgcttgaatctgggaggcggaggttgcagtgatccgagattgcgccactgcattccagcatgggtgacagagcgagactccatcttaaaaaaataaacaaaaaataaaaattgaggccaggtgcagtggctcacgcctgtaatcccagcactttgggaggctgaggtgggtggatcatggtcaggagtttgagaccagtctggccaatatagtgaaaccccgtctctactaaaaatacaaaaattagctgggcatggtggctcatgcctgtagtcccagctacttgggaggctaaggccagagaatcacttgaacccggaggttgcagtgagccgagatcgtaccactgcactccagcttgggtgacagagtgagacttcatctcaaaaaaaaaaaaaaaaattgagtgccttttacccagagcctcaccaacagaattgccaaacttttgattttttctttttttgccagtttgatcactaaatagtgatgtttcatcttacctcgaatttttttttttcatgagtgaagttgagcatcttgtttaaaaacatttgtggccaagtgaagtgctcaggtctgtaatcccagcaagttgggaggctgaggcagaggattgcttgaaaccaggaatttgagatcagcccaggcaatgtagggagaccccgtctctaaaaaagaaaaattaaactggtgtggtattatgtacttgtagtcccagctattcagaaggctcagggaggaggatcacttgagcccaggagtttaaggctgcaatgagttattattgcaccactgcacccaacctgggtgacagagttagactagatctcttaaaacaaacaaaaagtttacttttctcttttctgtaaaatgtctgttcatatcgtctctaccacacttatttttttggtgggattgtgtctttttagtgatatctgtgtttttttgttttttgttttttgttttggagccagggtcttgctcactgcaacctccaccttcctcaagcgattctcctgcctcagcctcccaagtagctgggactacaggcatgtgccaccatgcccggctaattttttgtatttttagtagagatggggtttcactgtgttagccaggatggtatggatctcctgaccttgtgatctacccgccttggcctcccaaagtgctgggattacaggtgtgagccaccgcgcccggccttaaacaagtttaaacacacacacacacacacacacacacacacacgttttttagagttggggcttgccttgtagcccaggctggtgtctaacttctggcctcaagtatttctcccaccttggccttccagatagtttggattatgggtgtttacccctatgcccagctctaaataagttttaatgccaaccatcacttctatttgtagagattcctaatgccacccagtgtaatgcttttggggctatggcagtgtaaatttggttttctcactgctgtttataattcagctttcttgggtctattgagttgatcactgcacctcactctgctttccactgtccaaaattttgtcaccattatttttttgtttttcttgtctttcagagttttagtgaggtttcaggaggaatcagaagttcatgcatgtattaagtcctttggttttactgaaagtttgacacatattttgaattgtagttattttgtctttcctaatttagatgcaaaattaagttgtctagtgagatactcagttaatcaagttgagatattaagggttacaaaaaggtttaccacactggtttatatacaggttaagtatccataatttgaaaatttgaaattcataatgctccaaaatctgaaacattttgtgagccgacaagagactcaaaagaaattttgaataaggtatactcaacttggataatattcatttgaagcatgtaaaggaaataatggctgttatgtgttatacacaaatgtgaagatagtgttgatttgatgctttacttttgataatgttgatctgatgccctggttttgatcacttaacagatacccatgtgctttatgggaagttgagttcttcttatgctcatgggctgagcccgaattaatccaaatcagtaatggtaattttatgccctctcccattgatttgatagtgagtggccttgagagccagttcattgggggaagttccccacttttttggtaaagaaacataagcaaggggaaggcagtctctcttatgatcctagacattaaattgttacttgcaactagtgtagctactttgaaaccgttaggggacaaaaagtcatcacactaaagatgacacaggaaaaacaaggaaagaacttaggtccatgatcttgatgaggcatcataaattacctatccctggagctgctgtagctctggactttttgttatatgagataataattcctcagattgacttagaataccaatcaaaataactattattttagctagctaagaaaaaaaatctgagtaaataccataaggttcagattacataaatatgaagatcaaaactgcaagttttctgagaagttagttattattgttttttactaatatgagctgcattggaaatttattttctttttaaaaaattattgctgtctttgtccataacttttatggacctgacattttagttgtttggaaaaattggtaattttaatcttttgttttggtatgattcaggttgacctgacattttaatacatctggctcctaggactgattaaagagacattttatttgttgaaatatgcacattttcttcatgaaattggttttcttttttatgtgtgacttttcttgcaaaagcttacaaggcacatgcttttgatagcagtgttacatttttaattaatattttagatgtaaaaggtgacagtttaaaagattgttttattagtgggttatccttaaaagcaagtggcatttggttttattttacaatagagtttaatcttacatgttttttgttaaagtaatgttaccaaaaaatctcttattgaactatttgtggtgaactttttaaggatgtttaagatttcacatgcagtttaactgatcacagatgaagttgtaaattaatacctcatgagcgtatttgactgcagggcattgttgtgaatcaaaaccgctttgttcctgtaaactgtgaaaggggtttaagcatatggattaaaattgcatggtgataccgaagtacttatgaaaagacactgtagttggatcatttaaaatgtactaaaatattacgaatagccataaaatataataattccctgaagcttttaagagtggtaagatttagttttatttctttgttggatttaactactttaataagaaattgttttgttgcttttggaactatgcatagtaatgagaataaccatgatgatgagaacactggaagcttcccagaaaacatgtatttcttcagaaatgttcttggttgtgacaaatatatatatgaagcttttccttgttcccatctgagtcattcccttaccagaacctttagaatgaaaggtttaatgatatcttctagtataagattatgaaatgagcattgtttagtgtaaaatcatatttttcttttgctgttaattttgtcttatagtatatgaaaatcacctggtgtagaatgtatttttcctgccataagaaactgtcaagaatctattgaaaaaataccatgagagtagttgttctggatgacaatggtaggttctgatttactgacgtagaagcaagcttcagttagccactttagtcataggtaaacactagattagcctaaggaaaaattgttgggaagcttttggagttctcatctgtgtcactgttttagatctcttcaagttctttgaaaattttggtacctccctgtttaacaaatattctgttttctgctatctaattagttctcatgtagatgacgtttctaatactaattaccacactttcttggactcctcttttataacgacctttatctccattccatttgatcaactgttttttaggactatgttctgaacctacttcctacccaggactgctttaaaaaaagtaatctatgttagcttcctgtttggcttcttcctagtttgactttactctctatatacagcctgagtggcatgctcggttatttcagctacatcttaccattactcagttctctctcccttttgaccttgctggtttctaaatctgggtcaatttgtgtgccttgcttcttgacttgatattacaattaacttattttgtcatactagatgttttcagccatctttgatccccaggttgctcaccaactcttattatcctttgaaatgactctcaaatcttacccctctttttgacttttatgtttgttgccctcatcttcatcttttttttttttttaatgagacggagtttcgctcttgttttctttctttcttttttttttttttttgagacagagtctcgctcttgcccaggctggagtgcagtggcgccatctctgctcactgcaagatccgcctcctgagttcacgccattctcctgcctcagcctcctgagtagctgggactacaggtgcccgccaccacgcctggctaattttttgtatttttagtagagatggggtttcaccgtgttagcctggatagtcttgatctcctgaccttgtgatccgcctgcctaggcctcccaaagtgctgggattacaggcatgagccactgcgcccagctcgctcttgttttcttgttgcccaggctggagtgcaatggtttgatcttggctcactgcaacctccgcctcctgcgttcaagagattctcctgcttcagccttctgagtagttggcattacaggcgtgtgccaccatgcccggctaattttttgtatttttagtagagacagggtttctccatgttggccaggctggtctcgaactcccgaactcaggtgatccgccagtcttggcctcccaaagtgctaggattacaggcatgagccaccacgcctggcaaattctattttttttttttttttttgagacggaattttgctcttgctgcctaggctgtgcaatggcacgatctcggctcaccgtggcctctccctcccaggttcaagtgagtctcctgcctcagcctcccaagtagctgggattacagacgtgtgtcaccatgcccggctaattttgtatttttagtagagacggggtttctccacgttggtcaggctggcctggaactcccaacctcagatgatctgtctgcttcggcctcgccaagtgctgggattacaggcgtgagccactgctcccagcccttcatctcttacattaggtgccatagcactcacctctgtggctctgtttcttctatcccaacagcacatgagggattgggtccccttccatctctccaactccctactcctactaccacataaattaacagaaactccctttagtagtaattctcaaatgaggtgccaaatcttggtctgtatggaatgtgtatttggttttaaaaaaattctaaaagtgattctcttctgaggtcctaaagggtcttttgcaggacttcctcaaattcgtcttttacaatgctataggagtcatctttgtcaaacatagatttactcattttacaactgtgtaacaacttattttttgccaagtattgggatagctactggagttagtaaagtgaatattagggtgcttacttttgagaaaaatgctaataatatagtatagccatcatttactggaacttttttaagtgctaggcacttcatgtatttatccttataatagtccttcagtgtagatattattagccactgtacagatgagcagccattctcagaattctgaggactcacatagtaattcattaggcaagtgataagctttatgataaatacttgaaagggacctctaagagcatagaggagggatatctagtttagagttggaagattaacagaataggcttcacagagaagatgatgtattaagctgagtatttaaagacaagtaggaacttagacaaaatgatagattggaaaatgagtgtgtggcatggttatatttgtgaatagtctttgtacagagatataagagaagcattttatgagaacacctggtgctcacttaggcaacacatatactaaagttggagaacagctcaatatgactgaagcatagtatgtgagatggggaatttagagtggtttagatataaagacattaaactaggttgtattttatatatttatacatctatatctatatatctatatctatatgcatctgtggtcccagctactaaggaggctgaggtgggaggatcgcctgagcctgggagatcaaggctccactgagccgagattgcaccattgcactccagcctgggtgacagagtgagaccctgtctcaaacaaaacaaaacaaaacaaaaacccagttagactgctggaatagtccaaataagaaatcaggaggccttgaaacgtgtcagtgggattaaagaggagagaggtggaattgaaggttatctggtaggtgcaatcaacagacttagtggtttaaaaagtgagtgagaggttatagtcaggttgggactatgtattaatcctttatttttttaatttactgtactgtactatgtattattgttaatatcctttatttcagattgacatatacccttaaatattcttaagatcatatccttaaggtcttaatagtctctgaataaatattggtataagctgcttcctaaatgatttcccatttatttactggtgtttttatatatctatttagagactgaatctcactatgttgcccaggctagagtgcaggagcatgatcatagcttactgtaacctcacactcttgggttcaagtgattctcctgcctcagcttcccaagcagctaggactacaagtgtgtgccaccacacctggctcattttttaatttttgcagaaacagactcttgctatgttgctcagactggtctcaaactcctggcctaaagcgatccttcagtccctgcctcccaaagcagtgggactgcaggtgcgagtcaccatggctggcttgaggagtgttttttaaaacatcctggccaactgtgagcattgagacatcaatttatcaaggctttactgagtgctcaagggcccaggcacattctaagtcctggaagagggagcacagtggaagttctaggacttagctatctagttaaatatcttcagtttaaacagatttactcattttacaactgtgtaacaatttattttttggcagtttctgaacttccagttttcacgttctctagtattgacaacaagctgataatcttgctagacacaacagactcttgaggaaggaattattcattgtggtttatagacaatgatatttgaagttaacttgccccagggcaggagtatggttcttatataatgtaggaaaaggccagtcaacaccagacctcagagctaccatttaatgcattgtggcaaatgattcgcatgtattatcacacttaatgctcacaagaatactaccatgaaatagttaatatttaaaacaaatttttttattttttaaggagactgggtctcactatgttgcccaggcttgtctcgaacccctgggctcaagtgatcctcccacctcagcctcttaaagttctgggattacaagcatgagccaccgcgagtggtctttatcattattatcgctgttttacagatgagaaaactgaggcacagagacctgcttatggtgacacaagtaggaattgaaaagatgagatttgaatctagctggtctaatttatcctgaagttcaagatagcaatacaagaattatgaacatataaatggagtgagtggatatgatcgctcaagataaatctcttggccgggcgcagtggctcacacctgtaatcccagcactttgggagactgaggcgggcagatcacgtggtcaggagatcaagaccatcctggctaacatggtgaaaccccctgtctactaaaaatacaaaaaattagtggggcgtggtggtgcacgcctgtaatcccagctactcaggaggctgaggcacgagaatcacttgaacccaggaggcggaggttgcagtgagccaagattgcgccactgcactccagcctgggtgatagagtgagactccgtctcaaaaaaaaaaaaaaatctcttggatgagaaaactagacttaggatttaaggaaatctacgttaatggactggccagaaaaacaagtcataaaggaaaattaggaagtaatcatgagagagggggatgttatgtcctattacctgaagcagaaatataaatggaaaacatatcagtgttattaactgaagggaaaagaaaatataaaaatatatctgttataaaatatattctgtataaaactcgaataccagattgttgtttgcattgacgttgcctgtaatcccagcattttgggagggtgaggtgggagagctcaggagttcaagaccagcctgggcaacatgatgaaactccatctctacaaaaaattagctgggcatggtggtacatgcttgtaatcccagctactcaggaagctatagtgggaggatcacttgagcccgggaggttgaggctgcagtgagccataatggtgccactacactcctgcctggggcgatgtactgagaccctgtctcaaaaaaaaaaaaaaaaaaagagaaaaaaaaatttttaagtacttttttacttagaacctttcaaatgccatgttatgtgtctttatatacagaaaccctgggcaaagacagtatggctctttttttaagaattaggagacatgagtgtaaagcatatttgtaaataacgggcaataaaattaatgcggaaggtttggcttacattatttggggagggaacatataaaattcaatattcaaattgttacatcaacttgaagtacagtgaatcatgactcagaaaatgtatgaagatgagacaaggtagttgcctattggaatcttaaatgatacttttagtagagatcatgtaaatctgtgttgatgttaaagaaaagtgaacataggctgagcgcagtggctcatgcctgtaatcccagcacttcgggaggctgaggcaggcggatcagctgagatcaggagttcgagaccagcctggccaacatagcgaaaccccatctctaccaaaaatacaaaaattagccaggcgtggtggcgggcacctataatcccagctactctggaggctgaggcaggagaatagcttgaacccgggaggtggagattgtagtgagccgagatcacaccactgcactccagcctgggtgacaagagcgagactccatctcaaaaagaaaagtgaacataaacttttaaaacttcattacagagtaaaaagtcttattacgtttttctggccaaaatttataaacttttaaaatatttcagtgaagttgagctatattagaggtatctctttatgtacctctggaatggaactttgataactgtttattacagtagaaaataggatctaaaatgggtaagttcattatttcactttgctttcttaatattcatggaaggtattttgccgaaattatttttggagagtatatgaaaagtaagtaatattttataaaactgtattgcagctgatttggagaatgagtggctactttgaaaattgtcagtagataggaaataaaaataacagaatgaagcagctcacacacttcagagtttattctcaatattgttgaattgggccataatgaagcataatgcctggttaaactttattgcaattcaaacatcccaccagaaagaaatttttaaaaactatatcaacaaataaattcactgaagtctgtctatagcttcttctaggaactacaatttatttatttgtttattttaatattgttttttgtagagacaaggtctcactttgttgcccaggctggtcttgaactcctgggctcaagtgatcagcccgcctctgaaagtgctgggattacaggcatgagccaccgtacctggctgaaggaactacatttttgatatggtactctgctttaaacgcagtaggtactctgctgaattgggctaaataaacatttcacctctcaaaactatgtgaatatttggcttaagcaaagatagcctgggaccatgaagaaagctaaaacacttaaaaaaaatgtacccttatttaaaaagtagcatgtttctttctgatttggagtgttatgtttttgttgaaaaattggaaattacataaaaccaaaatgaaaaatatagagatgatcagtaatttcaccatgaatataatactcctcttatcattttgtattcccttccaactaatttttctcttaaaagtggcactatgtttttgaaaaagctgactactttaagaaaatttctctcagtttactttcttaatcgtgtgcttttctgaagagttggctctgacgttgactactatagtaaatccaattttgatgagtttttcttttttagtgggccaaaaaaaaaaaaaggaaagaaaattctcctttgtagaaaaaggagggaggatggaatgtatattgtagtacacctgaaaatccataccttttcttagccatatacacaattagtttactctttctcaagataatatttttatagtaaattaggattctttgttacaagtgatgggaaaccaaactagtgctatgctaggttaaaaaaaggaatttagggactcaagtcactaaactactcacgcgcacacacacacacacacacacactcacacacactcacataggggttcaattgggccttaggaatggctaaatctaaggtctcaaaagctgtcagtttttttccttcggttcgttctttgtctctgagagttagcttcactttgtcagcctgcttctttatactcttcctgtttttcactctgacttactgtgtttataattatcttgggttagtttttcttattgctcatttggaaaaactatcagtacttctgattagtaatttcagatgtttttatattttaattttgtatgcaaaataagtatccgtgatattttaaaaatatttactaagtatttccctagtctttctctaaagggtaatctcaaatgaaacaactggaactggattctcatttgtttaatgactgaagaagtcttccaattactctacaaaccattgataacttttgttatttgtgaccagtattcatctagtaagatgttaaatgcttttatgaaagagacaagtgttttacctaaagaatgagaaaaaaaaaaccctaattttttgtgaagttttctccttttttgctgagtgcttaaagaaaaaaagtttatgttgttttaggtttttcttcttgcttatcaccctaggaactaattgtgttactttttaaatgtttaaatttaatttttcctgtcccttccccatgcttgctaattatgttttttaaaggtgaccctttaagatggctcttatagaataaagagagacactgaattttctaatcttgtggaagaggttatatttagccattggtattttaagttggagcacttcattctactgtgcctttagtttatgagtcatctggagaaaatgggctgcttcttgcttttaggaagagtctgtagcaaataataataataagtgctatgggagattttttgccaaataatttaaaatggaaaatgttttgtaatatattttattgcccatatgtaaaatacgtactaaagaatataggagtttttggctcattattatctttagctcataaaaataaacaaaagaggctgggtgcggtggctcacgcctgtaatccagcactttgggaggctgaggtgggcggatcacgaggtcaggaaatcaagaccatcctggctaacacggtgaaaccctgtctctaataaaaaatacaaaaaattagccgggtgtggtggcaggcacctgtagtcccagctactcgggaggctgaggcaggagaatggcgtgaacccaggaggtggagcttgcagtgagctgagaccgcaccattgcactccagcctgggtgacagagtgagactccgtctcaaaaacaacaacaacaacaacaacaataacaacaaaaccctaatgtcacatataacaaaaagaaagcattttctaccaaaacattatatagattgttatgagttataggtaagtggaaagcaagcataaaccatatgaaattattttatatgcaggatgtacagcagtggtcaaatcttaatgataattgtcagtaactggggagaatattgtgattattgaagtattgattttttttcaaatatttttatattacatgtggtaactttttataatcttgttttatatctactttagtatgatagctttaccatactagatattctatgaggggtagacagttggcaaaggatgtgatattgattctaattttggctacctttgtattatgtgtatcataatgatttcacgcttcagttttctcatctgtacagtattttgttcttcgtgacttttcttgcaggaatgaaaggaggtagcatggaacaaagaaaaaagtgtatcatattgtaaaacaggaaattttaaagtcctagagttcagattttaaatccaagatgtcatttttgaggtaaatttgtcaggtctccctgggacacagaatgactgcatcactagaatcatgagcccgtgggattgtttttttctttttctcaaatgtatttatttaacatctctctccctctctacttacctacctgcctacctacctacttacctctgttgtgaaacttttgggagctcagtattgtctactataccaagaataccagtcctttactcatttttttgcattacaaagatcatatggaatatactggaggggaatttaggtcttttggttctgtgttagaagagcccattttgtttttccctgcatgtggtagtcggtgtataggcctgtttctgtgatgggaagatgacaccttttgtcaaatctctatcctttttgtatgtcaaggaatcatttctttgcagtgaagtagagtgtgccctgtagtatagcactctgtgtccttagtcatagcaatattggaggattggagagttaatcatgtttgagaagttaggggacttgttctttcagcatctatttaatgaatctgcttgtatttttgatatcctaatgtgtcccaacactgaactcctaatctttcctctaaaacctgttccacctgcagccctctctatttcacttgatggcagttttatccttctcgttattcaggataaaaacctgagactcattcttgtttttcctctttctcttatatcccacatctaatccttaaggaaattatactggcaccacttgtgaaatatatcctgaaatctgatcacttataccatctaaatcgctaaagtcatctgtacccccacctctcttttgtgccaccatcatcctttgcctagatttttgcagtagcttcttagttactttctttccacctttgctgccttcaatatcttgtcagcacaacagattggcggacattttaaaaacgtaagtcagataatgacactctaataaaaatgagaaaggtttaaaaatagtaaagataggaagcctggacaacatggtgaaacaccatctctacaaaactagctgagtgtggtggtgcatgcttgtggtcagctactcaggaggctgaggcaggaagattgattgaacctggaaggttgaggctgcagtgagctgtgattgtatcacttcactccagcccccgtgactgattgaaaccctgtctcaaaaaaaaaaaaaaaaaaaaaaaaaaaaggaaatattatttgcaggtgaaatggttgtatttagaaacaagaacatttaagtggcaggtagttacagaattgatacacacaaatatattttttatacttttgtatgtttaaaaaagccacaaattacaaattatgttaacagcaatataaaaagaatgaaacatgagtggggtttattctaagctgagttgttcaaaattagggtatctattaacataatttacgatgcttctcagagggtttctgttgttcactcagtgactgcagacccactagtactaatgaactactctcttaacttgttattgaactacaccttctccaatgagtctgagtctttaacattgcatactcttttaatctgccttggggtactatatagagctttcttatatcttatagttactcttttattagagttaaaatacttctttatgttaaacttctgtttaccttactctgtgatttatatcttttgattagaaaagactaatgtaccatattagtaggtttttggataaatttttatattattttcatagatgctagaagagcatttgccaaaattcatcattgattcttttattaactttttgtgaattaaagtataacatacatagaaaggtataaaaatcataagtgtacagctgaaagaattactgcaaagtaaacatacttgcttaactaccatttagttctagaaatagaacttggccagcagcccagaagcacccctcacccccaccttcttccccaaaggtatcttctgtcctgacttctaacattggagattacctttgctgttttaaactttaaatatatggaatcatatagtgtgtactttttgtctctggcttctttggctcatcattataagctttatccacattgttgaacatagcagtgcttttgttcattttcttttccatgtcctattccatcatatgaatttatctcagtttatttttatattctactgttgatgatgaatatttgggttgttactagtttggccatattacaaataatgttggtatgtgaacattcttgggtgtgtcttttggtgctcatatgcacatatttcttttctttctttttttttttttttgagatgaagtcttgctcttgttgcccaggctggagtgcaatggcacagtctcggctcattgcaacctccacctcccgggttcaagtgattctcctatctcagcctcccaagtagctgggattacaggcacacgccaccatgcccagataatttttgtatttctggtagaaatggggtttcaccgtgttggccaggctagtcttgaactcctgacctcaggtgatctgcctgccttggcctcccaaagtactggaattataggtgtgagccaccacccctggcccaaagtgttatctttagaacagcagaaatgggagttccagtttttccactgttattttctatcttcagacaaacaactgtttagttatactggtaaactggcagtggtatatcattgtagttttaattgtatttccttgaccatgaccactaataaagttaagcttttaaaaatttatttatatgttgatcaattagatatacttctttgtgaattacttaagttttttacccagttttctattgggtgtttaagaatattttatatttatttatgtatttatttttgagacagggtcttgctccgttgctcaggctggagtgcagtgatgtgatctcggctcactgcagcctccgcctcctgggttcaagtgattctcccacctcagcctcctcagcagctaggactacaggcgtatgccatcatgcctggctgatttttgtattttttgatagagctggggtttcaccctgttggccatgctggtctcgaactcctgaactcaggtgatctgcgtgcctcagcctcccaaagttctggtattcatctgcaagccaccacgtccggcctgtttaagaatttttaatgaatttggctggatgtggtggctcacacccgtaatcccagcactttgggaggccaaagcgggcagatcacctgaggtcaggagttcgagaccagcctggccaacatggtgaaaccccgtttctactaaaaatacaaaaattagccgggcatggtggcacgtgcttgtaatcccagctgcttgggaggctgaggtgggagaatcacttgaacctgagaggcggaggtggcagtgagccaagatcactttattgcactccagactgggcgacaagagcaagactctgtctcaaaaaaaaaaaaaatttttttaaatgaaaaatctctgtactcagggctatgacactttttggttggcatatgtctttttggacttgttctttcattctttaaatggtgtctttgatgaaccgatgttcttcattttaatatggaccctctttttggtgttcctccctttttttagttttcagaagatattgtctatgattggttttacttctattggttttatttcttaaatgtttggtggaattcactggtgatacccttgaagcctggagttttctttgtaggaatgttccattaaaaaaaaaatacttaaagggctttttagattttttttcacttcttaaatcaactttggtaaaatttctttttctaagtatttgtacattttgtcttaagtgttaaaatgcgttagcataaccttttccctacagtatctttctgtgatttttaaatatgcatatgacctatcatttctgctaatgattatttgtgccttctttgtaagagttcatcaattttattagcgtttcaaagaactaactttggctttgttggttctctgtagatcatgatgtatgttttctatttccacgtatttagctccttttttttttttttttactttctttgggtttcatttgcagtttttttccttaccctaaccctacagttgtttttaaaaaaagattcttgagatggatacaggaccatataaaaaattttttttatgcatggcaagaagtttgcataaagtcagaagacaaattacaaacttgtaaaaaaattatttaataccaattacatcaaagtccaaggcctacttctttaatatgtagtgagtttctaaaagtcaataagaaggaaataattatgtattaaaaatgagcaatgtttgtgaagagttgatgtgtagaaaagttaatattaatggcagtaaaacatatgaaaggatgttcatcgtctcatgaggaattcaaaataaaccttctattattaaattggcaagtattttaaaaatcagtaataagtagtatgggcaaagttatagagaataggcgctttcataagctatcataaggatataaattgctacaacctctttgaaggagaagtttacattatttatcaaaattttaagtattcttttttttttttttctttttttttgagatggagtcttgctctgtcacccaggctggagtgcagtggcgccatcttggctcactgcaagccccgcctcccaggttcacaccattcgcctgcctcagcctccggagtagctgggactagaggctcccgtcaccacgctgggctaatttttttttgtatttttagtagagacggggtttctccgtgttagccaggatggtcttgatctcctgacctcattaaccgcccctctcggcctcccaaagtgctgggattacaggcgtgagtcatcgcgcccggcccttaagtattctttaattcacgaactatgtgtataaagatgtttatttccatattacctataaaagccaaaaaactagacataacctaaatgtttattctagagactaggttgtagctacccaatggaaaactatgtagccactaaaaggcaatagactgttggtactggttgttacagaacaagctccaggaaagtttttttgcagaaatacacattttattaaacgagtttgtgggtgaagtgtttgtattttgtgtgtgcatagtaagtttctgaagtgcataactttgtgtatctcactaggtaaatttgagtgttgtatttatggagttggatttacaacatctggtatttactattcagtatcactttaggttatgtttcgttttctcacttatattgtaagctcatagaaaatggaagatatggactgtgttttatgcttcataattttctccacattgcctagcatagtatattgagtgtgaaacagacttggtttttaaaaaacaatttaagaacaaatttaacactaaatatttgttttccagtttcagaacctgttcacattatctttggtgagctgtattgtagctctctgtagtagataggtataatactcattaatttattcatatgttaccatagggcgaactgagcccaagtgaataagtgagttatttaaagtaggggttggcaaactatgagctgtgggctaaatttgtcccacctcttgttctttatggcctagaagttaagaaaggtttttatatgttttaatgtttgggagaagaaagcatattttatgacacatgaatgttatatgaaatttaaattttagtgttcataattaaagtttattagaagacactgatgcatattcctttatgtattgtctatggctgccttcccaccactatggcagaattgagtcgttgcaacacagattggagttggcattttcattgcttcacactgctgcttggcatactacacatctcagtaatgcagttataattcaacagtgtttcaagtgccatatgtattgctgtgctataacactgtattttttttttattactagggcatacctatatgtcaaaacaagaaaaggagaaaatctcatggttttaaagcacagtggactggggattattttatccaattagatggtaaagcattaggtttattatgcccttctaaagaaatagaatatatattgccattaccaggctaagcacttacagtgttccaaattcataggaacataattctcataaaaattcaaaaatttgaaatgtaatatgttacaacagcagaatttttcatgcactcactttttctctcactcactctcacactgaaaaggaggctggacttaatataagattttgaatgacccatttgttagcaaagcaaggagagctatttactaatggtaagttagtaaattttcattgtagcagctaaagaatattttcagaaaaaaattacatttttaaaaatatcattagccatttggtgaccatagttgctttaagaattgaggacattaggctcgttgcagtggctcacacctgtaaccccagcattttgggagtctgaagcaagaggatcacatgagcccaggcgttcaagaccagcctgcgcaacatagtgagaccctatcttttcaaaaataaaaataaaaagagtattgaggattttaggccaggtgtggtggctcatgcctgtaatctcagcactttgagaggtgaaggtgggagaatccacttgagccctggagtttaaattcagcctggacaaatggcaagaccctatctctaccaaaaaaaccccccaaaaaaacaaaaacaaaaacaaaccagaattgaggacattagccaggcatggtggtgtgcacttgtagtcttagcttcttgggaggctgagatgggaggatccgtttgatcccaggagtttgagttcagcctggggagcatagcaagaccccatctctaaaataaaaacaaaaaagtgaattgaggacattgggtgtaacatcggtagtcagttaaagaagatagtggttttacttggctctgatgaaccaacagatgttactgacactgatcagttattcaaagagccaatgctgagtttgaagtgactgaaaaattagctttcatgaaaagtcgatgaaacatctgcagacgtgaatattttcaaaaaatttgagaaaacactaattcagcataatctgaagtagaatctgttaagatgtgttgctactgatagtagtaaaaatatatgtggaggccgggcacagtggctcaagcctgtaatcccagcactttgggaggctgaggtgggcagatcacttgaggtcaggagttcgagaccagcctggccaacatggtgaaaccccatctctacttaaaaaaaaaaaaaaaaattagcagcgtgtggtggcatatgcctgtaattccagctactttaggaggctgaggcaggagaactgctcgaacctgggaggtggaggatacagtgagctgagatgatgccattgcactccagcctgggtgacacagcaagactctgtctcaaaaaaaaaaaaagaaatatatatatatatataaaatatattaaaatacatatttatatcataaactttgtagatttctccacttaacctttttgctccatatatattttaaatatacattatacatatatatggatcagaaaaaagggttaattggagaaatctacaaagtttgtgaaactataaggttgtaaagcctatggctattcattgtattatttattagcagctattttgtagacaacatttgaatctatgatttattatttgaatatcatttattattgaaccagtattatcaacagtgaacttcatttgctgtatgaagagatagttctgtaagtttttatcagaaatttaagctgtatatttgacttgcctgaccacccatcagtttgattactgcagttgtttgagcttatggtcaagattcaaatttttctaaacaaggagaagctccttcaactactgttattgcatatgaaatggctttgaaaattagcttttactgaagactttatattgtttcttttctttcttcttcttcgtcttcttttttttttttttagaaacaggatcttgctatgttctccaggttggtcttgaactcctggactcatgtgatcctcctgcctcaagctcccaaagtgttgggattataggtgtgagccatcatgtccctggctaatacattatttcttaatgatactgatattgttgttgtttgtttctttctttctctctctctctctctccttgtttccttccttccttccttccttccttccttccttccttccttccttccttctttccttccttccttccttccttccttccttccttccttccttccttcctttctttctttcttctttgtctcttttctcttttctcaacagggtttcactctgtcacgcaggctggagtgcggtggtgctgtcttggctcactgcaacttccacctccctggttcaagcaattctcctacctcagcctcccaagtagctgggactacagcctcatgccaccatgcccagctaagctttttgtatttttagtagagacaggatttcaccatgttgaccagcctggtctcaaactcctaatgtcaagctatccactcactttggcttcccatagtgctgggattacaggtgtgagccactgtggcagcctttatatggtttcttaattttgaggcataccagtgcttatatgtaaaacttatactatggtaaagttatttgacagcagctaatgtagtttgaatcacaagtaatgtcaagctgctttatatacaatgtcccattctgtcaaaagttaaaacaagaagtgatacttctatttccacacacatttgtagcagatgtttgtgggctcaaactatagttttagcaatattgatgccagagcagagataacttctttatttcaaaatccatctaacactgcaatcacggagcttctaccttatgttacattagaagtgattaatctgcaatctacatgctaaaggggaaatatcaagaaaaagctctgatagaattctataaatgctttctaagtgataaatatgcttaatttaaatcatatgctattggatttatatcagtatttgggagtatctatttgtatatagagacattcaaagttgaaatatgtgaaattattatagatcaatgttaacagatgaatatttgcgatcaattttgattgataacagtaactttggccaggcacagtggctcacacctgtaatctcagcactttgggaggccgaggcaggtggatcatgaggtcaggagttcaagaccagtctggccaatatggttaatccccatctctactaaaaatacaaaaaattagctgggcgtggtggcgtgcgcctgtagtctcagcttctcgggaggctaagacaggagaaacgcttgaacccgggaggcggaggttgcggtgagcccagattgcaccactgcactccagcctgggtgacagaatgagactctgtctcaaaaaaaaaaaaaaaaaaaaagtaactttaaacaccaattaaatgaaatgttatttcccctaaaagaattacattcttctcattactaaacctgataaacaaaaaattttattgttattaatattcctaaatttgtcagtaaaagttttttgttttataagtacctagataatgtccttggtttttttctcattacccatagagcccaaactatttactacctggccttttacaaagaaagctttctgaccctcatcttcttctaaaagaataatagatgtctaattagaaaccagttatgcattgggttgagtatcctttattagcattttaaagttcttgcatttcgaaaatactaaaaatactcaaatttagaaaagttagttgtcttcataatgtaatttaaatgtttgaagtgttacaaaagagattcacctgcaattaaatatcagcagagtgtgtcctgtacccttatcctgcaacacttttctcctatagtaactgaatgactttggaattcagggctttgtatttttacctttttttaaagcttatttttgctttcttttcttttctgttttttttttgtttgtttgtttttttttttttttttttttttttttttttttttttgagatggagtcttgctctgtcgaccaggctggggtgcagtggcgtgatcttggctcgctgcaacccctacctcccgggttcaagcgattcttccacctcagcctcctgagtagttacaggtgggaccaccatgcctggctaattttttgtattttagtagagatggggtttcaccatgttccctgggctagtttcaaactcctgagctcaggcaatcagcccacctcagcctcccaaagtgctaggattataggcatgagccactgcccccagcctgtttttgctttcaaatggactgttgatggttttctcagagtgctttacttttgaagtccagtttgtactggaaagaatttatattccaggctgggcacagtggctcatgcctataatctcagcactttgggaggccaaggcagatggctcacttgagtccaggagttcaaaaccagccggagcaacttggcaaaacctcgtctcttaacaaaaatattttaaaatgagctggttatagtgctgcatgcctatggtcccagctacttgtggcactgaggtaggaggttggcttgagcctgggaggcggaagttgcagtgaacccaaatcgtgccactgcactccagcctccattacagagggagagcctgtctcaaaaaaaggaaacgaatttatattccacattttactgagtctagtgtgagtttttgtttaaaaaaaaacaacccaggaataatttcttcaaattcataagcatggcaggcagttttattttaaattctgtgggaaatatgaatttaaggatctcatgtaccatgccttgataatcatttctctgtaatgtatattttggcaaatgatattgttatgaaacatacttttgcattaatattaactttatgcataataaagatgcatcttcagttttttgtttgtcctatgagagtttacagctggggacatcttttacaaaagtatatttataacctgttcagaagatatgaaacacaataatgagataatcacctatgtatttttcagttagcagttacaaaaggattattgacacttatagttgttaatatctcagtaaaaacatactcttgtgcttattttaaaattgaacgctagtctatatttttaaagtttccttttatggaatattttgtcttttggcactttgcatctggattatagttcccccatttaagaaagaaacctgtttctattcaataggattaaaaacacactttcagttttagagcagatttatcatctacccttcaggctattctttaatatggagctcttaaaaatgagtatattaagatattccccagatgttttaaacttcagcaaacttgtggttttctttatttgtagtatttggaagatgaaagaaagtatctccagtatctaaacacttttcatattggttttaatgttgttttttttttttttttttttttttttgctagaaaggcatgcacaagataaagcttctacactgataaattttcaaagtccttgcttttaaaatatcaagctgggtgcagtggctaacgcctgtaatcccagcactttgggaggctgaggcgggtggatcacctgaagtcaggagttcgagaccagcctggccaacatagtgaaaacccgtctctactaaaaatataaaaaattagctgggtgtggtggctggtgcctgtaatctcagctattagggaggctgaggcaggagaatcgcttgaacccgggaggtggaggttgcagtgagctgagatcgcaccattgcactccagcctgggcaacaagagtgaaactcttgtctcaaaaaaaaaaaaaggtattgtcaaaatgagagttgtattagcagtaatgtaaaagtaatattgtatgtctgtatacttttgaatttacattgttatgtgattcatatttgttttgtatagctgtaacatttggttaattgtttagtgggttattgaatagattattttcttcattacttagtacagtggggattgagaatgctttgtatcaagtgtcttacaagtattgggaagttcgaattaaaaatattaaagatgtcagtcatttacttctttttttttttaaggtggtagcccaattgaaaattttctgcaaaatcagtaactaagttatttttccacaattataaacttagttgatggcatttattgagtgcttactacgttcaaggtaaatgaaatgaaagagtggaatagtgcattatacacgcacacactcaagggaagcaagtataaacaccttatttcatctcacttgtttagaaatttgattttgttttttcttgctgggtaacatatctgtgttaatcgaaaatttatgacttagagtggaatttctctaaaaagcagtaggtgacagggatacaagataaataatttcatcagagaatagaaattcttttttacaatggataaaattgtgcttgtaacagggatacaagcacaaaccaaatcaatgtttaattattttaaaaatattcaagggaaatctagttttgttaaaatttgtataggttggtagtgtgcatgttcttaaaaatccaagaacaatagcagcagcaattcttatttaatctttctttagtgtgtccattcaaccattcattcatcaatttttttttctgtgtacccattattcatcaggcactatgcttaaatatcgtggaacacaaaaagaaatagtctttaatgctgtgttttacaaatgaggaaacctaatctcggagaacttaaattacagttgtcctttggtattcatgggggattggttccgggaacttcctcagataccaaaatccaaggattctcaagtccctgatataaaattctgtggtatttgtatataacatatgcatatcctcccatgtactttaatttctagattacttataatacctaatataatgtaaatgctgtgtaagtagttgttatactctcttgtttagggaataatgtcaaggaaaaacactctttacatgttcagtacatatttttccaaatattttcaatctgtggttggttgaatccatggatgtggaacatacggatatggagggccagccgtacttgccccatgtcatataattagatgaatatagaattaaagccaggtccgtctgacagagcgtttgcttctaaccattgaggaatgttgcctaccctgatgactctactataggaaatcatatattgatatcaaattgatcttatatgtctgtagtgaggaacttggccatgttggacctatccccttccctccttgctcctctcctttcttcctcccttacccccacagcttcacccctcccttagctcttttttctgacaggtggctgtttccatccctgtttgctggcaccttctccacttaaattttggtatatcccttggttccactctctgtgttcttctcttgtgtatgagtgtggattttgtgtttgcttatcctgtgtggagtttctgagcttgaatctgttaagagtatgtcattaatcaaatttggaaatttttaagccatttttttttctttctttcctttccttttccttttttagaagcaggttcttgctttgtggttcaggctgcagtgcagtggcacaatctcagttcactacagcatcaaactcttggactgaagtgatcgtcctgcctcaacctcctgagtagctgggactacaggcatgcatcactatgcctggctatttttatttttttgtagaagtagggtctcactatgttgcccaggctggtttcaaactcgtgggttcaagcagtcctcctgctttggcctcccaaaatgctgagattatagttgtgagccaccatgcctggtcaagccattattttttcaatttttttttttctgcaccgcacttcttttcttctgttactcatgcacaaatttagatcttttagtattgtcctataggtctgagtcttttttcattttttaaaaaaatcctttttctgtcctgcagattggaaaatttttattgatttatttttaagtatactgattaacagtcttcttcattttactattaagcccatctagttagttttaaatttctagttattgaatttttaaattctaatatttttattttatcttctttatcttctgtttctttgctgagtcttttcactttttctagctgtctgaagagtcctagtagtttgtggttccctggagctctccgccttggtaatccagccagagaactggggctttattttctcagctctgcacatacttcctgtgactgtaaccatgtctgggtctaagtagtaggcagatactcttctcttgcttttttctttcttgtgttttagtcaaattattttacctcttattataactttgtttattattatttaccaacactttatatgcaaattgtagattattcagattgtatcttctaccagagtgttcactcttttctgtatgaggctgatacggagtgaggggagagcttattaccttaataaaaattaagggttaagctaggtcaaagttgatttttcagtgttgacagttcagttgagcctgtttgcttctgttcctagagcctgaacctctaggacttttaattgataccagtggtctccgctctgaaacagtccaccagaatgagggtaccaaactgacctcagaggtttccaggttaatgcagaggtttctagcttaatttctttctgccttcaaaatttggcaattatgtcaaaggggaaaatgatcttttgttttaggttttcagtttccaatgttactacttcagccttatgtaattgctaaaatccctactgttttccccctattgcccccttccttatcattatcttctgctaagcacaaagtgtgaattttcaggttccacatgtaaccagtataagtatatccttccccccaaaccccagtggaaatgtgccacggatccttatttttattctccactccttctagggctttcatttcttgcctattatgtttttagttgctcttttcttgttctgtctttgtaagcacagctagagtcagagaactttctgcttttggaactattttggttaacctctttaacttagcattcagtttcagaattcagcaaatgtgttttggggcaaactagctgtgtgttttaggtttgggaaatgtcaaattttgtttctctgtcttcatgcttctggctgcaaatgttggcaggtggaacaaaaagctgccagttctggcctgcccctgtgaacaggtctcacctctccggaaatttatccactttgtccttgttgcttcagagctctttggtaccattaacaatgtgacttatgatttatatggccttcctaggtgtcatcagtaggaatgttggctgtgatgcagtatatgctacccagaatcggaagttccatatattatgttttgataagagattttaggtgtttgagtatttctgatgagtgacattttttgaagtttgctagagagaaataattagctagttattgcttaactactctctctccatatctattacatatgtttctggaatatttctatggtcagagaaactcaggcccattataaaccatggactctggtagaaatagaagctgaaagcaaaccagtaagggaggtggagtgtataatttgtgttttggaagtacctgccggtggacttgggggtgatgctctaggtttaccatgagattactcatctaattttgagaaccactgtcctgcagtatttttcttttgcttacatatgactttttctttttatgatttaaaactaaatgtcaaccagttactatttaatgaaaatcataaattggtttagtgaaattttgttgtgttcttacaatgggtagaaacctaatgcacttatcatgcatctaaatttaggaataattcattttattttaatcatctatacttatatacaaaatgcttttcagcagtatatttgattatcttaggtacaatgatcttcatgttcagagttataaatgggaataattaaacctttaaacatattagagttgaataagggcttatctaagcaatacatgcttaaaattgctttcttatcaaaaaaataaaattggaggttcaagaagtgtctttaaattacaatccttatgaactaatagcttaaccttagttttgaataactgttactttttccgtcttttaaaaagatgcttaaaaataaacgcatgtcgaaaatgttattttggcttttagcaaactgacatttgagttttttaaaacctcactaaacatttgtggtaaaagatttcaaagctttgaattttacaatttgcctgtcgattccccccctgtgttattctattaacatttgatcttaataagtataacctgtttagaatgacttatgtttttaattatttgtttagatgagaagtttaaggaataacttcatcagaaattctacttggcagttatgaatgctttcttaaggaagttaaatttttggaatttcactgtaaagattttaatcacatgtcctattcttcatacatcaatctataaatgttcaaaaattgttaatgttgtttttatgctgtgctgatgttaacacaacgtgaggtcttctttcttctcctgataatatgctgagcgcacacacactctcatatgctcactcgctctctctctctctccttccctcccacccctgagtttgaaataagttagtggctttagtttctttgaaaatggaaagcaattgcccttaggtagaactggaaattgtaaagtgttggttttgtggacattttcctgttcataattcttgttatatcttatttataagtacttttattcatataggaataaatgattctatgttgaagggtataatcatgaagtcttttttattttttcgtgttagataaggagaaaaatgacacattaaaaattacagtgctatttgtgttttaaaatttcttctgtcgcttttgtattccttattgttctcttcactttttctattgtttttctagcttttcaggatacattttctaaatgcatcctaaatataacttacaatagttgccttttatttaaaagtaatacatttagtttccaaccacaaagtgtttaattctacatatttctatttttattttacatgatcttaatatatccttgattactgtgttgatcttctagtttttaggctgccacttataccatcaaaagccatttaaactggacttagaggataatgaatctaaattttcttatcttcctcaaaacaacagatacaattaaagtcacaaataagctgtaccttcagaattgctaggagacagaacatagtaagaattcaaatctcttataagcagagttataaacatcatattccaatattgattctgctgctttgtctgtacatttggagagcagaggtagcagggaggtttaagagactgaaaaaagggagaggggtgtatgaagtgtagatcagtaacaaacaccatcactcttgaaaagaaaaagtccaacagaggtcctagacctgtgttttagacaggtgggaggacagtaaattaatttttaaagacaaaataattatattgaatgaatttattgatcattttgttgaacagttagtataaggacatcccgtattatatttcagctttcataaactataagtgtttatgtcttatattttgtgttctttcaactttatcttaatttgcttctgttatttttaatgccatttttgtacatttgtttaatattactatattcatctttgttgtaattttttcctgtaataatgtaacataaataattataatattacaaagtttattaaatttcttccaatgataattaatatagtaggcttgtggtggaaaaatggatcaggtactgtccttccaattctgtcaggcttttgattgaggtgtttatatggccaccccgttcagacaaagaatgtcaaccaaaaggagaaagtaagaaggaatctataaattactaaaattcccatactttatttcctatggaaaaagtcatgtaaggaaaatatatagaagtttcccgtaaaatgtaataatatcataaactctttcatccttaaacacctgttagtcttgccacagcacaatcagttccctaaagataaatatttcttggtttgttagttggctacttaggagttccttttccttcttatgagttttcttctctcctgtatttcttttctaacaccatccaactggttatccaaactagcaacctcagaattttcatccctcttccacatcttacatttctttatcacatcctgtgtcttcaacttcggaatgattccttactttggtctcgtctctctatcctgtctttcgtatgagctattctaaaggcaggtggtctgcttctctttactctgtccagtgttatcatcatttttaaaaagtctgcttttcacactgttgctaaatagagtttaataatttctagtagccttcagaataatgtctacacttattagcctgatagttaccttttctttgtcagtttttactactttgattttgacctgcattttagtctgtgtttaactggtttttctgaatacgtcatgtttattgttttagcctcaaccctgaattttttttttctcccttaagtgtcaaatttcaattcagatgttaaactttccctgcctttttcattcagaatcacttctttctttgctcttgttttttattcagctttgttctatatatggttctttaaaaataattgtatggaaaattgctatgttcttttattataaaatgaagttgatttttcattacaaaacagtttatatgcttattgcacaatctaaacagatgtataaaagagccataattgttcctaatttggcgataactactgttaataccttggttgtattcttccaggttcttttcagtagacatgtatattgggtaattttgtttacacaaaaagattacattgtgcatcagttttcataaattagcacttctcatttgaaataacatggaaaatacctatcaatagatgtaaatctattttaaatctgtaacatttaaaaatgtttaacacttaagtagaagcaacacatacacatagtaaaactacatcaaggtggaaaattaaacgcttatttgaagacttctaattttgggaaattgactaattctgctattcttcaggatttctcaggccaaaattcagaacaaggctaaatttgcccatttccacctactattatttattctttctttatattatgctagagcttgtaggctctgtactaacacaagaaaggggaagaaaaaaattgtccttattcacaaatgataattatgtttaatttattaaaaacacataaatcattggagttaattaaatattagaaacttggctggaaaaaattgatataaagaatgtttctaaatatcagccacaaataaagattaaacaatatcataatagtattaaaacataggaagtatgaagtagtgatcagaataaaagatgtggaggctttgtggcaaacattatgaaactttgagagatactgtaatcatggattagatgatttaatattggaaatatatcacttttcccagcatagatatagataagtagtgcaatcactgttaaaatcctaacaagttgggctgggcatggtggctcacacctgtaataccagcactttgggagtccgaggcaggcagatcacgaggtcaagagatggagaccatcctggccaacatggtgaaaccccatctctactaaaaatagaaaaattagctgggcatggtgggatgcgcctgtagtcccagctacttgggaggctgaggcaggagaatcacttgaaccagggagtcagaggctgcagtgagccgagatcgcgccagtgcactccagcctggcaacagagcgagattctgtctcaaaaaaagaatcctaacaagttggtttttggagtttgacaactagttgtaaatttatatggagtgcaaaaaaccaagaacggccaaagcactcatgaagaacaacagggtaaggacacttgtagatagagtgtgtgtgtgtgtatgtatatatatgtgtgtatatatattatatatgagagatagttataagatactggggtttctaagtcagtccagtgtgttttttcttaacctgggtagtggttacacagacattcactttttttttttttttagaacagaaagtttctaagaatttatagcaccaagacattcattttttaaaaattgcacatttattttacttatcctagagaaatttataaaaaacaaaagtaaactataaacaccagttaaaaaaatccttttatattaactccatagagatgcaaatactgttaacagttaatgttttcaggggcctggctccatggcttgcacctgtaatcctagcactttgggaggctgaggtgggaggatcgcctgagctcaggagttcgagatctgctgggcaacatggtgaagcctgtctctaaaaaaaaaaaaaatacaaaaaaaattagccaagtgtggtggtgcatgcctgtattcccagctatttaggagactgaggcgggaggatcccttgagcccaggaggtggaggctgcattgagctatgtttgcaccactgcactccagcctggatgaaaaaggaagattctgtctccaaaaaaaaaaaaaaaaaaaaaaaaaagttaatgtttttagcttaccattataagtctaaataatgaatttgtgcttatttttaattaacaaacttatacaatgtctgtaaactctatactggaagatgaagaatgtagtgcacttacactgttttgcctttttattcttccttatatttgctttagtttgattttttattgattgactttatgacttcaacaatatatttaaaacctttttaaaaacttgatttttaacatttgagatatttatggagtcttctccatgaaagggagaattttgcatgcaatagtgtatgatgggcacttttaacttttttatggctttctttttcaaagtcatacaccactttacttttcttttaacctaattccatctttcttctgttttttttgggggggagaggttggaacatctccttagtaattttttccacataggaaaaaggattattaaatattactttgccttattaacctgataatttgagtacatattgaaaatttctagtttcaaaaatttcctcccttctcagcatagaatacattactccattatatttttagcatccggtattctttgagaagttaagtattagtctgatttttattccttttaaggtaattattatttttcacattatatgctttaaaggttttatcttaatatgagagattaaacaagatgtgtccaagtatggggtcctagtccctaatcccttgtaaaactgcttgatgtttggaaaaatctgaccatatttatgtttcaccttttttttttccaacatttctctcttactcttcataatctctattttccctttctgtatttcctgttaaacagatctcagaccacctaataaattctctacaccttttaatttttatttcatatttttaatttcttatattttctatctacttttttggtctttttaaaaatttcaacttttctatttttatcttagtttttacccatgcatattttgattgctcaggtaatccatccaactattgatttttcaaaaatttttcaataattgttagtgtacagaaactgtgtcattctctagctgcatcttttcatataattagataggtctgtttgtggcatctttctttccttgctttacaggcagtactgttatacttttgtttatttttatacataaaacatattttttgacgtttagtaagatgtggaagaggaaatgaacatatacttcatctcttttgaagtgtaaggtcttataattttcatacttcttgaactgattccaagggtaacattaagtgaaattttgtttagtttctatagaaaactctgttagttgtctggaatgaggagaaatacatgctgatttctgtatgtttgtagtaacaagtgattctgagactgggattctgattttgacttaaccagtttgccacgtgacctccatttggcaatctattaattattacttttactttctgtttagtttaatggccaattatggacagtctgttttaaattcttaaattcttatagttgtacacttatggaaaacatttcttaaatgtggaaatttagtatttttgttataagatatttcaattcatttattcaacatacttaaacaataaaaacattttactatttgtgttttaatactcttctgctcagaaaagtttactttgttgcaactcacagaaggtaacttacttttttctactgtgatttccttataggtttgatgaacttgtgaaaaaattcaaagtcgaatatcatgctggtggctctacccagaattcaattaaagtggctcaggttggttaattattttaaaagttaaaaggattcaaaatgattctagacccatgtctattttgcataattgtttccttttatattgtgttgctgtagaatagttttgttcatttgaattgggattttagtagtcattgcacatctaatcaaaagttattttaattggtatttctttggttattggtaagcttgaacttttaatgtttattgttcatttgtgtttcttcttaaattgtttcctttcactatcattttataatttttcatgttacagatttgtagaaacttcatattttatagatagtattcctttttattttataagttgaaagtatttattttttgttatgtgtacattaactcttacagtgtcttttactgtgccttagttcttaatgtaactttcaaagtttttaacgtaattaaactttatggcttcttcatttcctgcatgtcccccttacgaaggacgtttctgccacaagatagtagaaattgctctgtattatatatagatatctatatacataaatgtacattcatatattcatacctaaatatctatgtatagacatatatgttggtagatatgtatatgcatctatatatctataccggtgtatatcttttataaatctatatatctgtctctattcccatatcttccaatgagtaattgaataaacccattaggcatatactctttgagttaccagcttaacctaatcttgattgagagagttagtgatctgtttaatcttccagctttgaaagatatgaacaagttttacatacctctggttcttacctctgcagtttgaagttaactcaaaattctgctcattgcaatcatgtgtcagttctgcctacactagatttctttttcttttttattgattaatgctttccccttgaattctgattaacttcaagaactggggaagtggaaaattgacaaataaaatccagaatgatttcttttcaagtaactcttagttgattgagacatatagtatgattattccacatacttccaagctcagatttaatcatagttttcaaatattttgtaaaaatgaatctttaaggcggtcattaatatgaagtggcctgagtctttgtattggtcaattgatttgtattgtttttggtaaaacatcctggtggtcactttatgaacttccagagtaatagaaaaaggatgatttacggccaggcacggtggctcacgcctgtaatcccagcactttgggaagccgaggtggacggatcacttgaggtcaggagatccagatcagcctggccaacatggtgaaaccccgtctctcctaaaaaaatacaaaaattagccaggtgtggtggcatatgtctctaatcccagctacttgggaggctgaggccagagaatcggttgaacctgggcggtataggttgcagtgagctgagatcatgccactgcactccagcctgggcaacagagtgagactccatctcaaaaaaaaaaaagagagaaaaaaaggatgatttacttaagccttaatttatcaaggcacgttttgcattttgcagttttcagtcttttctcctgctagaactgggggtgatatggttaggctttgtgtccccacccaaatctaatcttgaattgtaatctgtataatccccacatgccaaggaagagaccaggtggaggtaattgagtcatgggtgcagtttccttcatgctattctcctgatagtgagtgagttctcacaagatctgatggctttataaggggctcttacccctttgctcggcatttcccattcttgctgccttgtaaagaagatgcctttcttctcctttgccttctgccatgattataagttttcagaggcctttccagacatgctgaactgtgagtcaactaaaacttttttctttataaattacccagtctcaggcagttctttacagtagtgtgaaaatgaactaataccgggaggctattagctgttcactaataaattgtctcctttcttggggatcttcatcagtttctgccttctaaaagtttattaattatataattaagttctccctcagctttctccctgatattagtctcataataaaacagtcattgcctacttttattcttttgcacttttttttttacaatatttcacattcattctaacaacgtattctagtagtggtttatttgttcctgtctttagcaaggtaataaaaggaatttgaagctttgggtaacttattctgtcagatcttactagtaatcatactttcatgtatcaagtgatatggcaaattatgtcaacaagaaaatgtccccaaagctcttaggtattttgatatgtcaaatcatgtttttgaagattttaatgaaaccataggcaacaaaaacaagtatggttgatatcttgtccaaacacaattctagatttatttgatacacagcacaaatgtaaattttggtaaatttcatttggtctgaacttcttcctaatgaaagtgaaaagttcttatctgctcaatatcctgcacagcatgtatataacactgctaaaaaggggtataacttgcttaagtttgataattgatgctttcttaatgaacacttttggttactttgtcagtttttaaaaaatttgtagaagcacttaatgtgagttttgacttgaaagaaatggaaaaacgttggcattgtgactcatgcctgtaatcccagcattttgagaggctaagttaggagaatcgcttgagtccagtagtttgagaccagcctggacaacatagtgagaccctgtctctaggaaaaaaaaaaaaaaaaagaaatggaagaaaatgacttccttggatatgtgcctaaaagatggctattattgttgctggacatagatgccctgcagtacaatattaacaaaatatgggaccaaaggaatgcccatctctgatttggcagtacattgagaatgagaatggaaaaagaagattatagtaaaacaaatatttttatgctgtttctggtttttttgtttgtttgtttgtttcaagacggagtctcactctgttgccaggctggagtgcagtggcgcgatctctgctcactgcaacctctgcctcccgggttcaagtgattcttttgcctcagcctcccaagtagctgggactataggtgtatgccacaaagcccagctaatttttgtatttttagtagagatggggtttcaccatgttggccaggatggtcttgatctcttgaccttgtgatccacccgcctcggcttcccaaagtgctgggattacaggcatgagccaccgtgcctggcctgtttctgtttttgaagaggccacaagtgggctagaaaaaacacataccaaaaaaatactcaaataattttatttgttcattatttattaatttttttgagacagaatctcttgctctgttgcctagactggaatgtagtggtgtgatcatagctcactccagccttgaactgctgcgctcacagggtcctccttcctccatctccacctccatctcctaggactacaggcacaccctaccatacctggctaatttatttgttgtagagacagggtctctgtgtgttgctcagattggtcttgaacttttggcctcaagtgattctcctgtgttggcctcccaaagtgcgaggattacaggtgcgaaccattttacctggctcaaatggctcatttttatatattaagagtgcttcagaactcaagtaaaaaagtcacagaaaagagcaatgaggttaaataaaactttttttcagtttctttactaaaactgtaacttacttggaatccagttttgacatcagaaattcaaattcaggtgttttaaaaccatttctgcaagaaagaaatttaagttaggatgatagccaatgtctttcagagtgttttaaagtgatggacattttgaacattgataagcctatataatgaatctgtaaacacaagggatatgattcataaagagctggaatgccaaaacctgcatttagctaaaagatagatggatatttttatagaactataaactaattcctatatctaaacacctattattgatagtaattaaaatcctaagtattctatgtttacatgcttttgttgagaggatatttagcttaatgtcattgcactggactgacatcaagaatgtgggcttgatgcatcagaggtataagtcacagtgaattttacctttgactgtattacgttttaccacacatacaagaaggattgacctaatggctctagtcaagtatagaaaggaaacataaaagtaaaaatattttattatttcttaggcaaaaagaagcatgcctttattctttttaattaaatattggtaaaatgtttaatccaactgtggttacgttatttttttaaaaagtgtgatagaaataaacaacagaataatatatgattttgaataagttcaatattagtttgctagggcagtcttagcaatttcagagactaggtggcttaaacaacaaagatttattttctcacagtgttggagtcccagatcaaagtgttgacaccttgattccttcagaggcctcgcttcttagcctgcagatggctaccctctttctgcctctttgcgtggtggtttctgtgtacatatgtacctctggagtgtctctgtgtgtcctaatgtcttcttataaggacaccagtcagattggattaaggcctaccttactgccctcattaatttaattaccttgttaaagaccctatcttcaaatgtagtcacattgtgagatactggggtttagggcttcaacatatgcatagtggcaggagggtctgtggaggggtgtttataattcagccgataacaactatgtgtttttaaatttttgtgtctaagtaataaaacatgaataagttaatttttggtagtgttcttttttgataccttcttccttttctttcctgtatatgttttagttacttttattatttaccatttgaattacaatgaacattctaaactcataacaacctaatttgaataataccaatgtagtttcaataatatacaaacactctgctcctttacatctccatcctcttcttatatattattacgctcattgattacgtctttatatattgcatgcccattaacatagatttgtaactattcttttattcatttgtcttttaaatcatataaaaataaaaggaattacaaaccaaaagttcagtgatagtggcatttatatttactatgtagctacttttaccagagttctttacttcttcatatggcttctggttactatcaaatgtcctttcatttcagcctgaaggactctctttagcattttgtgtagggcaggtctattgttaacaaactgtcttagcttgtgtttatctgggaatgtcttaaatagcccctttattataggatagttttgttggatatagaattcttggttaacggtgcttttcttttagtatgttaaatatgtcaactcactgctttttggcctacatggtttctgatgagaattagttcttattcttactgagaatcctgacttgtgaccagttgcttttctctcactgatttcaaaattctttccttgtctttgtctttcagcagtttgactataatgtgtcttggtgtgaatctttttgtgtttatcatgtttagagcttattaaattcatgcttcaagttcatgcttggatgtgtagattcattcattttatgaaagtcaggaagttttggaccattatatcttcaaaaatttttttcttttattttctctttgttttccttctggcattctcataattaatatgttggtctgtggtgattgtttagtgataaggattctgattaaataagatagaaaaaaacaccatggtgagtaagcaaagcagaaatagaaccccactgttttaactagtaacctcagcttgctttttttaccggagatttttctctcatcctgagaaaacttcaatttttacttctctaaatgttagagattttgagtagtgtttcacatgctttcttcacttcttactgtcttcttcaatttgggagtaattgtaggttgtcagagagagtgtcgaatatgcatcactttaaatacagttatcagtaaatggactctttcattcatgcttcccagagatgacagttttccttggtgcctagatacctttttgttccttggagattcatagtattatgtgactcattgaatttttcagaagcctgatggtgagcttcgtgaggtatttctatttaagttgtaagttcgcttgtttttaagcttcctgcaatttaacttacctatagtatttttaaatttattttaaaaatgccatcttggggtatattctaggcatctcaaaaattttaaataccatcttatcctttgttaactggaatataagcaggtaatcatttgaatcattttttttcctgtaattattataacattgaggctatatggatttttttttctttttttaatttgaggcagagtcttgctctgtcacccaggctggagtgcagtggtgcgatcacagctcactgcatccttgacctcctgggctcaaggaattctcctgcctcagcctcctgagtagttgggactataggtgcacaccaccacacccaccttatttttaacttttttgtagagattgggttttgccatattaaccgggctggtcttgaactcctgggctcaaatgatcctcaagacattagcttggtctcttctcaaattagcagatccttatttctgtcttataatttctaatctgcttttataattattgacttacattcaatcttccagtttttcatgtctcttccaattagataagcctccatatttgtatttaacttccagtaaaattttaaccatgttgtttcatttttaattaaaatttaagaggactgcctaaatgccagtgtgtttatgttgtatacatctcggggcatgcttttaagtgttttcttgatgtaaaacatcacataataaactagtgttcataattgtattttaaagctttccaaaattctatgtaaaatgagtttctaaaaacactaaacaaaagaagttttaggaattatgtttgaatgaaatagaaacattgaactcaaaattgtaaagctgatatttcaagaactaccaattagtgtaacattactaattgagttacagtatttagaagttaaaactgatgtaaatcaaaggactcatgttgtttatctattttgaatccttttttgaaaaaagttaatctttaaagtttttctgtattaaaaaaatctgattatctcttgtgacctattttacctagaaaagctagttagaggttaaaaggttttttatgagacatacttctgtgcatcggaacagtccagatgtaaatttaaaaagaagaaatgacaatgaagtgatcaaagagaattctgtgttcaaatgctttcacctggagcagttgtagaaatgtcagtagcacaactgtatttataattatagcaggatgtggcagatggtgatgcaacaccgtctcgtcaattctttgtgtcattgaagaaagtagtaagtattaattctgccaattttatgattaatgaataattttaagtaacacaggccctacgaataaggttgactgttcaaattgtgatacctcattatagtttttaaagtttaaatatgaattaatactcctctttgcctttctgttctctttccttttcaaattaggttgttaagttttcatagctaaaataagatgaaggaagcagtggcttgctgtcctcaattatatttttgatgtgtttgtgaaattattataacttagatcagattctttaaagaaaaatcagtatttcattttttcctttcctcccttttctccctctctcctttccttgtctctctcctttcctttctctctcttcttccctttacccctcctctccccttcccttctttctcctcctcctcccttcctcacatctctttcccttctcctcctacccttcctcttccctcccctcttcttcctttcttcctactttgttttatgcattatgttaagaaattgttttactgctattagtgataacatgcttttagttctgtcttagcagttatggttgtgctctccaggataaatctacacatatcacagttatccacttcataaaagaatgacatatctctactcttgtgggccttaatgtcatgcagtgtttctgggtatgacattaaacatgggtacaatttgaaattgtatttttctgtctaaaagcaaaacaaagcttcatcaagaaatactacaagcagtgggacctaatttcatcaaggggataaaactctattcctttttattctattttggaattggaattcagaaacatttttttttggtcctatggatggtatattcacttatttgaaatgaaaattgaactcagacttttctgaaagagtctcatttgttaattggttgacaaggatggtctttgccatttaaatgatacagtggtactgtcagctgtcattgttcttgaaagcaaagaaaatatttaattgtattgattttctgacttacgttcgaattaatacacatttccttcttctttaagcaactttattggaatatagttcacgtacaattcacctgtttaaaatgtataatcttgtggcttttagtgtgttcacagatctagctagctgtgcaaccatcaccacagtcagtttcacaatattttcttttcttttcttttttttttttttgagatggagtctcgcactgtcgtccaggctggagtgcagtggcgcgatcttggctcactgtaatctccacctcccggggtcacaccattctcctgcctcagcctcccgagtagctgggactacaggcacccgccactgcacccggctaattttttgcatttttagtagagacgaggtttcaccgtgttagccaggatggtctctatctcctgaccttgtgatccgcccgccttggcctcccaaagtgctgggattacaggtgtgagccaccgctcccggccccacaatattttcattatcaaatgaagaaactctataaccattagtagtcattccccatttctctctcaccccctcatcttctgtccattcaaccccttggccccagacagtcacttatccagttttgtttctataggtttgcctattctagacaattatttttatttttggagatggcatcttgctctgtcttcgaggctggagtgcagtggcacaatcatggctcactgcagcttccaactcctaggcacaagtgatcctcccacctctgcctcccgagtagctgggtctataggtatgtgccaccatgctcagctaatttttaacttttaaattttctgtggaaatggaatcttgctttgttgcacaggctgatgttgaattcctgacctcaagcaaccctcctgcctctgcctcccaaagtgctgggattacagttgtgagccactgtgcacagcctttcaccaattgtcaaaaacttattcatgtatgtgattgtagattctttgaccaacatctctccatccttctacccctctaattacccaagcctctgataaacaccattttactttctccttctatgagatcagctttgttatagttcacatatgagttgagattatgtagcatttgtctttttgtacctggattatttctgttaacaagttattctccaggttcctccatgttatcacaaatgagaagattttgttccttttttttgtggatgaatagtattccattgtgtatatatatcgcattttatttattcattcattcattgcctgataaactcttaggttgattacatatcttggctgttgtgaataatgaagcagtaaatatggacgtgcagatatatcttaatcatttccactgaatatgtacccagaagtgggattgctggatcacatgttgtaccgttaatttcttaaggaacctccatacctgttttccataatggctgtgctagtttacattcccatcagcagtgtacagggttcccttaatatttcgggtactatagccttttgtaatatattttgaagtcagatagcatgatgtgtctttgtcatttttgctcaagattgcttttgctatttgggatcttttgtggttctatatgaattttagaattttttttctatttctatgaagattatcattgtcatttgagagggtttactttgaatctgtagatcactttggatagtatgggcattttaatgatattctttaattacatgaatgcaggctgtcttttatttgtgtcttctttaatttctttcatcagcgttttatacttttcatcttagagatcttttatctccttggttgaatttatcactaggtattttagctatttttatagctattttaagaggaattgtttacttgatttttgtttttttcagatagtttgtggttgatatatagaaatgcttttgtatgtttattttgtgtcctacaactttactgaatgtgattattagttctgacagtattttggtacattctttagggttttctgtgtatgagatcttgttgtcttcaaacaagaacaatttaatttctacctttccaatttgtatgccttttatttctttctcttgcctaattgttctggctgggtcttctagactatgatgaatagaaatggtgaaagtatacatccttgtcttgttccagatttcagaggaaaagctttcaatttttccccattcagaataatagctttggatttttcatatatggcctttattgtgctgagctgcattccttctatacccaatttgttgataatttctaacatgaaagaatgttgaattttgtcaaatgcattttctgcatctattgaaatatggttttttcctgcatttaatgtgatatatcacagttattgatttgtgtatgttgaaccattcatatatccatgggatgaatccacttgatcctggtgaattatcttgttaatgtgctggcttttttttttcttttttaagacagagtctctctctgtcacccaggctgaggtgcagaggtgctctacctcctggattcaagtgattcttccgcctcagcctccctagtagctgggattacaggcaccaaccaccatgcctggctaatttttgtatttttagtagagaggggtttcaccatgttggccagggtggtcttgaactcctgacttcaagttatttacttggcctcccaaaattaatgtgctattgaatttggtttgctggtattttgttcaggatttttcttctatgttcatcggagacattggcctatagttttcttatttttgttgtgtccttgttaggttttggtatcagggtaatgctgattttgtagaatgagtttagaagaattctttcctctttattttttaaaaataatttgagaagaattcgtattagtttcgctttgaatatttggtagggtgtgttggcttacgccagtaccccagcactttgggaggctgaggcagaacttcaagaggccaggaatttgaggtcaacctggacaacatagtgagaccttgtttctacaaaaaaaaaaaaaaaaaattagcttggtgtggtggtacacacctgtagtctgagctacttgggaggcctcttgggaggctgaggcaggaggattgcttgagcttaggaggtggaggctgcagtgaactatgatcatgccactgtactccagcctgggcaacagagcaagaccctgtctctttaaaaaaacagaacaaaaattttggtaaaatacagcagtgaagccatcaggtcctaggcattttttcttttttctttgatgggagactttttatcactgatttaatctctttacttattggtctgttctaattttctatatcttcgtaattaaattttggtagattatatatattcagaaacttatttcttctaggttttctagtttgttggtgtataattgttaatgagagtctcttataattctttatatttctctgggatcaattgtagtgtctccttttttgtttctcactttattatttgtgtcttctcctttttttcttagtctagctaaaggtttgttgcttttggctatcttttcaaaaacctaattctttgttgtatttatcttttgtatgttttttaggtctctatttcatttatttcttctctttattatttatttttttctgctaatttggagtttggcttgttcttgtttttctagtcccttgaggcgcaacattaggtttatatctttcctctttggggatttatgtgttaattactataaacatcacttttagacctgcttttgctgtatctgataggttatgctttttttccattggcattgtttcaaaaaatctttttgtttctctttaattttttcattgaccatgttgtttaatttccatgtatttgtagagtttttgattttcctcttattattgacttctagtttatgccattgtgatcggaaaatataatctatgattttgaactgaaacttgttaagacttatgttgtggcttaatatgtactctatcctgaagcatgtttcatgttcaattgagaagaatgtgtaatcttcagccgctggatagaatgttctgtaaatgtctgttaggcctatttggtcaagagtgcagtttaaacctaatgtttcttttttggttttctgtctggataatgtttctgttgcttaagtggggtgctgaagtttcctactaggtagaggatcagaaaaaataaatattacatactcagcttagtatctgggtgatgaaataatctgtacaacaaacccccatgacacaacctgtacatgtaacaaacctgcacatgtaccgctgaacctaaaataaaagttaaaaaaaaaagttgtctactatgattgttttgtactctatctttccctttagatttattgatatttgcttatatcaggttattttaatctagtaacaacttaactttgattgctaaaaatgtttaataaacactgtgtactttaactcctctttttctctcacattttgaatttttttctgagatacagtctcactctgtcacccaggctggagtgcagtggtatgatctcagctcactgcaacctccacctcccgggttcaagcgattctcatgcctcagccacccaagtagctgggattacaggtgtgcaccaccttgctcaggcaatttttgtatttttagtagagacggggtttcaccatgttgcccaggctggtcttgaactcctgacctcaagtgatctgcctgcctcggcctcccgaagtgctgggattataagcatgagccaacttgtccagccacatattttgaatttttgatgttacaacttacaacttttaaaactgcatatcccactatcaattgttgtagttataattatttttaatagttttatctttaatcttcatattaaagatataagaggtttacatactatgcttacaataggccgaatagccacttcccactcattttttccaccatagaaaacttgcatccaggggacttctgcatatgtgggcttaggggaagggtgttgcagtcaaagcaccatttcccttactgtctgatatggtttggctctgtgtccccacccaaacctcatctctagttgtaatccccataatccccacatgttgagggagggatctggtgggaggtgattggatcatgggggtggtttcccccatgctgttctcatgatagtgagtaagttcttacaaatctgatggttttataagtgtttggcagttcctccttcactctctgtctttttctcctgccaccatgtgaagaaggtctttacttcccctttgcgttccagcgtgattgtaagttttccaaggcctccccagtcatacagaactgtgagtcagttaaacctcttttctttataaattactcagtcttggatatttctttatagcagcgtgaaaatggactaatacactgttctcagatttttctcagctctgtggtacaatgagacaccatcctgagttccaagagatccagggtagtcgtcttgccactgagaagatactaattgtgacaagttaatgggtgcagcacaccagcatggcacatgtatacatatgtaactaacctgcacattgtgtacatgtaccctagaacttaaagtataataataataaaataaaataaaaataaaataaaatctaatcttctgtgcaggcaaaaaaaaaaaaaaaaaaaaaaaagaaattctatagggtgtggagaaccagacaacaattcctacccttccattttgcaagcatcactctgccatattttttaaagaataatgtttttagagtatttgtgttctttggtacttttgctgctgagattcttgggataacaaagtaaaaaaccaaatagtctagattgtaacataccacagtgatttggggcaagaaggatgtgcagtagaattaagccaagctgggcaagtatgaacttgggactgtcaccaaactctgtctcattcttttctccttatttaattctttccatatcaagcatttacaacccactatgtagaggtccatacaccttggcttatagacttcacttggtagttactgttgcccacctatctattaaccagaattttcatttaaaaatctctacataaaaattagcagttatgcagtggagttttcaaataaggaagaagattggttggatggatggatgttaggtgaccactgggaaactatggttttagaacgagtagctggtaggttgcaggtggcatgtattttaatacatgtagcagaaaactgaaaatttatgagcattttagaaattagagctctgtcaaaataagagaaaaacttagatttaattttataaaagcagtactaatgactttatgaagatggcatatgatttatgtatgtatgaacaattatatgtatcattaaatagatcagataaattttttgttcttttaagaataataggccagatgtgatggctcacgcttataatcccagcactttgagaagccaaggccagaggatcagttgagctcaggagttcaagaccagcctgggcaacatgacaaaaccctgtctctacaaataataaaaaaaaaaaaattagccaggcacggtggtacatgcctgtcatcccagctagtcaggaagctgaggtgcaagaattgcttgagcctgggaggttgaagctgtagtgagccatgattctgccactgcattccagcctaggcaacagagctagaccctgtctcaaaaccaaataataattttttaaatatttattatctaatgtgggtttttgctttatgttacagttgtcacctactccaatatgaaaaatgagaagaaagccaggtgtggtggtgcatacctgtagtccctgctactcaggaggttgagatgggaagatcacttgaggccaggagtttgaggttgcagtatgctatgattgctcctgtgaatagccattttactctatcctgggaaacacagtggcatcctgtctcttaaaaaaaatttttttttaaagcatgttcacaagttctttaatacttctccattgaaaaggtagaacctaatttcccttctcttgaatatggcccagacttagcgacttgtttctaataagtagaatgtatgtaatgatggtgtgctatttctgaggctagatcattaaaggcatcattacttccatattattttttcttgggacacccataatggggaattcaactgctatgttcttgaggatacgcagtcagcctttgaagacacccacatgggcaggaacataagccttccagcggcaaccagcaccaatatgttggccttgtgagtgcagccagctccagtcaaatcaccagattactggagccctgccttacttaaccgactacaacctgatgagacaccccaagagagaactgttccactaagctgctcccaaattcctgacccaccaaaactatgtgagatagtatttcttatttatagccaccatgttttgaagcaacaatgactattaaaataataaaataactttcagacattgtttttaatccctcttttctgtagtccctgtactttcccaccccaatttatatttcctgtttctatttgaacttttttcttttttgttttcatttcttttatacataatcgttttgagctataagaataatttatgccaaaaattatgcagctaatattttacacccgtattgtaaccagtatactggtataaaactagataataaactactatggctgtgttttgcttcttacagatggaaggaaatgcctaaaatttaattttatataccacaatgtgttttgaaagttttgaataattttctggttttgaaaacctgttttgatttttttttctcacaaacacgatattcttaagtaaaatagagtgatttatgattaatagaaataatgaagattatgcaagttattttacttcaattgaaatagcaaggccagaataatttaatcatgttttccagaagaataataaaatagaatcagtggcaatactagtaaacattagtctacatttctatttatttatttatttttttagacggagttttgcctttttacccaggctggagtgcagtggcacgatctcagctcactgcaacttccgcctcctgggttcaagtgattctcctgcttcaggcctcccaagtagctggtattacaggcgcctgccaccacacccagctaattctttgtatttttaatagagacgggatttcatcatgttggcaaggttggtctcaaactcctgacttcaggtgatccacctgccttggcctcccaaagtgcagggattataggcgtgagccactgcacccagccaacatttatatttctttaacttcatatcatttgctgtagttagctggatcatatttcttaaattttactttatttatttatttttgagacaaagtcacgctttgtcacccaggctgaagctcagtgtttgcgatcttggctcactgcaaactctgccttctgggttcaaggaatcctcctgcttcagtctcctgagtagctgggattacaggcttctgccaccatgcccaacaaatttttttttgtattttttgtagagacagaatttcaccctgttgaccaggctggtattaaactcctgacctcaagtgatccacccacctaggcctcccaaagtgctgggattatggccatgggccactgtgcccagacaaattttactttcatagtaacattttgcaaatgtaaaaattttataatttgattagtaatgtcagactctatcaaggtgatgctctcttaaaagttgttgatgataatattagatgagagatgtatgtagttatgaaagaccctgaaatgattgtatttttttatttctgtacaaagtttactcacatttctatgtctagccatagctattctaagccatagcacaaagaactgtattgtgatggtgagactataaaaaggtaaatttagagaaagcttccagatctgctctagaatttattaccatctggtctctttggagactagtataattattcatgggaatgttttcaacacagaaaagcatggtttgtgtattggcagaaagtaaaaagtaccagtggtttaaaccatatgtagcttttttagagttaggcaagggaaatgaactgaagacctaattgagagtcatcagtagtgatgcaatttgtgtcaattttgtcagaatctgttcataatgaacaaaatattgcacaacaagaaaaactgaaggtattagaaatataactccatttgaagagtattactttatcttaatttaaccaatgaaatgtaagatggtgtcagctaagtatttgtgtaaatctctgaaataacataaggaatatatgtcaaattttgatgacttttaaaaatgaaaacactcatgttaaaataattttaagcttgaacactggaagaatgtcttattaaggttatttttcttaaattgaatatgaatgtattattttagatcattttagatgtggcatggacttactactgttcctcttaagaagcagaaatattttacagtctttcttaagcttaaattgattttatagaaaaaggaaaaaaaaactaaatatcttttcactttccattctaacagttacttggagtctataaaaaatgagatgacaaatcaaaaaattgaaatcgtctattttttcagctattttaaaagaaaaatgcctagtgggctgggaatacacaagaaatttaaatttgtgattgagaataagaaatgcatttgtggttttaaaaaagaaataccagcatgtcacattaaaaatatggcatctacagtattgtacaaaggaaaatgtattacattaggagggggtatgttgtactttatttagagaactagtgcagggatacgaatgagaagtataacgccatagaaggcatgagcattagtaatccagtcagagaggaagaattttgctgcctcccatgtaacataaaacagatgttccattctattagaaccttactaaaatgagagtttagatcattggtcaataggagaaacatgaacaatggcaatttaataattttgagggtttatcttatttgtgagttaatatccatggtggggagtatgaagggatgcctgccaaatgttattttatttttgatatcttgattgagagagctgaaaggcaacagtaagctatactaatttttaatttattgttttgcaaatttaatctatttttttctcaaaaactgttgtaagaaaaaaagatttcaaaattataagtcctgatttaatgcttgaataggtattgaagcatatctgaaagtataattaattaacctcaaatgaatactgtaaacattaagtagttggcaactgaaagtagacgtatgcagaaagggacaccagggatggtaccacagggtcctgggtatatttttgtttttttaagggaagatttacttttttctagaaaagaaattcttttcaaataaatttatttttcaaaaaatactttttttcaaaagtattttttccattttaaaattaagttataatttatatacaaaaaagtgatctttgtagtgtatgtttctgcaagttatgacacatgcacagtctagcaaccagtatcagaaataagatagagaatagtttcatcacctcaaaactttccctgtgtcccctttgtagtcttcctttcccctacttcagcccttggcaatccctgctctgtttttgttgacagagacagttctcctcacttgtttgtgaagactgtaaggttctgactgccctttttcctgggacatttctcagggttatatatgcagctgataaacttgagacatgagataacatctgttcccagacaaaaagcaagcttatttactgcttgctataaaattggtggattccctgagttcagtgcttctcatttgctgatgcaaactcactacaagcatagcatccatctgagcatccccaaaggacttgggatgaagggaactgatgcaaatgtgctgatgttcttctgttttgtcataagtaatgaagtgttttttctttgactgaggagtcttgtgtcttctgcctgcatccatgaattagttaagaggcttttgtgttagcttttattaaatagggtaaaatcaaatcccagtctccataattttctgtttgtatagttttgccttttccggtgacttgtattgagggttcctgcttctggccaacaacctatgagtgattttttaggtctgatcataaggcatttacagaggttttcctggcaggcttcatagggggagggctggtctccagagcagacttggtgcaaagcttttatagtctctgaggggaattgcagtcaaggacccagccatcctcttatacatatctgcgttcctagcctaggtgccttcattcagaggcctctttatgtggggcttttggggaggctttccttaagtgtctctgtcaagactttattggggaaaagaggggaagacacttaccaactctttctctactatgacttgtacttttctgtttctaacccttccctctctagccttcactcgactcctgggtctgtaaaactgccagaatcttttgttgggggttccctttggcaatgatgcaaccctcacatttgtgctggtctacctgccctgtgaccaatgtgccatgccacaggggaaaatggaatggggggtagctggcactttctccaatttagcctcttatactgtcacagtgattacagacctattctttattttattttattttatttatttatttttttggcttgttgccattggctgtgccaaaacgtggcagcccagctttctccagctctcctgaggtactgatacacacaaatggaatcatgttgtgcatagcctttgaatctgactttcttcagttgacgtaagttcatcttagattcatccatttgctttgtcaatagtttttaaattttaatggctgagtagttttctatcatcgtgatgtactgcaccttgtgtctctatccactctagagggatatttgaattgtttctggtgattatgaataaagctgctaaaaatatttatacgtttttgtgttaacataaattttcattttactagatgtattgccaaactcctttccaaagtggctgtgccatttcacattcccactagtaatatatgagaggtctagtggtttcacatcctttcagcacttgatattgtcagcttttattactacatcaattgtaagggggagaggagcatctcattgtttgtttctacttccctaattatgtgaagcacatttttatatgcttatttgctatctgtatatgttctttgaagaagtatctcttcaaactctttgccttttttttaaaaaaaattgtgtttatttttgttacagagttttgagaattctttatctgttctgcagacaagacttatcagatgtgtgatttgcaaatattttctcctagtgagtggcttgtgttttcattttcctaacaatgtctttcagtgagcagaagttcttacaaatttatgtacttttaaaatggattatgcttttgtgtcatataagaactctttgcctaatccagggtgagaaagatttactcctatattttctactagaaatttcatagttttactttttacatgtagatctgtgatccattttgagttaagttttgtgtatattgggtgaggtctgtaacagagtttttgattattgttttttgctattgttttttgctttggcatatggatatccaattgatccattactcttccctgaagtctatttaaatctctttaattgccattgtacttttttgaaaatcaattatgtggttgtatatctatgttccatattctgtttcattgatctatatgtctcttctttctccaatatcatacttctctgattactgtagcttaatgtgtttgttttttttgctgtctaatcatggaagttgaatttattgcattttacaggtcaatattttttgtagttgtagacgtctgtaattttgcactgttaattttaatgtaatggacatattagaaattaggttttcaatatgcaggggaaatgctgttaatttacaattgaagagagttatgaaataataataaatagaaaaagtaaatagagaaaggaaagtacagtcatcccttagtgcccataagggattggttctaggaccctctgtggataccaaatccatggatactcaagtcccttaaatggcataatatttgcacataacctatgcatatcctcccatatactttaaataatccccagattgcttataatacctaatacactataaatgctaagtaaatacttgttatactgtgttatttagggaataatgacaagaaaaaagtctgtacctgttcagtacagactcaacaactatccatttcccccacttccaagtatttttgatctgctgttggttggttggtctgcagatgcagatcccatggatatggtgggcctatatatatgtcttatttattgtcactaccttttgcttccaagtattttttatttttaatgagagttattttgttgtggtgggtggtttaacatacataagttttcccagcagcagaaccctgaagcaaggattttagaacaaagtctactttggagacgtatgtaacaggcaagaattgatgcaaggaaagcaaggcagctaatgaagacttactaactaaactaacacaataggttgctggagctttatcttgtgggataattctgggaaagtcagtgtcaaatttagtttcgggactaactcacctgaagtgtgagagagtgagtatatttcctgttactggttgtggactgccatacagaagacattgcacctgcctggtgctgtggtgggcagagtagcattcagccattcagaggaaagccctgagggatacagaggaagatactggctattggaagtaatttggaatggtgggaaagggttaggtccaaaggatactgtacagacactgacattatctgactcatgccttgtgaattttaagtgcctttcctgggttatcaaagtgaatagctttaatcaaatcatctctataaagacatttctaagtaaattttctatacttacactcctctactttttattactacagctggcttcattagctttttgtatattaatctgtgttgtcctactattagctagaagagcttactaactgtgagcttgaagatattgtatattccctcttcggatgatttttttttttttttttttgagtcagagtcttgctcttgtagcccaggctggagtgcagtgatgcaatctcggctcaccgcagcctccgcctcccgggttcaagtgattgtcatgcctcagcctcccgagtaactgggattacaggcacctgccaccacgctgggctacaaatgtatttaagaatcttaaatgagctgtgattgcaccactacactccagtctgggtgacagagcgagaccctggcttcaagcagtcctcctgcctcagcttcctaaagtgctgggattacaggcatgagccactacccctggcctaaattccttttctagcctctatacagaatttctaggataacaacaacaacaacaacaacaaaaacttaaatgataaaaatgaatatataaaatagcaagtaagccatgtaaaatattttcaatattcttagccattagagaagtgcaaattaaaactataagatactgctgcatacatatgtggatagcgaaagtaaaaactggtgagaatacagaatgaatggatttctcatctgttgctgataggaaaatgacacagccactctggaaaacagtttggcatttttaataaaattaaagataaatattccatatgactcagcaatcatattcctgagtatttaacatagaaaaatggaaatttatgtatatgtaaaaacttgctacacaaatatttacatcagcttaatttgtaattgcctcaaactggaaagaatccagataactttcaacaggtgaatagataaacaaactgtgatatatctatcgaatggaataccaagctttgtaaaagaataaattactggtacagtcaacagtttccgtagatcttaagttcatcacacgaagtaaaaaaaaagctaaactcaaagtgttacatactgtatgattccaattatatagtattacttaaatgaaaaaaaattagtgttggaaaattaacctgtcattccaggagttagagataatgtgggagaaggggataggtatgactataagggagttgcaggagagggcttctttgtggtgatggaatagttctgtgtcttaattgtgctggtgagtacatgaatctttacagctgataagattttatagaatagtacacacacactaagaacaatgcatgtaatgtctactttggggagctttttttaaaaaaatttcttttaagagacagtgtcttgttccatttcccaggctggagtgcagtggcacaatcatagctcactgtagcctcaaacacctgggctcaagggattctcctgcttccagcctcccaggtagctaggactataggtgcatgccaccatggctcgctaatttttttatttttattttttgtagagatgggggtctcaccatgttgcccaggctggtctcagtctcctggcttcaagcagtccttctgccttggccttctaaagtgctgggattacaggggtgagccactgccctggcctaaattccttttttagcctcttcacagaatttctaggataaccaatataagtaaagtagatgttatttttaaaatgatccactttatacactaaattaaaagacagtcttgatttcttcaaaattctttgctgtgaagtgaaacgtttggtaatcatatatcttgttgacataaacatacagattcctctgcatgtaacattcttttccttcactttaccaatttgtgcccatttcacgtatctcagcctatatccctttttcatgatcatcttacctctgacataactctttcacccaccaaatctgtgtttggtgtcatttctatgatggtcccatacaaagctggactcattttacagatgcaaaaagtgatgaaataatgaacaagttaatggcccaactgaaactgtggtgttggacataaactttagaataaatcctaaatcttaagtgtgcaaataaattattcaaaacatgagattacctaacctattctagtgatatttaacagagatatgtttgtaactggtggaagaagaatcactccctaggtacaagatcaattactgttcattttattcacctgaagataaatcactttcacagattttgcagactacttcttttcctgaaaaaatgatttattaaagtggaggtttctttactatatcaacactggcttactcttttctttataatacttctatactgaaagaagccagaggccaaaagtagtcttgtttgtgctgctctttatttcattgttatttttaaaccagatgatgaaattcccttccattttgaagggccatttttcatgtacataggagggaatttaaactgtttgagttaatattaacatattctattactataaattggttttagtttgattttaaaatagcatattaatttacatttaattttagtattcaactctgatcagaaaaatagtattttggatgtaggggtaaggaaaaggtgtgaaattccagttaaaaatctaaagtactgtgtttattgtttcattgtgtgtctgcatttagtattgtttgtatgagaaaaagtcagttgtttccttatattcccatataatttttgagtagtatgacaatcttcatttatatacctgatgacttttaatttttaaaatgttgtctaaaccaggtttcaggtgatatatcttgcttcctaatttgacaactctgaatattactattgaaacttgtaagcaagtagaaattaaaatgaagccatacatagcatttgctttgattaaaaagaatagaaacctagactgttttggaaaattcagtgtatatttcagtgtatatatattatgtgtttatatattgacagatctgggcatcagaatagagtcaagaaataacataaatagaaattcagtaagaacacatatgaaactggaaaccagtggaggaaaactgaggaattgctgtttgtgagagacttatttttcactcagtatacttttttttactgttttaattgtctatatagcatgctgcatattaccaattttaaatacttaattttgaaagattaaaatggctggcaaatttattgcccatttgcaaagtacatttatatcaggcatagtacaatatgtagaatgttattggaacattggaacattgtgtctgaaatacttttttaaaaacctcataaaatatgaaaatacttcttaatgatttcaatattaactctattcattagacatctatcattatcctttatgtcagaaacttagagtgaaatcttattagcttgattgaagaacacttgttctcatttcattgtgctatagttaacattcaaagttaaagttatttttcttctccttgatagtatactataataagtatattcaaagtgatgctctagatttgtttccttcacatttagacttgcatttttacaatgtttatactaaggtttcttacacttgccatagtatatctgtgcggtggcttactcctgttaatcccagcaattagggaggcccaggcaggtggattatgaggtcaggagtttgagaccagcctggccaacatggtgaaaccctgtctctactaaaaatacaaaaaaaaaaaattagctgggtgtgttggcgggtgcctgtaatcctagctactcgggaggctgaggcaggagaatcacttgaacctgggaaggtggaggttgcagtgagccgagatcctgccactgcactgcagcctggacaacaagagcgagactccgtctcaaaaaaaaaaaaaaaaaaggatttttgcaatcattaacttacttcttgctgtctgtttttattgtctttggctgtccttcttaacttcttcaaagatttctagtatatttacactccttaatcctaaatccagtgtatgttggctctcatggtagttttccatttcatgtacttgcttgtataatataaatccctgttcttggtgttttgtgtatttatttatttggctgccattgtattgaaaattgtcttgacaattcatttatgaacatcattagtacagcaatatgtaattcaaaaccagcatgctcaaatttgtactattctggttagttattgctatgtgtgtattttcaaatttttaaagacttagagaatagtaaaacatatacttagcacaaatgatatcacttcttggtacctttctgtgagtccttcttcccataaggaaattaaattgttctttgttttcatgctaagtagcatgaaaaaaaagctttattgagataaatcaaatttagagcatttttatcacctcaaaaagagcccatatacattagctctcacccactcaattatccctccttggctattttgggtccattgcaattccaagtgaattttagagtcagtttgtcaatttacacaatgagtatagcttggattctgatagggattgtgttgaatctctacatccataatgggtaatattgccaatcttaataaaattttccatgaatgtgggatgtttttccatttatttggatcatctttaatttgttgcaacaatgttttgtagttttcagagtataaattttacactgtaaagaaaacttattcccaaatattattttctttttgatgctattgtaagtggaattcttttcttaattttatgttcagattattcattgcagatggcttagagatacaattgtgtgtggtttttgttgttttgtttttgagacaggctcatgctctgttgcccaggctgaagtgcagtggcacaaacatggctcactgcagccacaatctcctaggcccacctgattctcctccctcagcctcccaagtagctgagaccactagacatgcaccaccatgcctggctaatttttaattttttttgtagagacagagtcttgccatgttgcccaggctggtctcgaactcttgggctcaagcaatcctctggccttagcctcccaaagttttgggattataggcatgagccgctgtgcctagctcagtttgtgtgtgtgtgtgtgtgtgtgtgtgtgtgtgtgtgttttaatattgatcttgtatcctacagcctttctgaacttacttagctctaatattttttagtgggttctttatgattttctataaacaaaaccatgtcatctgtgactatagttgtgtttccttctttctttctaatttggaagcctttaactattttcccccttccttaattgctgtgactagtagttgtaatgtaacagtgaacagaagtggcaagaagagatgtccctagtcttgtttctcatatagggggaaaatatctaatcattcaccattaagtttgatgtttctctgcagttttcttagatgccctttatcagattgaggaagttactttctatttctgtttttttttagcgtttttatcttgaaacagtacagttgacccttgcacaacatggcgattgtgggtgctgacccactgcatagtctaaaatccatgtataacttttgattctcccaaaacttgtcaattaatagcctactgttaaccagaagccttaccagtaacataaagtcaattaccacatattttatatatgtatcatataaagaatatattattaagaaaatcatgagagaaaatgtatgtactatttattaagtggaaatgtttcgtgagaaaagtcatcattgtcttcatgttgggttggctgaggaggcagaggaggaactggttttgctgtcttaagggtggcagaggtggaagaaaatactggtgtaagtggatttgtgaagttcaaaccagtgttgttctggagtcaattgtagtggattttgccaaatgctttttgtttgtttgttttttgagacggagtttcgctcttgttgcccaggttagcgtgcaatggcatgatcttggctcactgcaacttctgcctcccaggttcaagcaattctcctgcctcagcctcctgagtagctgggatttcaggtgcccagcaccacgcctaacttatttttgtatttttagtagagatggggtttcaccatgttggccaggctggtctctaattcctgacctcttgtgatccacccgccttggcctcccaaaatgcgagattacaggcgtgagcaaccatgcctggctgccagatgctttttctatgtgtgttgagatgatcatgtaattttgttttctattctattgatatgatgcattgaattaattgatttttggatcttaaaccaaccttgcattcctgagacaaactccacttggttatgttatatataatttttaaatgttgctggatttgttttgctagtattttgttgaggatttttgcatcattctcatatgagtatcagtctgtagttttattttcttgtgactttgtctgattttagagtatcatagtaatactggcctcataacatgaattgggagatgtcttccctcttctaatttttagaagagtttgtggagaattggtattaatttttttaaaagaagcagcaattgcttatttttctaatcaggtgtctatgctgctgaatcttaaggcctcaacaaatgttgcaccttattatttcattgaacaataagaccttctattctgattattcccggtaaataggaataatcactggtttctccagtggtttccacttgccaaaaactcatgacagatgacttaacaaggtggcacctgctttcaggggattgtatcagatgcatactcatttccagtgcagcagctgttggcaatctaggacttctctatcatggttggccaagtagtcctgctttggctgccagagcttcattctgctgaatattacattcctgaagtctcatggatattctttttgtcatttaaaaatatttccataaagtgttctgaacaggctggtctcttcaggttttacatctgttgtgcagtcttaacacagtccaaaaagcagatttctgcaagtttattgtcagtcccaagaaattccttcaactgtttaatctgatcagattctggtatttgtgcacccatattcttttggtacatttattagtcatcttctctgatgcatgagtttcctttctgttcttgtaaagtagtgttccaacctttgtttgaatgtcttcagtgagacgtgatttcttacctaagcacaggctctcacatctgacgtcagtacaaggctggaggcctacactgccagtcgagtctgaggatggaggatcaggatcagggcaagcattgcagccgctttatctaattcttctttaaacgttcattagaattcaatagtgaagccattcagggctaggcttttctttgtgggtagtttcttgattactaatttaatctcttgttatataggtctgttcaagttacctattttttcttgaaatttttttagtcatttgtgcctttctaagtatttgtccatttcatctaataaataatctaatttgtttaatggctattctttctgacattaatatagccactttgtctttcttgtgggtgttgtttgcatcacgtatcttttttttttttcccagacagggtcttgctttgttgcccaggctggagtgcactggcaagcagaggttgccactcactggaacctctgattcccaggtttaagtgatcctcccacctcagtctcctgagtagctgggattacaggtgcataccatcatgcttggctaatttttaaattttttgcagagacgaggtctcactgtattgtccaggctggtcttgaactcctggctcaaagtgaaacccctgccttggcatctcaaagtgctgggtttacagatgtgagccaccacatccagcctgcatgatatatttttccacccgtactttcaatctgttagtaactttctatctacagtgtgtctcctgttgacccacataactgtcttttatgtatagttattagaactattgataagaaaatgtgaaagtatagtcccattatcttatttgagtggaatcagtagactatttcataaaatgtattctagtttatagtttagaatagtttgtttttcatggcttttgagaaaaacatttgaatgagcttacattttgttgcatttaaaatttctgggtttttgttgttgttgttgttgttgttttgagatgcagtctctctctgttgcccaggctgaagtgcagtggtgtgatcttggctcactgcaacctctacctcccaggttcaaatgattcttgtgcctcagccccctgagtaactgggactgcaggtacatgccacgacctggctaattttgtatttttagtagagatggggtttcgccctgttgggcaagctggtctcaaactcctgacctcaggtgatctacctgactcagcctcccaaagtgctggaagtacaagtatgagccactgcgcctggccaaaatttctgttttttaatgaatccaaagttcatgtttttttttcttcccaatgccatggtacatatcatcaccaaaaaaagtagtgattttgcttcagtgaacactgaattttaatattattgatagaatggctatatcgatcagggttttacacttatagtacagtatacttgcaatgtaggtaggcctcatcctttgtaattaattaattagcttgtaattatgtaagctaatctaaattttcatattttcagttttaacatttgggcttttgagttacatttcttatattttgatttttttctataaattttaaaaccagaaagacaacactagaatcaattaaatgcaagattgaaagggtttcataatgtaaaagagcaatcttgtttttgaaatgttcagtttacagtaaggatcgagtagctctgcagctaccgatttgggaaatacctgaggttttttttccccttgcacttacaggctgttttagccctgaaggtggctagtaaggacacagactttagagtgccacgacagttccataacaggaatgaattgaagaagagaagcagtggagtcaggagcctcacaaattaaagacaactggtgaagagaaaaaccatttattttcgatacttaagatggctgagcctgtaattccagcagtgctttgggaggctgaggcaggtggatcacgaggtcaggagattgagaccatcctggctaacacggtgaaaccctgtctctactaaaaatacaaaaaattagccgggcatggtgggcacctgtagtcccagctactcaggaggctgaggcaggagaatggtgtgaacccgggaggtggagcttgcaatgagcagagatcgcaccactgcactccagcctgggcgacagagcgacactctgtctcaaaaaaaaaaaaaaaaaaaaaaaaaaaaaaaaaaaagatggccgaataggaagagctccagtctgcagctcccagcaagaccaacacagaaggtgggtgatttctgcatttccaactaaggtacccagttcatctcattgggactaattaggcagtggttgcagcccacagagggtgagcagaagcagggtggggtatcacctcacctgggaggtgcaaggagctgggggacctccttcccccagccaagggaagccatgagggactgtgctatctggcccagataccatgattttcctatggtttttgcaatccgcagatcaggagattccgtcgtgtgcctacaccaccagggccttgggtttcaaacacaaaactgggcggctgtttaggcagacacttagctagttgcaggagttttttttcgtaccccagtggcacccggaaccccagcgagacagaactgttaactcccctggaaagggggctgaagccagggagccacgtggtcttgcttagagggtcccactcccacggagcccagtaagctaagaaccactggcttaacattctcactgccagcacaacagtctgaaattgaccttggaccattgggcttggtagggggaggggcatctgcaattactgaggcttgagtaggtggtttttccctgacagtactaaggtggcggggaggtttgaaccaggtggaattcaccacagtgcagcaaagcagctgtggccagactccctgtctagattcctcctcactggacagggtatttgtgaaagaaaggtagcagacctagtcaggggcttatggataaaactcccatctccctgggacagagcacctgagggaaggggcggctgtgggcgcagcttcagaggacataaactttcctgcctggtggctctgaagagaacagctgatactgacaaggaggattctcccagaacagtgcttgagctctgcttagggacagactgcctcctcaagtgagttgaggagactccgtgccttctcactgggagagaactgccaacaggggccaacagacacctcaaacaggagagctctggctggcatcaggctggtgcccctctgggacgaagcttctagaggaaggaccaggcaacaatctttgctgttctgcagcctccattggtgatactcaggcaaacagggtctggagtggacttaaagcaaactgcagcagacctgcagaagaggtgcctgactgttaggagaaaaactagcaaacagaaagcaacaaactcaacatcaacaaaaaggacccccacacaaaaaccccatccaaaggtcatcagcctcaaagatcaaaggtagataaatccatgatgatgaggaaaaaccagcgcaaaaacggtgaaaattccaaaaaccagaatgcctctttgcctccaaataattgcagctcctctccagcaagggcacaaaactggacggagcaaccccaagacacctaatagtcagattctcctctgagctgaaggaccatgttctaacccagtgcaaggaagctaagaaccttgataaaaggttataggaactgctaactagaataaccagtttagagaggaacataaatgacctgatggggctgaaaaacacagcacgagcacttcatgaagcatacacaagtatcaatagccaaatcgatcaagcagaagaaaggctatcacagattgaatatcaacttattgaaataaagtgtgaagacaagattagagaaaaaaaaaataaaatggaatgaacaaaacctccaagacatatgagactatgtgaaaagaccaaacctatgattgattggtgtacctgaaagtgacagggagaatggaaccaagttggaaaacacacttcaggatattatccaggagaacttccccaacctagcaagacaggccaacactcaaatttgggaaatatggagaacactgcaaagatactccttgagaagagcaaccccaagacacctaatcatcagattctccaaggttgaaatgaaggaaaaaatgttaagggcagccatagagaaaggtcaggttacctacaaaaggaagcccatcagaccaatagcagatctctctgcagaaaccctacaagccagaagagagtgggggccattattcaacattcttaaagaaaagaattttcaacccagaatttcatatccagccaaactaagcttcataagctaaggagaaataaaatccttttcagagaaggaaatgctgagggattttgtcaccaccaggcctgccttacaagagctcctgaaggaagcactaaatgtggaaaggaaaaagtggtactagccactgcacaaacacaccaaaatataaagaccaatgacactatgaagaaactgcttcaattagtgtgtaaaataacctgctaacatcatgatgacaggatcaaattcatgtataataatattaaccttagctgtacatggcctaaatgccccaattaaaagacacggactggcaaattggatgaagagtcaagatccatcggtgtgctgtattcaggagacccatctcacttgcaaagacacacataggctcaaaataaagggatggaggaatgtttaccaagcaaatggaaagcaaaaaaaaaagcaggggttgcacttctagtctctgataaaacaggctttaaactaacaaagatcaaaaaagacaaagaagggcattacataatggtaaagggatcaatgcaacaagaagagctatcgtaaatatatatgcacccactacaggagcacccagattcataaaacaagttctcagagacctacaaagatacttagacttccacacaataatagtgggagactttaacaccccactgtcaatatgagatcaatgagacagaaaattaacaaggttattcaggacttgaactaagctctggaccaagcggacctaatagacatggggttgctacagaactgtctaccccaaatcaacagaatatacattcttctcagcagcacatggcacttattctcaaatcaaccacataattcaaagtaaaacactcctcagcaaatgcaaaagaatggaaatcataacaaacagtctctcagaccacagtgcaatcaaattagaactgaggattaagaaactcactcaaaaccacccaactacatggaaattcaacaacctgctcctgaatgaatattgggtaaataatgaaattaaggcagaaataaagaagttatttgaaaccaatgagaacaaagagaaaacgtaccaaaatctaggacacaccaaaagcagtgttaagagggatatttatagcactaagtgcccacttcagacagctggaaagatctgaaatcaacaccccaacatcacaattaaaagaactagagaagcaacagcaaacaaattcaaaagctagcagaagacaagaaataactaagatcacagcagaactgaaggaggtacagacatgaaaaacccttgaaaaaaatcagtgaatccaggaggtggttttttgaaaagattaaccaaatagatagactactagctagactattaaagaagaaaagagagaagaatcaaatggacacaataaaaaattataaagtggatatcaccactattctcagagaaatacaaactaccaacagagaatactataaacacctctatgcaaataaaccagaaaatctagaagaaatggatacattcctggatacattcctggacacatacaccctcccaagactaatccagggagaagttgaatccctgaatagaccaataacaagttctgaaattgaggcagtaattaatagtctaccaaccaaaaaaagcccaggaccatacagattcacatccgaattctaccagaggttcaaagaggagctggtaccattccttctgaaactattccaaacaattgaaaaagagggagtcctccctaactcattttatgaagccagcatcatcctgattccaaaacttgacagagacacaacaaaaaaagaaaatttcaggccaatatccctgatgaacatccatgtgaaaatcctcaataaaatgctggcaaacgaatccagcgacatgtcaaaaagcttatccaccacaatcaagtcggcttgacatgtaaggctggttcaacatacgcaaatcaataaacgtaatctatcacataaacagaaccaatgacaaaaaccatatgattatctcaatagatgcagagaagtcctttgataaaattaaacatccttcatgctaaaaactctcaaaaaactaggtattgatggaacatatctcaaaatataagggctatttatgacaaatccatagccaatatcatactgaacaggcaaaagctggaagcattccctttgaaaaccagcacagacaaggatgccctctctcaccactcctattcaacatagttttggaagttctgactagagcaatctggcaagagaaagaaataaagcgtatttaaataggaatagaggaagtcagattgtctctgtttgcagatgacatgattgtatatttagaaaaccccatcgtctcagcccaaaacctccttaagctgataagcagcttcagcagtctcaggatacaaaatcaatatgcagaaatcacaagcatttctatacatcaataatagacaagcagagagccaaatcatgagtgaactcccattcacaattgctacaagagaataaaatacctaggaatacaacttataagggatgtgaaggacctcttcaaggagaaccagaaaccactgcccaagaaaataagagaggatgcaaacaaatggaaaaaaaattcagtgttcatggataggaagaatcaatattgtgaaaatggccatattgcccaaaataatgtatagatccaatgctattcccatcaagcttccattgactttcttcgcagagttaaaaaaaaaaaagaaacaaaccttaaatttcatatggaaccaaaaaggagcctgtgtagctaagacaatcctaagcaaaaataacaaagctggaggcatcatgctacctgacttcaaactgtactacaaggcaacaataaccaaacagcatggtactggtaccaaaacagatatatagaccaatgaaacagaacagaggcctcagaaataataccacacatctacaaccatctgatctttgacaaatctgacaaaaacaagcaatggggaaaggattccctgtttaataaatggtgttgggaaaactggctagccatatgcagaaaattgaacctggatcactgccttacacattatacaaaaagtaaccaagatggattaaggacttaaatgtaaaaccgaaaaccataaaaaccctagaagaaaacctaggcaataccattcaggacataggcatgggcaaagacttcatgactaaaacacccaatgcaattgcagcaaaagccaaaattgacaaatgggatctaattaaactaaagagcttctacacagcgaaagaaactatcatcagagtgaacaggcagcatacagaatgggagaaaatttttgcaatctatccatctgacaaaggtctaatatccagaatctacaggaacttaaacaaatttgcaagaaaataacaaccctatcaaaaattgggcaaaggatatgaatggacacttctcaaaagaagacgtgcaaccaacaaacatgaaaaattgctcatcatcattggtcattagagaaatgcaaatcaaaaccacaatgagataccatctcatgccagttagaatggcgatcattaaaaagtcaggaaacaacagttgctgttgaggttgtggagcaataggaatgcttttacactgttggtgggagtgtaaattagttcaaccgctgtagaagacagtgtagcaattcctcaaggatctagaaccagacataccatttgaccgagcaatcccattactgggtatgtacccaagggattataaatcattctcctataaagacacatgcacacatgtgtttattgtagcgctatttacaatagcaaaggcttagaaccaacctgatgcccgtcaatgatagatagagaaaatgttgcacagagacaccatggaatactatgcagccataaaaaaggatgagttcatgtcctttgcagggacatgatgaagctggaaaccatcatttttagcaaagtaacacagaaacagaaaaccaaacaccacatgttctcattaataagtgggagttgaacaatgagaacacatggacacagggaatggagcataacatacctgggccagctggtgggtaggggtcaaggggagggagaggattaggacaaatacctattgcatgcagagcttaaaacttagatgatgggttgataggtgcaccaaaccaccatggcacatgtataccaacgtaacaaacctgcacgttctgcacatatatcccagaacttaaagttaaaaaaaaaaaaaaaaagccaggcgcagtggctcacgcctgtaatcccagcactttgggaggctgaggcaggtggatcacaaggtcaggagatcgagaccatcctggctaaaatggtgaaaccctgtttctactaaaaatacaaaaaattagccaggcgtggtggcgggcatctgtagtcccagctacttgggaggctgaggcaggagaatggcatgaacacaggaggtggagcttgcagtgagctgagattgcgccactgcactccagctctggcgacagagcgagactctgtttcaaagaaaaaaaaacttcagtttacttgattttgcttatagagttctttgagaatttaaatcatcctttctgaattacagaaagtcatagattagaagtgtagctttaaaatgctctagatcactctgaattaagaaaaagggtttcctttgtccagaataagcatcaatttaaaacagcatttaaaaacaagtattcaacaaattggtatacgaattataacacaagcaactaaatcactgactttgattagtctctctactgattactactgttgaacagaagttgtgtgtaagaataggagaaggtgaactcattgtcttgagcatgtggaattagttcttgtctgaggccagatagcaatttttatcttattttcagtatagcagatcctatgctgccctgataagaatcacctgcacagcctcattgactctcacggaagtattccagtaactctttgaattttttcctagaaaaattggcatctgttacccctacacaattccttcataaacagtagaaatttcccccatgaaacctttcctttaaccttaacattcttcgataattatttatgaagtccttaaataattattacaacaagtattggttttgaatacgtaccagctttggaatactgcttaaggaaaccatgataaactccaactcctttatgattatttagaggaatatatctatttgttatagtcttaaggaaaaccttgtcaacatattagatgatagaaacagtcataaccagcgaccaccaggtttggtgggaactcatgatgtgaagggtctactccatgttctgccaaccaagtaactaagtcattttgggcaaatgattcagctgacttgatctgttacatgattcctaaggtctgttatagctccaatatttcatggcatcactccactttaatgtattatctatcttaaaaaagttaaacagaaagatcaattagcacttatattaaatttgagttgctgaatattttattttttctcacttccactcactgcttccactatttgggtaatgattgttggagctgtatgcatttataatgcattaagtacagtgtggtatatcagtaaaacttcattacaaatattcattccatacatttgtctgtactggggtcagtttttttccccttcttcttctttttaaagacagggtcttgctctgtctcctcctgtcttggtctcccaatgtgctagaactacgggcatgagacactgcacctgctcttttctagttttatttgtctatctgaagagtttattatttggctaagctcacatggcaaggtaggtatcatgaagtgttaaaacccagcttttctgctaatgttcttgtgagataaaccaactattagtaaagatacttgcttcctaatcaagattacttggaattgttaagagagtatgtatgtatgtataagttaactttttaaaaacttctctgctgcctggaggaataatgaaatgacccaaagggatagaagcaaaatatttcagatagtacataacgtatatacttagccttgtgcaatcaagaattaatgatataatgtgtatggagtaatatttaactttatttcgttataagcccttttgggatagtggttgttccacataacttttatcttctttaatgcttagtatctgctagaaatgtagtctgtgggatcataagagttggggaagatttacagatagcattttcagagactgaacagaaaagcatattgtcatttggaaaaattttaaaagtgtctaacttttattcaggaccatttgcttttattttcctgttgttatttatttctattatcttgtttacagttgaaatttggacaattggtctgtatcttttctaattttcattatatataaagacttaggtttcctctttccttatgtgtttgttggtaaacattaggtgctatttttaagttttcaattctcaggcatagtgctacttatccatgttatttatataagcaaatgagcatatttgccaatcaatccacggtaagaaacacaatttaagttcctaccaaggatacctctgtgtgtgtgtatgtgtgtgtatgtatctgaaatatttcactaaataattcatttttttttttttttttttttttttttgagacggagtctcgctctgtcgcccaggccggactgcggactgcagtggcgcaatctcggctcactgcaagctccccttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccaataattcatattgttaatacctcaaccatatcttgatattctgttagctttttaaatgatggttgtgaccaactacagttcacatttttcactagtggatcacactctgcagcattaaaatcaccgtgaaatagattaattagaataaatgaagtgttcttttttcattctgtttgtacagtagatattattggattattttataaaatacccattttataaattggatggtatgttataaatggatagtaggatttttcctttcttcattttgtaccaagagaataaaaaacactcctgttcagtacatctctagcaagcctatttcaacatccaatgtctcaaataattaatttttctatactttagtcacccttacacctaaacgttacagtgcttcagtataacttctatgtaaacattattaatcccatttacagatgggaaccagagtgttgggagacaggtcatggatttctcatgttcctgcacagtctaagtgttctaaggagaggcatttacagtgccaattgtataaggagaaatttcaggacagtaaaactactgacatgtccctccctggagacgtccaaggataataaaaataaaagaccttctcttccccttcccagaggagatttgcttatatttgagtgtaatgagcaatctttctgggcagagcagggtggcaaaccaatagaagatcagagttccttcatttgggggttactctcctgtgatgctctctactgtatgcactagtaacatccatcccttactgcattgcctcatggagattggagctcagggaactggtctaaatatattgttctaggtgctgcttttgctacgagtaataaattgtctttgtttctgatccacagttcttgtgtccttatgtcattgtgtgtgtgtgcatatgtgtatgcaggagaacgaatgcggcagattgaagagcagttgaatatcagacctttgtagtgtggtggtggtgattatggtgttgagacagaattttgctgtgttacccagtctggtgtgcagtggcgcaaggctcatttcagccttcgaactttcaaactccatgggctcaggtgaccctcccagctggtactgaaggcacaccccaccatacccagtgattttttttttttttttttttttaagagacagggttttgtcatgttgccgaggctggtctcaaactcttgggctcaagcaatccacccacctcagcctcccaaagtgctggggttacgggcataagccaccatgcctagccctttgtgatttttttaacttaactctggctcacacaatttaactgtaggtctgtttgtaaacctgaagcgctttctatgctttcttccttacatagaccgataaaataagtagaaaatatggtgctaatgactagtatttggtataagtagataaatgttttgtatcacatttgcatgcttataatctgtgatcaatgagcagtctgaatatttttccctccatcctcataagttaaactaaaaaaaagttatagattgaggctgggatatctggtggcgaaattatatttatttgaacagagtttgtgtatatacatacatatttcagaatatattgaaaaataaaagtgtaatgaccttgataaaaatgaaatattcacttaaaaactccatttaataatgcccacaggaaagaaatgcttctagaattttttaactaatcatttttctcagtacttttgattgtcatgcaaactaaagaaatggacttaatgaacaatttagttacaataataaagtttcaaaaattctaaatttacctcataattgcaacagatgcaaaattatttcatatctttatactcgttatgaaattacctcatatccaaaaatatttatgtcaagtgacaggctttttgcagcatttttgatattattacccttgtaatatataattaactttgtaagttaaccttgtggaacttttaagggaaatgcattaacttagcattaatatagacttctaaaatttactgtgatgtagaacatttgatttaatgttgtctgtgtctaatacaaaataactgtggtccacttacttatttcaaattttattctcaaaggtacctactagattatgtgtgaagaagtttgtgaccaaagtaatataactgattctgttttgaaaatctagaataaagtttatgcaaaagcatatggattatttctttatgaatgcagttttatactaaaaactcctccatacccacgtaagtagatatattctcatagtgatgtagaaaactgacaaaacttttcatcctcagagctaggaattcttgtgtttggccacaagggaaagacaaaggtattagaattttaaataagctatcatcaacaaatactacatctctccagctccattcataaatatagcaacattttggaagtgcagatgaatcgaacatagttaagtgagaaaaatttttagtaacatacataatttgtaaatattgaatcgttttttaaatgatactctgagtcataattatttcaaattgtacataatgctagaagaaactaggataatagcagaataagttacagtgactaaaatcataggtttttttaagagattggggagtctctgtggtgcccagtctggagtgcattggtgcaatcatagctcactgtaaccttgactcctggcttcaagcaatcctcctgtctctgccttccttttgtagtttcaggtcttaacatttaagtctttcatccattttgagttgatttttatacatggtataagatgaggatctagtttgattcttctccatatggatatctttggtctatatatttatttatatgacagtaccatgctgttttggttactgtagcttggtaatataatttgaatttgtgtagtgtgatgccgcagctttctctttttgctcaggattattttagctatttggggtcttctgtggttccatatgaattttaggatttgttttttctatttctgtgaagaatgcctttggtattttcatagagattgcatttaatctgtagctcactttggttagtaaagatattttaacaaggccgagcatggtggctcatgcctgtaatctagctctttgggaggctgaagtgggaggattgcttgaggccagggattcaagaccagcctaggcaacatggcgtgaccgtccctacaaaaaaatatttttttaattagctaggcatggtagcatacacttgtagtcctgtctacttgggaggctgaagcaggaggatcctttgggcccaggtggtcaaggctgcagtgagctataatcatgccactgcactctagcctgagcaacagagagagatcttatctctgtgtaaaagaaaaagaagtgtaattaaaggaaaaaaacattttaacaacagtctttcaattccaaaacatgggatgtctttttttccttttctcttcagtttctttcatcagtgttttataattttccttgtatagatctttcatctgcttggttaaatttatttcctggttattttatttttttgtagctattgtaaatggtttgctttcttgatttctttttcaggttggttgctcttagtgtatagaaattctactgacttttgtatgtcgattttgtatctgacaacttaataaattcacttaccagttctaatataatatggtctaattaatatattagactagaagtataagatctctcctggagaatgttccatgtaccgatgagaagaatgtgtattctgtggcagttggatgaaatgttctgtaaaggtctgttaggtttatttggtctagagtatagtttagcttcactgtttgaagttaaacactgatgttcttacatttcttataagaacattttatgtttcttatgtataagaacactgatgtttttatatttctagtctaataatgtattattaaactaaaaatataagatttgtcctggagaatgttccatgtcctgatgaaaagaatgtgtattctgtagcagttggatgaaatgttctgtaaatgtcttaggtttatttggtctagagtatagttttttacttcagtgtttgttgattttctgttgggatgatctgtccattgccgaaagtaggaaattgaaatcccctactattattgtatttatctcttgctcttgctcttatgtattcacacttgctctctctcatgctctctctctctctctttccctttgtatctaataatatttgctttatatatttgggtacaccaatgttgggtgcatatatatttactattgttatatccttttgctgaattgacccctttatcattatattatgatctcctttgtccctttttacagtttttgacttaaagtctattttgcctaatgtaattataggtattcctgcccttttctggtttttatttgaatagaatatctttctgcatcccttcactttcagcatctatgtgtctttataggtgaaatgagtttcttgtaggcagcatgtatctgggtcttgtttttaaaatccattcacccaccctgtgtctttatttgggttttatttgagatggagcctcactctgtcccccatgctggagtgcagtggtgtgatctcggctcactgcaacctccaactccctggttcaagcgattcttctgcctcagcctcccaagtagctgggactacaggcgtgcaccaccatgcctggctaatttttgtatttttagtagagacggtttcactatgttggccaggctggtctcaaactccggacctcatgatccacccgcctcggcctcccaaagtgttgggattacaggcgtgagccactgcgcccggcctatcctgtgtcttaattggagcatttagttcatttatattcagtattattgatagataaggttttactactcttattttgttacttgttttctagttgtttttaacttttcttctgcttcttttcttactgtctttctttgtggttaggtgattttctcttaagagtacattttaatttattgctttttatccatttttgctctgtggttaccaagaggcttataaataaacatcctgtagttatagcaagtatttaaaactgataatcaacttaactttgattggaaaaaaaacacacaaaagtgaacattaacttccttctcccccttcattttgaatttctgatgtcacagttcacatttttatattgcctatcttgtaacaaattgttgtagttattatttttaatagttttgtcttttagtcgtcttactacagatattagtgttttaaacactgcaaatacaatattaatataacactcattttagtgtttcttccagtttgaagaagtttttaaagcatttcttattggacaagtctgattatggtaaattccctcagcttttgtttgtctaagaaagtctttatttctccttcagttttgaaggataattgtgctgagcacagtaatcttggttgacagtttcttctccaccagcattccaaatatattcttccacattttcctggcttataaggtttctgctgataagtctgctaccaggcatattggatcttccttgcatgttatttacttctttcctttcagtgatttcagaagtttttctttgtgcctttgacctttgtgagtttgattataatgtgtcctagagtagtcttctttgtgtttaatctaattagtgatctttgaccttagtctacctgaatatttatatcttttttcaggtatggaaagttttctgttatcatttccttgtataagttttctacccctttgtctttctcagtccttctttgacttcagtaacctgaatatttgcccttttgatgttgtcccatagattttgtaagcttgcttgcttccttttctttttttttctcttctcaccatatttttaatcatttttctttgaactcactgattcttttatttggttaattctgcttctgttgctctctattgagattttcgcttcattaattttttttttttagttgcaggatttctggttttttaaaaaagttatttgagtctcttatatttctttcataattttctgaattgattcttcatgttttctttaagttctttgagctgtcttcaaacaggtattttgaatttttggagagatcacatatctcggtcactttcaggttagtctgtggtaccttattttgttcttttggtgtgatgtatttccctaaatgttctcaatgctttagaagtgtgatgatgtctgagcattgagggatttgtaatttattttagtcttcccagcctggctttgtttgtgcctgtccttcttcaagaggccttccagggattctaaagctgacttactattgcattctctgagcctctgaccaattacagccatctcagcactagagtatgctttaagcccaggttttctgagtcctgcaagggcaccaaggttgacacagctttctggcccagatggacctcgggaagacccaagggaggtagttgggctgcctgggaatgctgtccagacacctgaagccagaagactctcctagtggtcctgataggtatgcctcccaacaaatctctgcacagatgggataggtccctgactacaaagagagtggctggagttgagactgtgcgtctttggaatctactgtggaaaggaggctgattggctcacctcattggctcagattagcatgcatcacccaacaggtcccagtatctgggcagtttcttgactgcagcaagagggcttggagccaagactgggccccttcagtatctactatggatatgcctgtcacatggatccagttgggcgtgtgtctcccagcaagtccctccatagatggaatgattccctgactacagcaggagaggctggaggtgtgactgtgcccccttgggatttgctgtgggacagaggattgagagcctggtcttggctcagaggggtgtgcatcgccctgaatgttcctgcacatacaggatatttccccaactgcagtgagacgagccaaagctgaaactgcaccaccctgggatctgctgttggatggaggttgatgtgcttgtcatgttggctcagatgggcgtatgtctcccagcaggtctctgcatagacaggagggttccctaacagcaggaggagggtctggatctgagactggaccctctcaggatctgctgtgggatggtggctggagaacctggtctgagcatgcatctcaccagtagaccctgtagacaagatagtttcctggttgcagcaggaaaggctggagctgagactgggctccctcaggatctcctgtgttgcagaatctggagagcctgtcttgtttgcccggacagatacccctcttccagcagatctctgcacagaattattttcagaccacagcaagaagggtcagagctgagaatggaccacctgaggatctgctgtgggatggaggttggcgtgcctgtctcattagctcaaatgggcacccatctcccagcaggttcctgtttctgcacagataggatgcatcccctactgcagcaggaggagctgaggctgagtctggggcctcccttgggatctgtggcatggagtctggagccccttgtctcattgactcagagacacacccacaggagataacttttcaacttctagtaagcaatcatttgaatcattaagtatttttggtgtattatacataaccacacttaattacaattcatacctgtaccttcttattgctacccatatttgaggaataggtctttcccttctttccttctatatttaaaaccttttatctatattttcttctcatgccttgagtctaatctcaaaccttgttctcttcttgatctttgctaactttgttgtaaatgtgctcctatcccactattgaaacaaacaggcaaactctccaacattcgccttatctatcctcatttcagctgaatttcttgacagtgtagttcacacttctttatctctgatgcattcagctgctctcaccacgtttttaaaatccagtgggcacgagtcacccatgaccttttagttgccaaatccagtgaacacttttcagttcttgtctgacttatctctggcatttatcagtgttgaccttaccataactctgaaacttttcctgtcttgcttagcttatgtgataccttttccctcaggtttttcttcttttctggctcctcttcttccttttccacagctggcaattcctactcttacagctcttctaatgttttcctttcctttcctttatctttaggcaaaggctatggtgtgtgtgtgtgtgtgtgtgtgtgtgtgtgtgtgtgtgtgtgtgtgtgtgtgttctagcaacctctttcaaatgaattccaatggattctaacactaagctggagtgtcaggtactacttgtgatttcttctcttttatcttcctgggagttttacagaatctacagtagtgatcactacttcccacagtcttttcctgacactttctttctccctttctccagtttattcacttctcttttagattacaggacaattttcctctgttctccgtacatccagcctggctgtcctccagtctgtgttccatagagctactgaaaaccctactaagaaacaaattttgtaataccatttccttacaatgcttcagtaattaatgttaacatttaggttaaaaacagccttatcattaagaaaacttttaaactgatttaaaatttatataatgtgaaatcattttaaagtatacaattcagtggcatttactgcattcacaatgctgcacaaccacaaccataatttctaaataattctaagttttcatcaccccaaagggaaactccatacccatcaagcagtcatttgtcattctcccctccagctagccccgttcatccattaatcagctttctgtgtccgtgggtttacctattctggaggtttcatatacatgaaatcatcactatatgtgaccttttctgtctggtcttttacttagaataatgtcgtggaggtgcatcccattttgttgcatatattagcacttcatttttttgattgaataatgttccattgtatagctataccacatttgttattcattcatcaattgatggacattcgagttgtttctgccttttgaatgcctgattttgattcatttttgtagagtccttaggttttcctaagtataagatcatttcgtctgggaacaaggctaatttaatttcctctttttcaatttggatgccctttatttctttgtcttacctaaatgctttggctgattcattttgggcaaatacctgggaagagtgtttaattgctgggtcatatggtaattctatatttaactttttaaggaaatgccaaactgtctactacaacatctacaataagataaattttcaccagcaacttatgagggttccagtttgtgtacatcctcactaactcttgttattttattttccagttttaaatactattaatatctaactcagtgggtataaagttatatctcattgtatttatgatttgccttttcctaatgactaatgatattgtaaatgttttcatgtgcctgttgcccatgcatacatctttttgggagaaatgtatattcaacttactttcccgttttttatttgagttttatttttaaccaagaaataccttttaagtgatcagacctggaaccttgccaggtttaatgattatcaaagcagagccatattttgacttttgatgttatctattattatagtcttgttattcataattacttgaatattatcagcatctctagatcctttgtagttaaaacatagtaaagtattttaagtctttatactaaaatagtacgtcttgaaagttttaatatagaacactctgcttagcatttctttataacctaaaatgcaattaataaaagggtgtcatttcctctgccaattaagtagccttcattggttgatattgaacaaattgctgatacttatttctgtgatgtttactttttaaaaaaaatattttttgctttctttttaacacttccaaacaattgctaggttaatttgtcagttgcaaatctgaaataaaattgtttttagcagtctttcaaataaaattttcgttgagactaaagagatcctggattacaatcaacatttgtagatatgtcatacatagagaaccaaaaaaaaattataaatctgatataaatatcagtgtgccatacaggcatggtggctcatgcctgtaatctcagcattttgggaggctgaggcaggtggatcacttgagtctaggagttcgagattagcctgggcaacatggtgaaaccccatctctataaaaaatacaaaaattagccaagcatggtggtacacacctgtagtcccagctgtttgggaggctgaggtgggcggattgtttgagcttggtaggcagaggttacagtgagccaagattgtgcctctgcactccagcctaggtaacagagcgagaccctgtctcagaaagcaaaacaaaaacgcccaaatatcaatgtgctatgaaaccacacattgtatgtgttcattcccacaaattggagcattttaagaagcgctctaaattagtttatgtcttgcttttcttcttatgttctgtagattctttagtactccataagaaaaatttgctatagaaagcataaaaactgcaaatgcattatatcctccatgaaaccagctttaatttagttgctaaaccctgatcattgttgcactatacactcagaaaatgtatagcagtgactattttgtaaatatgaagagttcatattcagcacattcagcaatggtttatatctaaaatgatttttgaagaatgctttaaaaaacttctttgcctagagtctttaaagctggcactttaaaactatgtttcatggattgtcagttggaatggacttcaggaggtccataagtccatgaaattacagttttttaacatgaatttttctgaggatacatgatttttatcatactctcaaaagaatctaaaactcaaaaatggttaagagacacttaaataaaatgttgataaaggccatggtcattgattctcattcttcagaagctttgcatgtgtgagtttacctactcactaaaatgtacttgtaaatccaaaaccagtactcggtgcttttgcagtcatttgtaaacatatttggagaagcaaaaattttgagttaccttatgtgttcattcctctctgaggtcaaagaaggtgatggtttgccttgtttcagctgtcatactgtaaacaagtgtccttttcaatgcgtatttagtgccatattaatcacattttttgttgttgatttttctgtttaaaatggttcccaagcatagtgcagatatgctgtctagtgtttctaagcataagaaggctgtgatacacctgagagaataaaaatctgtaatagacaaacttggttcaggcatgagttacactgctgttgactgtgagtttattgttaataaatcaaatatgaagtatcaatatctgtataaatagttaaatataattatatatagatgtaaatataaattgttaaaatacggaatctttaaacagaaacatacattttagaaattatgtattggcattggttgaccaagatgatgtttggagaggttttcaggaaactaaccctgtctttttcccaggaacaataattctgcaggaggcagaacctgttgtctaggttggagtacagtggcatgaacatggctcactgcagttttgacctcctgtgcttcttctgccccagcttcccaagtagttcaggctacaggcacatgtcaccatgcctggtaatttttgtattttttgtagagacagggtttttcttgcccagactggtcttgaatttctgggctcaaacaatcctcccatcttggccccacaaagtactgagattagagatgtgagcctccatgcccagctatagttaaccttttgcagtgtttttttttttaacttaatgtttctaaatttcttctagggtaaacatttactacgtagaggctgtgtgtcatttacctcttcatggtatcacacatcagatacttctaacataatcatgataaatgttagtggtttcatggtcttatttacactccagctctaccagaattcactaatctacttcaagtttctgtctgaaatattctttttttttttttgatacagagtctcactttgttgcccaggctggagtgccgtggccccatttcagatcactgcaaactctgcctcctgtgttcaagtgattctcctgcctcagcttcccaagtagctgggacttacaggcacacgccaccacacccaactaattatatttttagtaaacatggagtttcaccatgttggccaggctggtctcaaactcctgacctcaagtgatctgcctgccttagcctcccaaagtgctaggattaacagacacgagccaccgcatcctgcctctgtctgaaatattcttattgttcatcatacagtatattgggctacagtactgtatttttctccagggtgttggtaaccatttatgctgagtttagccattttacttaagagtctactaattcactgtagataaagagttactactttggcatggtggagcatgcctgtaatcccagctctttgtgggaggccaaggcaggtggatcgctcgagtctaggagctcaagaccagccaagacaacatggcaaattttatttctacaaaaattacaaatattagccaggtgtggtggtgcatgcctgtagtcccagctactgaggaagctgaggtgggaggattatttgagaccgggaggtagaggctgcaatgagccatgattgtgccgctgtgctccagcctcagagacagagcagtaccacaaaaagagttagaagagttctttatctaacaaatatgagttgtatatttgcatagttgattgcattcatgaagtctaagtatttttttattcattaaatctaaaggaagttggggctctctgctttcgataagatgaagtaacaagtactgtacttatccttcacctaaaataatgattaaagaaaatttgtgtgtttatttcttaagacacagaacaagcatttgataaaatccaacatccattcctcataaaatcactcctgaaactggtgatagagaggaacttcctcaacctgataattagcatctataaggaaccaatggtaatattatatttactggtgaatgtctgaatgctttctcactaagatcaggaataagacaaggatgtctactttcactacttctgttcgatactgtactgcaggttctagccagtgcaattagttaagaaaaagaagtgcttctagattaaaaaacagaagtaaatcaatcattatacttcagtgatatgatcatctatgtatattattctatagaatctacaaaaaggtactagaatgaataattgagtttagcatgcttgcagaatataagatcagtatttaaaactcatgtagttttctgtactaggaacaaaaatttgaaattaaaatttaatagaagaaatattttctatcacataaataataggctatacttggggacaaatctgacaaaagatctggaagacctttactctgaaaactgtaaaaacattactgaatgaaaataagtgtgcagattctttacatatgatactaatagaatgatctgtttaaaattgattaattgtgcatcagctatatacataagccaaaacttaaacaattgtacaccttaaatatgtacagttaattttgttaattcaaatccctatactactgttaaaacaaattagaaaaacaaactaaaggaatttatgttcatatgacagtgaatgagttgtctgaactcacctcaatttttaatcctaagatgaatccatctctaaaaagtactgaacatctctgaaaagttatgaatatggtgtatgttttctcccataacctcatatatagcaattattgttattaggaaatcagaactagcttaaataatcataacattgaccatctgctttccttgttaaatacatttgactactaacttaatgttttcagttagccctctaaaatttgagaaagcaacatcttttttacctttttgccagatttctacaggctttctgatatatagttggccctctagatcattgctggcagtttgaaatatgtgtgattatgatagagtatttaaaatattttattataaatatttgatcaattttttattatataaattttcttcttttaaaaaaatacaatttagagatggggatcatactatgttgcccaggtcttgaactcctgggctcaagtgatccttctgccttggcctccaaaagtgctgggattatagatgtgagccactgcacccaggctagggtaaacttttgataaatatttttgattatgtagaataattttatggtgagttcaaagtagggttttgcaatttttattgtggagatgtatttatactgttagtttcaggatatctgtactgatcatctcctgtgtttttaatcatgatgtttccttttcaaacaacacattatgatgaaagatcaattttcaatgaaatcatttataagtatatactagctattgcaactttggggtttggaaaggaaaaattaaagtgtgttatgtttacatgttggaaacatgttagaaaaatcagtctaggattggaaggagatgggaagatttaggagtaactgctaatgggtacaaggtttcttcttagggtgagaaaatgttctacaatgatttgtggtaatggttacagaagtatgattatacctaaaatcattgaatcatatgctttaactggataaataaaaggcatttatattggaaaggaaatagtaaaactgtatctgtttgtagataacatgatcttatataccaaacaaaaatcttaagcagtcccctacagatctattagaagtaataaatggcttttcacactacccacatagacgtccatacggcgttctttctggattcccatcgtagcttaaagcgaaacttttcaccatgtctggagcccttgatgtcctgcaaatgaaggaggaggatgtccttaagttccttgcagcaggaacctgcttaggtggtaccaatcttgacttccagatggaacagtacatctctataaggaaaagtgatggcatccacatcgtaaatctgaagaggacctgggagaagcttctgctggcagcttgtgccattgttgccattgaaaaccctgctgatgtcagtgttatatcctccaggaatattggccaaagggctgtgctgaagtttgctgctgccactggagccactccaattgttggccacttcactcctggaaccttcactaaccacatccaggcagccttccaagagccacggcttcttgtggttactgaccccagggctgaccaccagcctctcacagaggcatcttacgttaacctatctaccgttgctttgtgtaacacagattctcctctgcactttgtggacattgccattctatgcaacaataagggagctcactcaatgggtttgatgtggtggatgccagcccgggaaggtttgcgcgcgtgtggcaccatttcccatgaacacccatgggaattcatgcctgatctctacagagatcctaaagagactgaaaaagcagagcagcctgctgctgaaaaggctgtgaccaaggaggaatttcagggtgaatggactgctccagctcctgagttaactgctactcagcctgaggttgcagactggtctgaaggtgtgcaggtgccctctgcgcctattcatcagttccctactgaagactggagtgctgagcctgccacggaaggctggtccacagctcccaatgctcaggccattgaatgggtaggagcaaacactgaaaggtcttaagctgttattgcacacgctcttaagcaacatggaaataaggttgacggaaaataaatgtcagtttaaaaaaaaaaaagtaatgcattcagcaaggttgacagataaaatatcaagatagaaaaatatattggatttttgagcaatattaatgggcaaattgaaaatgaagttatgaaacaatttcatttaaatatcttaaaaagaaataatgtacttaagtataaatataacaacagaagtgtggaacttatactctaaaaactacataacattgaaagacattaaaggaaactaaatggaaagacattaaatgttgatattttgaaaagatttaatatttttaggatggcagttctcccccaaattgatctaaaataaatttcctactaaaatcacagctaaattctttgcacaatttgacaagctgctcttaaaattaatatggaaattcaagggacccagtatagccaaaacaatcttgaaaaagaccaaaattgtgtttctcacttcccaattaaaaaacgtatgatgaagccataccaatatgtagttctggcataatgatagacatatctattaatggtatagaattgagaacagaaataagtcttcacatttatggtaacctgtctttctataagtgtgccatggcataaagaatagtcttttcaatgaagggtactagaacacctgcccatccatatgggaaaaaaaaaaagctggacccctatctcatatgcaaaaattaactcaaaatgaattaaagacttaaatgtaagaactaaaactgcaaccgttagaagacatagggatacatgtttatgactgggcatgggatatgagctggcaaatgattcttagataggtcaccaaaagcatgagcaataagagaaaagaataaataaattagatttcatcaagttttgaaagttttgtgctttaaaggacaccatcaagaaagtgaaaagacaacccacagaatgggagaaaattgcactcacatatctattttatcttgaatatataaagaattatttagactcaataatgatgaaaagacaaataactcactttaaaaaatgggcagaatatctgagtaggcagtttcccaaaagaagatatacaaatgactaaggagcacataaaaagatgctcaacataattagctatcaggtatattaaagtcaaaactacaatgagataccatttcactcctgctaggatgatgggtataatcagaaggacagagttttggcaaggatttggagaaccctaaggcattgctggtgggaatgttaaatagtgcagcctttttggaaaagagtcttgcaattccttaaatattttaacatagagttaccatatccagcaattctgctcctaggtatatacacaagacaaatgaaaatgtttgcacaaatgtttatagcagcattatgtataatagcctaaacatggaaacaacccaagtgtgttactgataaatgaataaacaaaatttggaatatccatgcaatagaatattatttgacaaaaaagaaatgaagtactgatacatgctacaacatgggcaaattttgaaaatatcgtgctaaatgaaggaagccagtcataaaagtacacatgttttatgattccatgtctgagaagtggcctgaacatgcatatttttagagacagaaaataaattagtgtttgcctgggacttgtgaagatgaggttttcggaagtgatgactcaagagtgaactggtttttttggggggtgttgaaaaatgttctaaaattgatgtggtgatgcctatacaactccaaatatactaaacaccattgaactgtacacttcaaagggatgaattgcatagtatgtgaattatatcttaaggagctgataaagaatatatatttattggtctgttttaccctttgaatggattttacccatatgtgatgtttttaccatgatacattaatcatttgccagagtttttgttccttaaattatgcatatcttacaaatgtaaaatgtcttatttgtcaatatcactactaaacaagaaaatagtctttaagcattgggaacctcactggtggatatgagttttacacgatcataattttcagagacccagggagaattatctcccattttttgattagttttctgtacactgttgcctaattatctttctgaaatacagattgatcaggtaactctctgatcccagcctgcttgtcattgtcatgcatggttagtccttcataaaatatgctattatggaccccatcttttactaaattcagagaaagcatgcccatgtctctctgtgttttttgtgtgtatgagtttctctatgtataattcactttagtttatttttcttcttttcgcctggtaaaatcttcaaacttcaagaaacagcatatctgttatttactctttgaccttttcattataccccatattccttggtgctttccaagttttttgttcgtacctttattataacactcctcgtatgttgttttcatgcttactcctccagtagagctatgaacttctcatgactttatttgtgcttctattccctcacagagtactttagatataataagagtctcttggattaatgagttcctaattttattgtgggtgctcagtaacatttttattttgatgatgttataattgaggtatgaatcagactccccttacactttctgcatataaatcttttttgtaaaagaattctatacattttaattatcctataaaaacttaattaccaatattgtttgtagatgtctgttgccagatttttaaaaaatgatgcattaccatccccataaatgataattgccttttgctttttttaatataaaaatgacaactttgcctgtcaaattataaaaaatgttttctcattattttcatttgccattctttggttactgtgctagagaatatatatgtctattgtttgttagtgtttatatcattgccctttaaaaaaattgtagttgtgcaagaatggatgtaggcaggctaaaatatggactctccagagatgtggatatgcctgggaaattgtcatttgatttacctgtcttcacaatcagcattttggaccgtgatacagttgttactacctatttacacttggctgataggcaggctcaaagctgtagcctcttattagagtcagtcaaggggggccagaatggcaagagccatttttttttttaaactgctggtcctacctcagcagcaccaggagagtggcaaagggggcttcttcaaagattttatggtatcttcactttatgtcaaagtctaagctatcagtatttttctttgtagtagttggtgtatgtgccaaagttagaaaatctttctctgtcttggttattaaaataagtggctgaattttctaatacctttatgggttctgttttgttttggtttgttttttcatttgtgtggggtttttgttgttgctgctgttgttgtttttacacttttggttaaagtgtgacaggaaaaacttttctttttttccctgaaaatggttctgtttttatgccagcttaatgtactaattccctcatttccgtctaaaaaaaaaatcacctttattttaatactatattgccataggtacttggatccgtgtttgaactctgtatttttctgttgatctgtatattagtaccaaattgtttctaaagcaattaacaaataatacattttaatacctggtagtaaactgctcccttaatcccatcattattactcatctatttcagaaggtactttcttattattcttccacatgaatttaaaaatcatattgatattttcaaaatatcacattggaatttgtaggttctttaggaagaaataacattttagggtacatttttgttttcttatcatatatcaagtttttcattttaattatttatttcatagctttttattatcgaaagtttcaaacatacacagagaaagaatagtaggtataatgagctccacgtttctattctctatctagcttcagtaattatttacatttgccaaacctgatttaagtacctctcctatgaagcaagtcccagatgtcttatcatttcatcctcaaatgctctagattgcctgagaatggtctcaaaaaacccaccatcatattattcacaatggtaatttcttactgctatttaatatccaatttagatttgcatttcataattgtttcaaaaatagccttttacagtaagtttatttgaatcagcatctaaagaattcaaacactatatttgtaccttgtgtcttttattattactgcttttctctctctcgtcttttttttttttttttaatactgtcattgacctttttttaaaagagaaactgtgttatttttccaggagaatatctcactttctgaatttggttagttgcttcatatttagtatttgctgagaatttgagctagagatttggttaaactcaggttttatttctttaggcaagaatcttcttaaagtgatgctccatcatttccattttatctcatctgtgagccatcatatctggtggttccacttttaatgatgctgagattaatcaatatgttcaggtgtaggttttttgtttgtctggttttctttctgctattgtatatagaacattttccttactgtttttctagtaggttattattggtatctgagaagatttttaaagcatgtgttttagtaactggacatctgaccaaactctcattactgtgtcaacttaaaaatcatgagatctgtaaatctggaaaagagaactttatttctgagaagggttacaacctgtaggctgggaagcacagcctctggattagatcaaaagtagccatttcaaagacgatgggtgagagaggagttttacactaaatgggttagctgaacatacatatttaacaggttataggaggagctatgagtattcatgaaaggggttacatgtatgtatgataagcaaacataacatgttacatatgtcccatgttcgctttggaatggagacttaacattaaaaatgtggtaaaatcagactctatacatcaaaggtgaaacttaggactcaaaggtgctttgtgcacattctctgtaaactgaccagtccatggtcaattgtcgtttatcaggaaggattgctttgtaagttggtcagcagtcatgtcaaaaccatgaaaagggaggggaatctggccacaacatcaggcagttggtcagtggaagaattttccattctttcttttccagggctggtgtttgtttaactcttaggaaaaatagtctaatgacaggtagtgaggaagagtgtatactgagacgtgaccaacctcctatctcatcaaggccgggaaacttcgtttttaaagtttttctggggcctccttagcccacagacatctgttcagtaggttggggcacttaggattttactttatctcacaaatatctaataaaatttttgggtgatcctcttcagtgactagtatagaattgtcacacttgagctttggagatgaggtgtctcaaattaaaccctaggatggttatttagtctttctgtgcctcagttttttttttttttaatctatgaaatggagatcatgtgtctacctcataggtttataatgaagattgaatcacttcccataataatcagaaactacatatttgggctgggagcagaggctcacacctgtaatcccagccccttgagcccaggagtttgaggttatagtgagttatgagcatgccaaagcactcagagtgagattctgtttcaaaaaaagaaagcagatgtttgttttttaatttttccatatcttttgcagattgtgatattgtgctttccctttttttcatattttaggcctttaattttaggatgtaattatataggccataacagttaaaaaatagcagtgataacatgcatcctacaataacatgaatagctaatatttattttagtataattttcttcttgtataattatgttgttttagtagtatgttttgaatatcaccagaataaatttttggtatctattaaaataatactataatttctttacattgatcttttaagatacagtttatccaatacttatgatgccaggttccagaatgcattagaagagtgtttgtggcatagggaatgttggaacagaagcaacactttacaatgttaaatagttttattgagaaggtgagatttgggtaaagactttcaagatgagtgaggatccatatgggtttctgggggaaatccagttcagtggaggggttggcatttgctaaaggagggcatgtttggtgtgtttcaaaatccagtagggagccgggtgtggtggtgtgcttctggagtcctagctgctcaggaggctaaggtgggaggattgcttgagcccaggagttcagatctagcctggacaacatagcaagatcccatctctaaaataaaataaaaatttaaaaaattgtttaaaatcctgtagagagttcagagtggttggagcagagtaatggagaatagtagacaatggagttagagaggcaatgagaggtaaagggaagtggcttgaacctgtagggcctcatagactattgtaaagatttttgctttttagtgagtgttgttggaagcattacagggttttgaacaaaggaatgacatactttggcttgcatttaaaaaggacagctctatgtgcgtggagtcaaggatggaagcagagaggttaggaaatcatcgcaacagtctaggcaagcagttatggtaacttggatgggtggtagcgtggagttaatgaaaagtggttgaaatctggaaatagtttgagaacaggcttttcaaatggactggatgtggtgtgtgaataacactcttctcactggtcttgttgcctctccaatccagttatacacagtagcaaaaatgatcttactttacatttgataatttcaccttcttgattaaaatccttcagtgacatactattacactgaataaaatttatccttcttaatataaccaacaaggcccacataatctagaactgcatatttttctaaccgttttcatctccctgagctccagccatacaggtgttaaattgttttaatatgccaaagtttttcctgcctcagatgctttgcattgctcctccctctggaaacttcccctaaccgtaaggtcactctttacccaatcagctcatttgcatgtttcacgtctcagtttaaatgtccttttgtctatttaaaatatattttagctgagtgcctttaatcccagctacttgggaggctgaggcaggaggataacttgaggccaggagatagagaccagcctgggcaacatagagagacctggtctctgaaaaattgaagaattagctgggtttgatggcttgcacatgtagttctagctacacaggaggctgaggcagggaggatcacttgagcccaagagttcaaggttacagtgagctatgattgtaccactgcactccagtctgagtgacagagtgagactccatctctaaaaaaataaataattggttccttctttgcctgcctcccactctttgtctttctcaaacatttttttcttcatagcatttcttacaattatgcattttatttctgtgtaatgtttttgtttgctatgctttgcattttatattgtgtggaatctccatgaaaataaggaccagcctgacttgttcaagtttgtggtcaagtaacaggatggtacctggcccttagaactatctttataaatatcattagattggattgactgactcaattaatgaacaaatgaacaaacaaaataaatcattatatgctgaagtagcagtcctggacattgtatctaatttagattttaatttaaccttgttattttgatactcgcttcccttaatcagtcattgcatgttccttattgtaaggtggttgtttttctttatcatgagaagaatagttcttctccgggcgcagtggctcacatctgtaatcccagcactttggggaggctgagacgggcggatcacaaggtcaggagattgagaccatcctggttaacatggtaaaaccccatctctactaaaaatgcaaaaaattagctgggtgtggtggcatgcacctgtagtcccagctacttgggaggctgaggcaggacaatcgcttgaacctgggaggcagaggttgcagtgaatcgagatcgtgccactgcactccagcctgggcgacagagtgagaccctgtctcaaaaaaaaacacatttttttatttagctattagcttctaggcaaaatcttaaatttcagaaaataattatactcatatagtcatactacctgtcagggaaatgtgtcaaaggaaatatgaaacaatagctttaaagttgtcccgcaccctcaccctgtttttcttttgaaggtattatactaaaggaagaaagggaaaaagagaaatctatggtgtgagttcaagtttactactgtaagtgtttaagaaagggctctgttaccatgacaacaaatgcatgaatttcatgtggaaaattttcagtgtatgggactgataaaattgtaacattctgattttctctggtatagaattgttctttgtcaagttaaaaaaaatctgttaatatatgttaaaattaaatttttaaatgttttatgatattgttttctaattgtttattataacttaaaatcatagccaaaagagtgtactttcgtagatctgtcaagcagaaagttaagtatttgatttgacattaaaaattacttttctaatctgtattagatttttgctaaatggtaaataaaatggtaaatagtttcatgtattgggagttcttgacaatagaaaatgacctgccactttatagattcctttgccttaaatgcttactaactcaggtagaggaaagctgttaagctttaagtgctttgtcatatttgcaggcttttatagtggaagagaacagcagtcagcaatgatgatggaaaactgtggcaggtagacttaaaacaccataaagcacagacgattgtgtgtaatgccttgaattgaatcctttttgaatgaaatgatcagccatatgtgccacccttatggaccctgtaagaagagtagaagaaatgtgccctaatgctaactgtgcatgaaattgcagtgttaggagatattgaccagatgtttcaatctcagcaaatggcttgttatgtgactgagtgaaaatatctttgctgctttgatcacatacaccttgaaggaaggggtaatttaatagaggctgtcatagttcatcattgtcaataaactttgacttgacctttgccttacgtttttgatgttgctgctgttaagtgttgttgggcagatgtttactgccttgagggattttgctttttataaagtgtatactagaaaaagtaaaggagaaggattttctcaattcttttcttattctttggttattagttggcatgcttctctgtggattttgtagaatttctgggcagatgcatttgagtgacattcttatgtctaaagatcactgtggtgtttctctaaaggtttcttcctttcctcaccttcctttttcttttctcgagacatggtctcactctgtcactcaggctggagtgcaagtgatgtaatcttggctcactgcagcctctacctcccaggctcaggcgatcctctcacctcagcctcctgagtagctagaactacaggtgcacaccaccatgcctggctaatttttgtattttttctagagatggggttttaccacattgcctaggctggtctcgaacttctgagctcaagccatctgccggcctcagcctcccaaaatgctgggattgcaggtgtgagccaccgcacctggccctttctcaccgttttgtcctggttttaatttaccacaataaacttccttggtggtttttctttcttattttatatacagcctattcttttgttctgatgaaagtcacattgaattaaaacttgacacctattgtaacaccataccaggtgctgtgttatttttttatccctagttttggagacctttggagataaatccatgctattttgtaatccatttttgttaatcttaagaaattgagtgaaagtttcagtaacacaatttttttaaaattataagatacagtattttaaaattttggtaaatagctttggattaaatgagtttcttgtttaatttgatgaatttgactcagttctgtaacctttttgctctttttcttgaaaagaaaaaggcttcctcactggctatatctgggttctgcctacactcttccctcacttccccttggtgtaggtggcctagaccgtgttagtcacctaatgaaatctgtgaatcctctcttgaaaaacacagcaaagtttccttacaatttcaggatgtttattggattttccccccctcctctcacacataccctgcaatgataggggcccctggacttcaagcagactaacaaagcttagaaaataagattcatactccttcttagtattctagatatataacaatttgacttagaagtaacaataacaatagtattagtgatactgctacaataattacaacagtaataataataataataattaaaatttactttctgccaaccttatgccagattctatgctgaacctttaacctgtattactggttatattgttaatgatacctctagatagagtatatgcagcatacttttattctgtactttaggaaatactatatctttagaatacagatttgagtaagagattataagcattttgattctaagactttttggaatactgaacttttagttttctgattccagtagtcagtctgtctgtctctgtctctgtctctgtctctctctctctctctctttctcggcctctctgccattcatcttcttctgaaaattagctatcccacgtaagcctcatatatcccctaattcctatttgtagttgtgagggaggaaaaatattttccttctaagttctctgctgtaagattcttgtaacaaaagacagattaacaaaagttaagtacactaatttatattctaagttttatgtaacatagagggaaatgaagacttgaagaaacaattaaacctggtgtttttacattaggttttatgaagagtggaagggaaaggcaataggacaaaaaggggtatgaactaagagtagtaaactgaggggaccttagcaagacctgtttgtttagattcatctcatgtccttacatcttctgagataaggatgttctttttttctgcatatagtaaacatcctctcacatggatggtcttatgatttgcttcagaggaaatcagaaagtccttcctgcacctgctgttctcaaattccttcagcttaaaattttcagtatgtcaagtgccatattttgggggtagtgtgtcctgatctccatcatagttaagtgtcagcttggacacagtttctcatatttatcttaggaaatcttctttggccactctgcaaagactaaggtgctacttgcatgttctgcaacaactcctattatatatatatcatctcttaaaataaatagtaacatatcttgtatgtaagctttatgtacccttaaattgtaagttttaagaagatacaatcctggctttcctgttcacttatttgacaattatttaattgcatagaatgtagcaggcactcttctagatttggaaacacaccctacaactcttttaaaaaagccaagaaaacagtcttgaacagcaaattacaattaagtggaattaattctatgataggaatgatacagtttgttgcggcaacataaaatgcaggcatataggctgggcacggttgctcacacctgtaatcccagcactttgggaggccgaggtggatggatcacttgaggtcaggagttcaagaccagcctggccaacatggtggaaccccacctctattaaaaatgcaaatattagctgggcatggtggcgtgcacctgtaatcccagctactcaggaggctggggtaggagaattgctcgaacctggaaggcagaggtttgcggtgagtcaagatcgcaccactgctctccagcctgggtgacagagcaagactccgtctcaaaaaaataaaaaataaataacaatgggtatatagaacagaatttaggacaacattgtctcagtaagtgaaacctgaaacctaagtaggaagctagaaagaacaaacagaaacagaatgaagtattcagtgtactggaacattgcattcaagagtgttaatgcttaggattaacttggagaggaagttaatggttcaatcataaagttgtttatgttgaacttgcttaagatacttgggtaacgattgaaggacattttaggaagagcactcaaaatgcagtggattggagaaaaacagaactaaaggcagggagatgatctaagaagcttttgcaaatggttgcatggttgggaggatggagtgacagagagaatgggaaatgacatccaatgggtagaggtttctttttgagataatgaaaatgtgatggttgcacagctatgtgaataaacaggaaacaactgaattgtatattttaaagtggcaaattgtatggttatatgaatatatctcaataaatttttttaaaagagacttttatagtagtctaattgagagtagatggtggcctgtactaaagtggtgttaatagaggcaggagtaaaagtgtgtcaatttaataggcaaaatagggttgagtaggtatttggatattcagagcagtcatttgaaaacaagtataagctaaaaatgagggggtctcagcatatagatgataattgaaaccatgagagtagattagatcatatccagagaaagtatatacggtaagaattgtaggtaacctgggaatccaggcctgagaaatgctaaggaatggggagaaggaaagaagcctacaaaagagatagagaagacttctttatccattattaattacaataatgtccaacaaataataggtgatcaacaaatattggtggaatgaattgaatgaatatacactaaaaattctgcattttatcacagtctcagggcactgttgtcatcgtcagctgtactctgtaataggcactgccttgaacactttgcttacattatcctattcaatcatcacaataattccacaagaaacatagtctctgaaatagtagcttgtttaccatcacatggctggatgaacttatatatctgagtctaaagtttattttttctactaggcctaatattccccgaatctgttctgagaatgttaacagatatttactaacaaaaataacaatagaactatttcagggaaagaacaggattattagaaattgatttttattaataggatgcttgctggcaggggcaatggagcagttttttaaggaaagaagcataacatactagttattcagttagaatagattcttaatatttatgaaaatcttgtgttttgccctgtctcacttggtggtattgtaatcatctgagaatctatcctataagttatgtgatatatgctattttccttatcaatctatttcagttttgatttcctcatcatcctttgcagtctgcttgttgctgtttctcagttttgacatttaatttcttttagttgtgctttacagtttttctgagatgcctcattgagttttctgtataaaatttcatatctttggcttatcttgcaactcttttagtacctaggtgtcattcttcatcattctattatgaattgaattaaagcatatggcattatttcagaagtgactgcctcttgggcatcattgtcagttatattgtcctaaatattgcatttaggtaataaaaaggaaatcttccttgaaggtaaagttaatattaatagaaatctttccatatgttgttaaagactcttgttatgaagtttaatatgccatttatttaggccttatttaaattcagttgtaaattttttccttctggctccttaccttagtgaactgtcatctcttatcatcatactctttgctcgaaaaccttcatgtgttgctttctaccctcaggatgttgcctaaatttcttgaagtggtatttactgatctggcctacatctacctttcccattagtctcttccttcccacatagttgctttgtcggtatactcctaatagtcttttatttctgtttttcattgtttttgttaatattatattcttgtttcccaatctgtgcactaagtccccttggggtgctgtagcaaacccacagagagtcttcagggtatttcaaaatttcaaggtaaacacagtgacgtctatcagacacagcatgaaccactagctccagatatttcagtttttttttttttgagatggagacttgctgtgtcacccaggctgtagcgcagtggcgggatcttggctcactgcagcctccacctcctgagttcaagcgattctcctgcctcagcctcctgagtagctgggattacaggcatgtgccaccacgcctgggtaattattgcatttttagtagagacggtgtttcaccatgttggtcaggctgttcttgaactcctgacctcgtgatccgcctgcctcagccttccaaagtgctgggattacaggcgtgagccactgcgcctggcctggtatttcagttttaacattagattactacattccttttggtggcattatactgtgcgaaactgaatctttgacggtttctgtgataaaaagcaaatcagtgtgaaacaaatgagggtgatggttaccagtctgattccaagatttgagaattttgcagtgcctaacaggtagaaaatcattaggaaataaacacttttggctgaaacgaattatttaataaatggaatttctttcatcctaggggcaccatgataaaatttctaacataggaaaggaggcatgtgctatatgctgtatgactcttttttctttctagtttgtaaccattttggaagatcatacccatccttcaaagaccaattgatactgctacctgtctttggaggcctttcctgatcccctccactgcagttgatctctctcatgggtattttccagtaatatgctgcttttttactattgctgtttaagttaaactaattgaagtatttatttgaagttaccaatagtggccgtggttttcctattcctccagttaggtataattacttaaagtataacaagagccctttccttctttgtataaaggtgatacaaatataataatagaaaccctatactgtactaaactgcgtaggttgttagtcaatttctttttatttcttttttttcttttttctttttttttgagaggagttccactcttattgcccaggctggaatgcaatggcgcaatctcggcccactgcaacctccacctcctgggttcaagcgattctccttacctcagcctcctgagtagctgggattacaggcatgcgccactatgcctggttaattttttgtatttttagagatggagtttttccatgttggtttggctggtcttgaactcccaacctcaggtgatctgcctgcctcggcttcccaaagtgtcgggattacaggcgtgagccactgcacacggccttgtttgtcaatttctaattcttacaacatccttaaaagatcataggttatgttatccacattttatatttgaagaaattgacgtttagcagtgttagtttttctcacacccacatacctcctgacctttagctattctagttccttttcctttaatattgattatagaatcaactttttgatatcctcaaaaatccattgagagtttggttgggattgcattgaacttatgaatcaatttggggagaattaatgtcttaagaatattgagttttcaaatccatgtacataatatagctcttcgtttatataagttgtttttttttcctcagcagtcttttgtagtgttctacatatatgtcttgcacatatttggttaaatgtgttcctacatgtttcaattttggtggtattgtaaatattgttttcttaattttaattttcaactcttctttgaaaatttatagaaatacattagatttttatatattgatcttaaagtctgagaccttgattgacttacttttaattctagagcatttatgtggattccttatgattttacatatattccttaaacatgcacaggttggtatctagccatagcctcaagggttactctgtagatttcaactcattcttctctgaaaatctttttcacaatttctagtctcctggctctccttgaacacatctctttctcctcattttagtgaaaatgccaggctctatttgccttctttctccctctccatggtgtggaacttgcctcctggcagagtacctgcatgatgtcagggcacaccttgtttctttcctatcagagatcacagtcctaccatgcctgttattcaatgtctgaaaattctgtaggtgtttccttttggttttctggtttacagcacaacagtaattctagagcctgctactcactcatggccagagcagaagttaaagtttttaaggtatactgtacatatgtgaaccaagggaaggtaggcagtttattttagctaaaagaaggagcataatcaaaggttataaacaaggttgaatctccatcctggagaatcaaaatctagtagttgtgactttgtattaggaacatcatcatttttatctttttattccctggcagacatgcattaaatgtttgttgattgagtatcaaaatgataggaaatagattagttggatgttggtgaaacattgtgttttagatgcttacagatgtactaaaattttaacagaaatctttgcaaattacttgttaaattttcctaaactgatttttaaaaatctatttcattctcaattataacatctttactgagattattaagtgctttgaagcagttaacgtggcttttttttttaatggctgtaaaaaaactgaatttttaggcttgttaaactctggttttagaatgacttttgagtggaaatcactgatcaaaagcaaagttctcacattttgtcaatatctgaatgtcagaaatagaatgtcaggcagtttcccatgttgaaatattcgatagtaaaaggatagcaaagttgctgaatatttctactgtttatcaatttttgccttgcaggttcaaataatatttatttgtagtggaaatatttcaattcatttaaatcctgattatggagtagttagtaaatcaggtttaagcctgacagtgagttgatatagctcttatttcagactgtagtttgaacatgtagactctctgattataactaggctaaattatataataatgactttattttcactgaacaaagtttgctattattttgatgacaaattatttaagtaatcatagtaaaagttgctattggctctgggttttatttattttgctatatatagtagacatggttgatcatttaatcatgccttatagataaataaaagtaagttatagaataacacagaaattttctgctaaatttatactttcactaaatttaataacaatagaaattctctgttaaatttatactttcactaattgtagaataaagtattttaagttaggcatttatactgagacattttatgatattaactgcttcatgttatttactcattttgataaatggagtgataatatccaaaatggaataaattaagtttaaattattgttattctttaaaggaatgatttagctacagtatgtttgtcccaccttttaattttgaacattttctaacttacagaatagtaaaatgaacttttctatacctttcacattgatccaccaattgttaacatttcaacacatttgtgttctctctttaaataaatgtatgtgtgtgtattttcctcagaaccattctgaagtatttattccttattcaagaaattaagcattgatactgttttctgatgtgtgatcaagattccagatgtcacagttattctggtagtgtccttgatagctgtttaattttattctcagtccaggatccaataagaatcacacattacatgtattagtactatttctttaatatactttcctcccacctttttggttaaggcattttcttcaagagtccaacccagttgattgtaatatgtgccaccttgtggacttaatctcatgattttaggcaataatagtacgtaagtgacactgtgtatttcccattgcatcacatcgtaaggtttatggctttattgataatgctaattgataatggttaagatagcatccctcagattttttgcttagaaccttcttccctttccccattccatgtttgtgttttccttatcctgttcagcaaacctagttcccaacagcatcaactttatattcatttgctctatcctacaatacgcacaaaatagtttcaccaataacataaccaacaataaacctactaaataaagtttgatttatttgttgtttttgttccttataattattccattaagactgtattgtcataagagcatactgaaaaattatttgcattattttttctatgtgcttatgttacaatttgataccttctttgatttttcattcttgttatactcaacttcataatttgtttttcttctaatggaatttgaaattaaaattaaattttattatttgaaaatgcaaaattttaacatgtttcagaagtcaaatttgtatggaatgctatattcagagaactcttctattcctattcctctactcctttcccactcactctcatagaaaagcatttttcatttctagtttattctttctgtgtttctttttataaaattagcaaacacaaaattatatatacattctaatatatgtatatagtatagtatctatactaaaagaatatatatggttgagtgaggtggcttgcacctatagtcccaactactcagaagactgagctgggaggatctgttgaattcaggagttcgaggcaagaatatacacacacacacacacacacacacacacacacacacacacacacattctcttttatgtaataaaaaccataacattaactctaccatcttaaccatttttaaatgtaccaattagtatacgcatgttgttacatagtcaacctctagaaatttttcatcttgcaacactgaaactctgtacccattaaactcttaattctctgacttccctccctgacgtccttggcaaccaacattctacttatgtttctatgattttgactacttcagatacttcctatgaatggaatcatacaatatgtgtcttttttgtgacagaccttatataacttagcaagttcttgatgttcatctatgttgtagcatgtgacaggatttccttcttttgtttctttatcctttaattgttgatagatgtctgggttgcttgtacttcttggctatcatgaatattgctgcagtgaacatggacatgcaaatatatctttgagatcctgctttgaattcttttgactgtatacccagaagtgaggttgcttgattatatgttaatttaatttttaatatttctttcaggaacttccataccattttagtagtggctgtaccatgttacatttccaccaacactgcacaagggttcattcacttctccacattttgccagcattttttgttttctgtgttttcggtagtaaccatcctgatcagtgtgaagtgatatctcattgtggttttgatttccctgatgattactgatgttgaacatcttttcttgtgcttattggccatttatatatcatttttggagaaatgtctattcaagtcctttgcccattttaagatcatgttatttgtatttttattgttcatttagaagtttgttatatattctggatattaacctttcattggatatatggtttggaaataagttgccttttcactctgttgattgcctcctttgccatgcagaagttaagcttgatataatcacatttatctatttttgcttttgttgcctgtgcttttgttccatatttatgaaatcattgctaaatccaatgtcctgaagctgtcccccatatttgaaaataatatatattattaagttttattttttaaacaaagctttttacctttgagacttgatttttttttgaagttaacaaaatatcctggaaattactttgtatagaaggagtgttccacagagcttttcctttttttgtgttgttttgctgggatttttgaatggctgtgtggtattccattgtgtggatatatcataatttaatcgactgatcttctacaggtggacttctagtttatttccaacattttgccattacaaataacatctcaatacttatatatgtgttgttttatattgtggatgagtctgtagaagtgggattgctggtcattaagctgttactatgtctcattcttacagttctgtctttgttactttttcctctcctcatccttttacctctcaaatatgcatgtatttcttttctattccaaatatttgagaacagattttatcaaaatctattttgatatcttttgactttgtatgtagattatttgtaggttattttgctacctgtaagtctttgaaactaaacaggtgttacctatagaatcactatagaatattagaaccctcagggatttgagctaattataaaaggtaaaaagttcaaatctgtgaaacatatgcatcttacaagaaatccattaaagcttataataattacttcaatgaaaaaatgagatatttgtaactagaactgtaacactatttctgaatttttaaaagaatttttttagatatgagcatgttttagcttaatttatatatgaattactacaataagtatgacaatcatagtaacagccacagctaatatatgttgttgactatgtgctgggtaccatgctcagcaatgcaagtacattaatttacatcatttcaattagtcctcaacgaccttatgagatgtatttgtaattatatctccactttaaacatgagtgaaatgagaaatgttaagagatatgctctaacatgctctaactcatgcagctagtaagtggcagaagcaagatttgaacccagagagtcttcaatcaagatggattctgctctttttatgacaatgctagacttcttatattgggacccactattattttcctatatcaggccagcatttgtcttaaggtctgtatgattttagctgctgagtccttaacaactttatgtactttatttctctccccaaagcagtataagatattacatggttgttatattaagtttttttaatcgtaagtgatagcacagaattgaaatcccattcataacagctacagtttctcacaaagcattcttgtcacatcactatctgtggcagaatattaaactatgtgtaccatttttttgccccattaaattatttatgttcctgttttacagtggatgattcaacagccacacaaagcagcaacattttttggatgcattgggatagataaatttggggagatcctgaagagaaaagctgctgaagcccatgtggatgctcattactacgagcagaatgagcagccaacaggaacttgtgctgcatgcatcactggtgacaacaggtcagtgtaattccaagggaaccactatactaattggctattttaacactggtaaaatatgaattccaatgtgaatttggaattttgactttataattccttttaatgtttgataaatgcttattccttatatcagttttcctgtattgtttttaaatttacttttgttaaacatgcagttgaattcatgaggcataatggaataaaagtttgaggttatttagtccagtctctactttttataattagaatcagaaaaggctgatagcttgctcaatgccttgtagcttgctcaacaccttgtagctaatttgttgcaaaacttgaattagaaacaatgttcttttcaccatatcctgaggttggaatacgagagagagagacagagagacagagagagagtgtgtgtgtgtattttatgtatataaaatacaacattacattcaggctcgtaagacttagtcatctaaatggtcatctaaaccatttctggcaaatagtaattcattcatattgaataaactcagtcgtgggtagtataccactaacaaaacaaccaagtatatttctatacacccttacttattagaaaagtattcttaatatgaacttgaaatatctctctcaggcccctccatatattggttggttgttcttttgtacccacatggagatactccttcagtgtattcatgcactgctaacgttattaccatatcagcacaggcttttttcccctttgcaagggaaaaacaaaataactgccctagctattatattgttgggataatcaaagatgacctctttttaaatagtgattcactagaaattttgcattacttatagttggaaatatgtagtctgtcctcctccattccctatctcctttcttttcccatcttctcttcctttctttttttcccttttcatcctcctttattttcttccccctctccaccacgaccttgctccatttcttctatttacccactttattgctcactacttgaccttcagcagaggtatattaaggaatggactattctagagactggggatcaataagcacagtatttactaaataaccaaaatacaatattcaaaaattattagggtatgaaaggcattttcagatctttcctttaattttgttttttatatacaggagaactttatggttttaagattacagtaaacattgaaatatgggattcagggattttaaaaaaaaacaactaaaaatgttgaaatatgtttgtttagacctttgcccttagttttcccaagaccagccttaatctgtaggtgcaaagttttcccattagtgagaagtaggtcagattttcttctgatatcacttaggctacagtaaaattactaaattgttttagtatgctaaattgctgtcctaaagaacagttatggttgggtgcagtggctcacgcctgtaatcccagcactttgggaggccgagtcaggtggatcacctgaggtcaggagttcgagaccagcctggccaacatggtgaaactccgtctctactaaaaatgtaaaaattagccaggtgtgcacctgtaatcccagctactcgggagacgaaagtaggagaattgcttgaacctaggaggtggaggttgcagtgagccgagattgtgctattgcgctccagcctgggcaacagagcaagattctgtctcaaaaccaaagagagagagagaacagttatgataatattagatcttctggatgtcaaaaacttaacttttatactaattttatggttatagtgatattgttgagatgatatgggactcaaaaattggggagaaatcttcagtatctaaatcattatctaaattctggaagctaatacagttggatcaattgttttggataggtccagtaacctttgctgccactatcaaaaactcagaaattggccgggtgtggtggtcacaccttgtaatcctaacactttaggagaccgaagtaggctgatcactcgagctcaggagtttaaggccagcctggccaacatggcgaaactccatctctacaaaaaatacaaaaattagctggggatggtggcatgtacctgtggtccccgctgcttgggaggctgaggtggaaggattgcttgagcccaggaggttgaggctgcagtggactggggtcgtgctgcccactgcacttcagtctgggcaaaagagtgagcccctgtctaaaaaacaaaaaacaaaacaaaaaatttcagaaattgaagtgtttgggtaatgcagtatctttcttgatccaggttcttcctcttcaaagtcagaatcaaatacgttgggataataagaatactcatatttttctggtcgggcatggcagctcatgcctgtaatcccagcactttgggaggccgaggcgggtggatcatttgaggccaggagtttgagaccagcctggccaacatggtgaaactccacctctactaaaaatacaaaaaaattagccgagcatcatggcgggcacttgtaatcccagctacttgggagactgaggcaaggaaattgcttgaacccggaggcggaggttgcagtgagccaagacggagccattgctcttctctagcctgggcaacaagaacgaaacttcatctggaaaaaaaaaaaaaagaatacttttatttttcttttggagaaactgtagtttcccatcaaaaagtagttttattatcagaatagagtttagtatctggtaccagaaatgtttgcttttatttggtagccattttgtcaaaattttcctaaagtcataattactaaaatatttttataaattaggtctaaattttcttaagtttgtaatatagttattttgtatatgaatatgttgatgcatattactctttctttccttcatttacttgaacataaacagatgtatcctttagtagtaaattggcagatggatgagtggaaatacgttttggaagagaattgaggtttttttttttaacagtgtaatcgaacatattaccaaagtctgaaatgataagattttttttgtaagctataactgttacaatttaattagaaaaagagaaaaattggcaagtaattttttaaattctggagcagtatgaggaaggaaagtatttttatttataatgtaaataattattgtatttatttttaattaaacaagccaagtgacacttgtagcaggattttatttatttatttatttattttttagagatgtggttttgccttgttgcctaggctggagtgcagtggcatgatcatagctcattgcagcctcaaactcctgggctcaagcaatcctcccacctcagcttcctgagtccctaggactataagtgtgcaccactacccccagctaatttttaaaattattttgtagagatgggatctggctgtgttgcccaggctgacctcaaactcctggcatcaagcaatcctcccaccttggcctctgaaagagctgggatttcagctttgagctactgcacccaacctgcagcaagattttaaatgcagtatcctgcttagatattccatttctaaaattggaccagtcaggggacttttcaactatagaaaacaattctaattgatttcagcccttagaatgtaatggtttacaaattaattcctcttagcgaatatggtctacatttataagtgtcttttacgaaattaattccatatttggcttttaaaggcttcgattaaatagacaattatagtatgttgatatttatttttataaagatatttttctacttaaaaaatgtttttagttgcatagatttctttttatataatgagttagccttatttcttaactgcattttgaactattaaggtgtaaaaagtaggtcctattttactatcaaaaggcaacttaaatgccaatttctttctcaaaataccaggtgttgtttagaacaaaaattatcatagatgcctcagaaagttctcaaaacaaaattattatttatatttatttaaaaatcaataacattagttttgaagaattaattaaaatgtaaattttaaactttgcaaaaaatattggtaattatctattgaaacatatgctaagtttgactataatattacttgcttattctttggttgttttaggtccctcatagctaatcttgctgctgccaattgttataaaaaggaaaaacatcttgatctggagaaaaactggatgttggtagaaaaagcaagagtttgttatatagcagtaagtacttacctaattcaaatctctagtacatatttacatgatggattatagttgttgtctgatatatattttaaaataattatcttttatttaccctgcaaattatttatctctctcaaagcatatgttagattcactattgtgaaaatagaacagaaatcattatctttctatgggtaacataatttgtattatttatcttcaggtctacctatttttggatacattatgcataggtgcttgccaaccaagcgcagaattctatattaaatcagtttccaaatatattttaaaataattctacaaacttacatcttacatttgtaggcaacttgcattgtgcagaaaaatattagtagtataaatattcactgcaaatagtttgagctgaattgcttaaaaaacttaattgctatttattccatagtaattaccatgacacctcttaatttaatatttcagaaacattgatcgtgacaaatctcttaaatctgggaacaagggcagggtgtaatttgaattattaagtcttctgacacaaaaataattggttaagaatttatttctaaaataggatggtactaaaaattctgaattaatcaccccatgattaccttgtttttatttaatatgtgttaaatgtggctttacacaaataagtagatacctatgaaaaaagcatctcgtatgcatgtaatatatggttttggtataacagctgctgccatttcattacctgagctctgtgaaatagctggtaagatgtgtaaaaaattgattaccctactaggaggaacatgtttattgaaaatataattatttctttcagtctaatgttaatgtctcctacagcatgtttgtgtgcactgttctaggctttacaacattgttattgattcctctgtataccaaatcctatccctttataactgtcaaataaatgcttacattgagaagattatataatggaaagttatgctatcttttctgccagtatgtgagaaaaacatttcaagaattaaatattttacccctttattatttccatttcattttatttctcaaattggtctcatgttctttccatttttcaaatcttgatactgtatttcttgtagtgtgattctttagaggggatttatgtactatttcaaaccatcttacacttgaaagtctgattttcaaaaagcaccatgtttagaatttggcataatttatatatacttgttgactatgaaataagacagtgtattctgatgaaaaagtatatttaacttgacaattacagtcttctatgtttcaatatatagttgttcaatcctgaattgtgagccaacttgcaaacaactcatagttgtaatgattatacagtataacatgtctagccaactttgggtgaatggaacttttatgaaagtgtagattcaacttgcagacaactcatagttttagcatttatgcactatattgtatctagccatatttgggtgaatggagttttacagtagtattaaatatttatacttacgtgcaattttgtacagcataaagtgatcagcttttggtgaaattaataaggcaaatgatattatttttgagatttgggtggtgtattcagccagaagaaataacaaaatggatttcagttgttatctgtgatacaagtgttagcttgtagcttctgtttcagcagtttcataaaaagaatgatctcttacattgccaggtaaatctgtactcttctcctagcttggcttattccaaaatagttctgaaaatagtagactcatattggatacctgggacgctgtatattcttagtgaacattcaacaaatatttacttggtgaataactaagagcataattcgtatttattgaaatctgtaaacttccttttgaaatacaatgttatttccacaaagacactgcaggttttgcaaatctgtaattccctttgatttcagagcattccgaaatgatgtgtagtctagtctagttttttcttagcatatggtcaaaccataaattaagtgggctgccccatactttctggttctatgaggtcaacagtctcattacattatcatcataaactaatgaggtttaagaaattaaagttctgggggctctttaattctaaaatgtttttgatctaaggaagcaacgcagtttatctattcaacaaatatccgtaactaaaacatctgtctgcatcacataagctaaaccagatctacatactcagctctgcttcttcacactattctccaaactagcagtgtttcatgaatattaagaaaattccaaaccttcttcttcattttcttcaccatataatttactgagtaagttcacactggaaaccttcctgactgaaaagctaaaattgaatatggatacaccagcatcctcttttggtttaaatacagtgccaagatcttttaaaatttattttttacctttcataataaatgtctcattttatgccacgtaaactcagtttttccatgtttaaaccagcttctcagattctttgttagcaggtaattagggactactggctatggtgactaggtaattatgtttttgaaaacataagtctcaggttctcttcaccttagaatcagattgggatatatctgttttttctcacttaagaaataatatttcctggcatagtggtttatgcctgtagtcccagtgctttgggaggccaaagccagtggattgcttttggtcaggagatcgagtccagcttgggcaacaagtaggtctctaaggacttgctttatgaatctgggtgctcctgtattgggtgctttatgaatctgggtgctcctgtattgggtgcatatatatttaggatagttagctcttcttgttgcattgatccctttaccattatgtaatggccttctttatctcttttgatctttgttggtttaaagtctgttttatcagagactaggattgcaacccctgctttttttttttgttttccatttgcttggtagatcttcctccatccctttattttgagcctatgtgtgtctctgcatgtgagatgggtctcctgaatacagtacactgatggatcttgactctatccaatttgccagtctgtgtcttttaattggggcgtttagcccatttacatttaaggttaatattgttatgtgtgaagttgatcctgtcattatgatgttagctggttattttgctcgttagttgatgcagtttcttcctagccttgatggtctttacaatgtagcatgtttttgcagtggctggtacccgttgttctttccatgtttagtgcttccttcaggagctcttgtaaggcaggcctggtggtgacaaaatctctcagcatttgcttgtctgtaaaggattttatttctccttcacttatgaagcttagtttggctcgatatgaatttctgggttgaaaattctattctttaagaatgttgaatattggcccccactctcttttggcttgtagagtgtctgcagagagatctgctgttattctgatgggcttccctttgtgagtaacccaacctttctctctggctgcccttaacattttttccttcatttcaactttggtgaatctgacaattatgtgtcttggtgttgctcttctcgaggagtatctttgtggtgttctctgtatttcccaaatttgaatgttggcctgccttgctaggttggggacattctcctgaataatatcctgcagagtgttttccaacttggttccattctccctgtcactttcagatataccaatcagatgtagatttggtcttttcacatagtcccatatttcttggaggctttgtgcgtttctttttactctttttttttctctaaactactcttcttgcttcatttcattcatttgatcttcaatcactgataccctttcttccacttgatcgaatcagctactgaagcttgtgcatgtgtcacgtagttctcgtgccatggttttcagctccatcaggtcatttaaggtcttatccatgctgtttattctagttagcctgtcgtctaatcttttttgaaggtttttagcttcttttagatgggttcgaacatcctcctttagctcggagaagtttgttattacctatcttttgaagccttcttctctcaactcgtcaaagtcattctccatccagctgtgttctattgctggcgaggagctgtgttcctttggaggagaagagacgctctgatttttagaattgtcagcttttctcctctggtttctccccatctttgtggttttatctactttggtctttgatgatggtgacctacagatagggttttggtgtggatgtcctttctgtttgttacttttccttctaatagtcaggatcctcagctgcaggtctgttggagtttgctggaggtccactccagaccctgtttgcctggctatcaccagcagaggctgccaaatattgcagaacagcaaatgttgctgcctgatccgtcctctggaagctttgtctcagaggggcgcccagttgtatgaggtgtctgttggcccctactgggaggtatctcccagttaggttactcagggatcagggacccacttgaggaggcagtctgtccattctcagatctcaaactttgtgctgggagaaccactactctctccaaagctgtcagacagggacatttaaatctatagaagtttctattgccttttattcagctatgccctgcccccagagatggagtctacagaggcaggcaggcctccttgagctgctgtgggctctacctagttcgagcttcctggccgctttgtttacctactcaagcctcagcaatggcgggcacccctcccccagcctcactgcttccctgcagttgatctgatagcggactgctgtgctagcagtgagcaaggttccatgggcatgggaccctccgagccatgcgtgggatataatctcctggtgtgccgtttgctaaggccattggaaaagcgcagtattagggtgagagtgtcctgattttccaggtaccgtctgtcatggcttcccttggctaggaaatggaattccccaaccccttgcgcttcccaggtgaagcgatgccccgccctgctttggctcacactctgtgggctgcatccactgtccgacaagccccagtgagatgaacctggtacctcagttggaaatgcagaaatcacccgtcttctgcatcactcacgctgggagctgtagaatggagctgttcctattcctttttttgttttgttttgttttgttttgagatggagtcttgctgtgtcatccaggctggagtgcagtggcacaatctctgcccactgcaacctccgcctcctgggttcacaccattctccttgccttagcctcccaagtagctgggactgcacgtgcctgccaccatgcccggctaattttttgtatttttagtagagacggggtttcaccatgttagccaggatggtctcgatctcctgacctcatgatccacacgctttggcctcccaaagttctgggattacaggcatgagccaccacacccagcctaattgttttttttttttttaatcagctttgttaatatatgtctcacaacttacaatacatacattttacttctacatatatattataaacatcgtaaccttgctgctatttttgtttaaattgtcaaatatatattttaaaagacttaataagaaaaaattcatatttttactcaggtatttatcatttctagttctctttattccttttggttagaattagatttccatctggtatcattttccttctgcctagagggcattctttaacatctcttgtatttggatctgtcagtaataaattctttcagcttttgtatgtttgaaaacatctttatttcaccttcatttttgaaagacatttgtgccagatatatagttctagtttgacagtttttcagtacatgaaaaatgttaccccattgccatcttacttgcatagttcttgataagaaatctgacattcttttgttcttcaatgtttcacaacccccattccccaaattttgctgcttttaagatttttcatatgagaccaggtgcggtggctcacacctgtaatcccagtgctttgggaggtcaagatgggaggatggcttttgaggcatggagatcaagattagcctaggcaacatagtgagaccccatccttacaaaaaatacacacagagaaaattactcattttgatcagtttagttatgatgggccttagtgtattcttcttcatgtttcttgtgcttgggttttgtttaacttcttagagctatcggtttttagtttttattatgtttggaatatttgcagccattatacatcttcaaattggttttctgacccttttatgccacttgaagttgtctcatagctcactgacactctttttttattttgtttctttctctatgttttattttggatacctcctttgctgtgccttccatttcactaatattttcttctgtaatacctgaactgttattaatctcatcaaataaataaagctaaatatttcttactactgggggaagacttttcttagtactccatggcacagagcactaaggggtccctaatctctggtactgcaactatatcagttcctgttaggaaccaggccacacagcaggaggtgagtagcaggccaccaagcattaccacctgagctccacctcctgtcacatcagcggaggattctttttttttttttttcaaatgtgaaaaatctaattttattcagtttagattaatgtatagctatacactctggactcttaatgaaacctttcccattctttttttttagattttattattatactttaagttttagggtacacgtgcacaacatgcaggtttgttacatatgtatacatgtgccatgttggtgtgctgcacccagcagaggattcttataggggtgcaaatcctattttgaactgcacaagcgagggatctaggttgtatacgtcttatgagaatctaactaatgcctgatgatctgaggtgcaacagtttcatcctgaaaccacgcctcctacccgtccgtggaaaaattgtcttccacaaaactagtccctggtgccaaaaacgttggagactttgatgaaaaaaatgatgagtttttctgctctaggtctttgaaacagccactatttccaaatgtgtatgtgcctcaggtactgttccttctatttttttttcctcttaatacttttggatgtttctttcccaggtactgaccttaagaaaagaccctctacagaattccaggtttctctgtaaatctttctgttctctgatattgtggtctttcaactcttaactgctctgaaattcccagactctcagttgtatttcctcaactcactggcatctactacagttctccttataccatattctggaaactcttgcaataaactgctgtagtcatatggctgacctccattgtttcccatctctcagagatacgtattttttattcttgatgtccagtgtattaaaaaccattgtttctagttttgctattgttgtttcatgatagggagtaaatctagtttctgttcctctactgtcttctgctttgcattgtttttgaaaggaagcctgctgccattcctatcattgttccctcttacctaatatgtcttttaacctcctttatctgcttttaagatgtttatcactgattttaaacaattttattatgatgtaccttggcatagttttatattttgtgtggttggggttttttatagtttcattcactttggaaattatttaacaataagttttctctttccacctccatctacctttgggactccgattaaaataataataataataataataagaagaagaagaagaagaagaagaagaagaagaagaagaagccacttgtagttgacccatgtctcagtgattctgttttcaatatttttgtttttctatctgttcttcattttgaataattactctctcccctattttgtcttttcttttttatttttatttttattttttgagatggagtcttgctctgtcacccaggctggagtgcagtggtgcaatcttggctcactgcaacccccgcctcctgggttcaagtgattctcctgcctcagcctcctgagtagctgggactacaggcacgcctcaccacacccggctaatttttgtatttttagtagaggtgggttttcaccatattgtttcggctggtcctgaactcctgacctcatgatctgcttgcctcggcctcccaaagtgctgggattacaggcgtgggccactgtgcctggcctctttcttttttttttttttttcagacaagttctcgttccgtcgcccaagctggagtgcagtggcacaatattgggtcaatgcaacccccacctcagcctcccaagtaactggaactgcaggagtgcaccaccatgcctggctagtttttgtattttctctagagacaggttttgctgtgttgctcaggctggtctcaaactcctgaactcaacttatctgcctgtctcgacctcccaaattgctgggattgcaggcatgagccgccatgtccagcattgaataatttctattactctgaagtttactaattatttcatctacaatgtttaatctgccattaatctcatccagttgacattttatctctgacattatagttttcatctcttgaactttgatttggacctcttttactcatgccatatctctacatagtatgcttatgttgtcatgtgctttcggaatgttgttataacaattgttttaatattcatgtctactaattctgtcacttttttttaatctgattaccttggtattggtttttcctgattacctgggtattcattgtttcctcatacatgtgtactgaagactccaaaggaatcccttgcatatctcgagttctcactttccacctctttcttctccaagcagctctgtcctctccagtactctgccccagcatgtggtagccagcttggcctccctgaatggaaactacttgactctatttaggttcttccttcccgctctgcagcctgggaactctattcaaggtgtaagtttgagtaattgtagcgcttaccttattctgccccttctttgattattatccaatgcctgaaaattgtgttttcatgtattttgttcattgttagttgtttaagatgggaatataaatctgctccctggtccttcatagtggctggaagtgcaaatctctaggttgattttggtttttccctttttcaggtaactcgctttttttttcaagaatgcctaatttttttatttgaatttgagtctcagtctgttgcccaggctggagtgcagtgacacaatctcggctcactgcaacctccatctcctgggtttgaacgattctcctgcgtcagtctacccagtagctgggattataggcacctaccaccatgcctggctgagttttgtattttttttttttttttttagttgagatgaggtttcaccattttggctaggctggtcttgaactcctgacctcaagtgatccacccgccttggactcccaatgtgctggtattacaggcatgagccactgcccccagcctgaatttgaatttgataataactatgatttatctctatgcgaattctgtattgagttttcctcgaacaatgtattcattttaaactgtagatttcattcccagttaactttcttgtccccaaatattgtttctcctttacttgacctattggagtgtcagaaaatgatcataaccatcactgataaatgtgttatggggaatattagagtaaaagcagaaattccaagttgtggtgagaaagtacagtagaaccttgaacaatgtgagggttctgggcactgaccccttcgaaaatccacatacaatgtttacctcctcaaaaacttaactactaatagtagttaattggaagccttactgataacgtaaatagttgattaacacgtattttgtatatgtattatattctgtattcttacaataaattaagctaaagaaaaaatgctataatatcatatggaatgaaaatatattattattcattaagtggaaatggatcatcataaaggtctttatcttagtcatcttcatgttgagtgggctgaggaggggaagaagaggaggagtggttggccttcatgtctcagaggttggcagaggcagaagaaaatctatgtataggttgacctgcacagttcaaattcatattgttatagtatcagttgtaatcttaaattcatcttcaggttgatttagtgtcaaaattccctcaaatattattctagattctataaaatgttctagataccattttatcgcttaaaaataaatgtgaaagctctcagctaagatatagttgttcatctatgtgtaattactagttttgtaattttttgtaatttcttagtcacctctgcatagtgtttggattacattgtgagtacagtaggattttgtttagaaatctatgcgttatttcaaataacatctctttatgataggaaaaaaggttccaagtttgaaataacactgtgaagaactaatcaccatgcaagtttaggcttattatggggaaatttttaaactttaggtattaaaaagatttttaagaaatagattttaacaaactttcagtaccttgtgacttaccctgcgtaaacaaggtcagccaaatttgtaccctgtttcatggattagaaattaaacactataagtgaaagaataataagtcatatcttgtcaataattttgtgagagtatgagacttgtggtgagttttcctttagcactcatgcctattttcttttttaaattattttttcagttcctatgtcttattacaggtcttctcttttcctctcttcatttatttataactctgtcttgaccacttatatctgttttcggtctagaattttactactttggagaatgtggtttttgtgagggtagagttttcaaatgtcactaatgtttgcttctggaataagggaagtatgattataggtcagtagaagaaacatggtatgaagaaatgtacagccttggtggtaagcaatagaattcatacttacaaagaaacagaagtatatgtatattaaaggcaagtaagaatcactaccaaatgtttacattttacatctcctgctttgtttgccctataggtttttcatacctatgccatgagtaacaatttttcttagtaaaactttcatttatactcagttacaattaaatatctttatcagtaatctaaaagcaataaagcccttaaaatgaggtagtgtgataaattataagaaatctcatctaagaaatcatatgtttgaaattttacgtgtcagtaatgtggtttgtgtccattgaattaacaagttagaatgaatttataattaaataaataatttctatttttttaggatttggttatcttttggcagtatttaccaaaagacatggttacactaaaacgtgactagaaatttaaaaagattgctcaaaatttcatgctcagaatttagaacgtgccatctagtattctttgctctgtcatgaaaagatttgagaaagtttcagtgaaagtgaattaagttgttttgtaatggtaacctaatggaaattgaagtaatttttttttaaaaaaggtaagtattatttaggccaggcacagtggctcaagcctgaaattccagcccttcgggaggctgaagtgggtggatcacctaagatcaagagtttgagaccagcctggccaaaatttttggtagagaccagaccatctctactaaaaatacaaaaattagccaatcatggtggtgcattccttagtcccagctgctggggaggctgaggtaggagaatcgctcaaacccaggaggcagaggttgcggtgagccaagatcgcgccactacactccagcctggctgacagagtgagactctgtctgaaaacaaacaaacaaacaaacaaaaacttacttaaagtgatagctttaaaccttattcgaccatggaacaagcctttgtaacataatctatactgttacaataagtacactttggcagagtaagtgaactaatgatttttttttataatttaagctagtctgtgaatgacagttgattaaataatgtcacagctctttatatatagcattaaatagagttcaaagtatttttggaatttattaatttataatattcttctgtgattattaaagaggtgggatagctaaactttttctcaccttttatcattgttccaagtgcagttttgaactcgtatgtgttagaactcccattatattggtcaaatcgatgatcaccatatgactttattcctgcatttttgcctcaaatttttaactatcctattctggactgcttcattaacttcattagggattaactatgaatgtttaagcctttattttacaatgtccttgcaggtgtccttaactgtttcatttataaacacagagaataaaatgaaaaaaaaatctgtagagttgtttgttctatttggagcttttcatgttggtgtaaaattcctgacacttaacacatatgaatctttttcattcatgtttaataattttatttgagagtcacttcaagtaaagcccaaactgtgttaacatttgagttaagcaaagacatctttgcttaacaataaagcaaatatcacaataaagcaagtcacatgaatattttggtttctgaattcatataaaagttatgtttacactatatggtactctcaagtgtgtggtagcattacatctttaaaaataaacatactttaattaaaaatactttgttgctaaaaaatgctagtgatcatctgagcctttagcgagtaataatctttttgctgttggagggtcttgcaccagtgttgatggctgctgactgctcagagtggtggcttctgaaggttggggtagctgtgacgatttcttaaaataagacagcaatgaagtttgccacatcaattgactcttctttcataaaagatttctctgtagcatacaatgttgtttgatagcatttacctacagtagaacttctttgaaattggagtcagccctctctaactctgttgttgctttaacagttatgtttatgcagtattctgaatttttcgttgtcatttcaacagcattcatagcgtgttcaccaggagtagattccatgtcaagaaaccactctctgtgttcatctataagaagcaatttctcatccattcaagttttatcatgtgattgcagcaattcagtcctatcttcaggcttcacttctaatactagttctcttgctatttccatcacatgtgcattgacttcttccactgaagtcttgaagccctcaaagtcatccatgagggttggaatccacttattccaaactcctattaatgttaatattttgaccacctcacatgaatcgtgaatgttcttttttttttaaacagggttttactcctgtcactcaggcagggaagtgcagtaacaatcactgcacattgcagtctcaatctcccaggcaagctcaagcaatcctcccacctcatcatttattttatttttgtagagacgaggtctcaccatattggccaggctggtctcgaactgctgggcttaagtgatcctcccactgcggcctcccaaagcgctgggattgcaggtgtgagccaccatgcccagcccatgaatgttcttaatgacaactggaatgatgaattattttcaggaggttttcaatttactctgcccaaacccatcagatgagtcactatggcagctatagccttatgaaatatattacttaaataagatttgaaagtcaaaattactcattgatccatgggctgcagaatgaatgttgttttagcagccgtgaaaacaacattcatcttcttatacgtctccatcagagcccttgggttaccagatgcattgttaatgagcagtaatattttaaagggaatctttttttctgagcagtagatctcaacagtgggcttaaaatattcagtataccagctgggcacagtggcttatgcctgtaatcccagcactttaggaggccaaggcgggaggatcacctgaggtcaggaattcgagaccagcctggtcgacatggtgaaaccacatctctactaataatacaaaaatgagctgggcatggtggtgcacacctgtaatcccagctactcaggaggctgaagcaggagaattgcttgaaccctggaggcggaggttgcggtgagccaagattgcgccattgcactccagcctgggtgacaagagtgaaactgtccccaaaaaaaaaaaaattcagcataccatactcaaacaggtatgtgttcatccaggctttgttatttcatttatagaacacaggcagagcagatttaacataactcttaagggctctaggatttttagaatggtaaatgagcattgacttcaactgaaagtcaccagctgcattagcccctaaaaaaaaaagagtcgtcctatcctttgaagcttcgaagccaagcatttacttctttttagctgtaaaagtcttcaatagcatcttctgccagtagaagactcttttgtctatgttgaaaacctgttgttcagtgcagccaccttcatcaatgatgttggcaagatctgggtaactcttcagcacctgctattttaccttgcacttttatgatatggagattgcttctttctttcaacctcacaaattagcctctcttagcttcagacttttcttgcacagcatcctcacctctcagctttaacagaattgaaaagagttaaggttgtgctcgggattaagctttgacctaagagaatgctatgctggtttgatgttctatacagaccagtaaaactttctccatgtcagcaataagcttatttcactctcttattcatgcgttcactggagtagcacttttaattttcttcaagaactttttctttgcattgagaacttgcctgtttgttgtgagaggtcaaactttcagcctgtctcacctttcgatatgccttcctcactaaactcaatcatttctagcttttgacttaaagtgagagacatgcaactcctcctttcacttgaacacttagagaccactgtaggattattaattggcctaatgtcactattgttgtgtctcaagaaatagggaggccttaggagaggtagagagatggggtaatggccagctggtagagcagtgaaaacacagcatttatcagttaagttcaccatcttctatgggtgtggtttgtggcatcccaaaacaattacaataataatatcatagatcagtgatcactataaaagatataaaagtttgaaatattgaaagaattaccaaaatatgacagagatccaagcgagcacattctgttggaaaataatgacaccatactcaaggcaggcttgccataaaccttcgatttgtaaaaaaaaataataaaaaggtatctgtgaagtgcaataaaataaggtatgcttataccaaaacagacttaattatgctatttcttaccattagtgttagagttcagtttctaatgtttttcattttccatatgttattgatgttcagtgagttacacaaattatttactgttgttacttccaccttagtagggagaatctttgatttttgctggataaattttcaaacaagagtgtgattataggctggacgtggtggctcacgcctgtaatcccagcattttgggaggccgaggtgggcagatcacttgaggtcaggagttggagaccagcctggccaacatggtgaaaccccctctctactaaaaatacaaaaattagccgggcgtggtggcgcatgcctgtaatcccagcacttgagaagctgaggcaggagaatggcttgaacctgggaggcagaggttgcactcctgcctaggtgacagagtgagactccatctcaaaaaaaaagaaaagaaagaaaagtgtgattacagagatcctatttgtgtttatttttaatttctctagaatttgttttcttcaataaataaaattctaataccagttttttttgagtaacactgtgatttttatacagaaagactttctccaaattggagaatgtactcttttattcctgtaatttttcttaactcttatttttggcagctaccaaaagtaaaactctctaccaagacagagaagaaatctttgggaatattaagtaatgttatttttcattacacggactaacctttttactaagaagaattgggatagtattggttatgggagcttaggagccctaaagataaagattggaagattttgtgttgtggacttgtggcactgtaacaaagtctgggaattttatgtgagattggaaaccacactatgtgctaattgcctcagaatggtaagaaaataagcatatgtatagcatttagttgttaagacagtaggcacttatgcagagccccaaatgaattaacaaatcatctactgaaatattttcacttctgtttactttatgtattttagaccaatcagcagttgcttgagaaaatgaaatgtttactaaatctctttaataaacatgtttaagagaggaaaaacttataaacattcagatggcagtgtacatttttaagtgctagttgtcatatctttgaaattgtatgtaaactggacataaacaatcaagtgtctacagaatggtatctgtcttccaatatatttactgaagatattatagaatctttatagtttaatatgatttaccccacatgttctgttgttgctatcttttcagataaagttgaatttaatctttcttatcagcttttattgaggtatttatgaaccattgagttcacccacttaaaaaatatcattcagtggctgttagtgtatttacagagttctgctaccatcactgtaatctaatgttagaacattcacatcaccacagaaggaaatgttatacccatcagtagtaatgctccataccccctggatttaatcttatatccacatctctcataatagtttcagtggtatctagttattatgactacaaatgatgcaattgttcctgattacacaaataatgtatttatgtctttattgttggcatgtaatggaagacataataagtctgctttgatctcttgctcttacctatttctctattgcaagtgttataaagagtcttttaagcttttgctcatatatataaatatatatatacatacatttatatatacacacacatacatatatacacacacacacacacacacacacacacacacatatatgtaatgctaccgtgtttgagggtcatgagggtcagttttttgaaataccagtttttttctgatttaggtggatgacatggtacgtgaagcttaaaaaaaaatttggtaaattggtatgaaaaaatgagaggacaacgtttttcctttctggtacttagcaggaaggcaagttcttgtatgaacccatatttcctgttacccattttcagaccaatattggtttctcatctatataatagggatcttttgactctaacctcttaaatctatcatgtgttttctttcttcaccttggaaatagcttcttgaagccccagacttctagagcacattcatattaactaacattgtcctggtttactagttagggatattagtaaatcctaaatagttgaagacgttctgaaagatatattgctgctttttaaaaatttatttatcttgttctctatacggatttctggcacaaggttggtttttgtttttgtttttgtttctgttttttttttgtcaattgtggtaagtccatggatgcttttctctataactttcccattttcccttatcacaccgtcactgcaaacatctaatttctgtccagtctctcaactcttttcagctctgctgtcctaactaatcattttttgtattcatctttcaaagtatttgtttctgtcttcattctataagtaacaagattatttaaggttattttgtattacagaaatagtaaaaatcaaataaaatatcaaatgtagaatagtccaccaaaaatattttatttcatcttttccagagaggtacacatataataaagtaaatgagcattatatattttattattaatcctcaataatatatttttcacaggtatgttgcttcttgtaagtttaccttttttaatgtgaaaactacaataaactaaattaaattttaaaaatattttacttactaaagtcaactgatgttttcctggtagattgataggcttcttgtggtagcttttaatcatttgcaagttttgagcccatttctaaaacttttctcattgtaaatatgtatttcctttcttatattaactgagaatttgtttttataaaaataaagtggggaatcagactcaaggtgaaatgttgtagacttagtgccagcaataagcagaattatttaaaatcattcaaatatctttaattcccttgttgtctttttcaaaaactgtacattttaactacattaatataacggaagactttttaaggcttagttttcctttatagatattccctaatttcatttttatttcagtctgtcagggttgtgaatgtgatgttttaaggtacactgtagtgttttcacatcctcagatgaactgaattgggacaatactttgtaggaagttttttaatatagtatgtagacacattggtaaaaatcagtatgtccactggcttattagtttcacagatgcttccataattcttagtgtactcttgggtattttaaattatcatttcctgacagcaatcctgaaacatgccagtcttttaaagccttatttctgagaactaaagcaaggcatcagcgaaccatatctgacatgccatgttaatttccataactatcatttctgggaggtggtaggatttctaaggcatggagaatctcagtaaatctactttaaaaaaaaaaaaagcaaaatatctgttttattactgggtttccattcacgagccctgactgcttcattcccacttaaataatttcaaaaatagtgataagcatattttttctcttatagattattaaatatttactcacgtgcacaatatatcaaaacatattttgaattctatattcttagtgttgggtgttcatgttgtgaatgaaaacctcattctgttatctcatagcatatttatatatacaaataatttttgccttaagtaggaaagaaacagctaaaagatacataggttattttgctttttaaaattttagcaaactattctgtgaatcttttgtgtgtttggggctgtttgtagaggaaaatttcatcaagcaacattttgggaacattggccttttgtactctttcctaaataaacagaaacttgtactccccaaaataaaatgtttctttgtatattgttacctgcaagttattgataatggaaggaacaccttttcaatccttagtcccctttcccccaacacagcttttagattgtcgataaacttcccagctcagtaattaactgagctcagtcattgcaccctgtatcatgtgatttttttttccagtggaatacattattagagcacttacacagccagtctagctgcagcagcccaggcggcaacagcagtgccatttttcacaaagaaaatgttgaacaggagccaaatgtttggtggcagtctgttgctaggaaatcaaggtcctgaggcgattaatgacaaagcaagcaataacaagaaggcagaattacagatttaaaagagaaaaaagtggttggtgttataattacccaaagaaatccgcactcattaaattggctgtttttatgattgactttaattggaggttagctcagatatttagctcctttcccacccctttaaacacacacaggcacataatctgtagaactgcagacttgtttttctaagcattgagaggagcttgccctgtaatttgatccccactgacagatgcattttctatgctgccattttgaattaacctattgtagaacaattttcttcagccctgttgaataaaacatccagtctgattacctccgatggatttgatagagtaaaagaatgtacttctcattgaagtagattgtttgcatggactctactgattgtgaactctgccagtaagcacaatcatttgtaataaattttcaaagaaatttgtgaggaaaaggtaatgagagtcacccttttatagtttaatgtttggcacctccatcaaaataatataattcttataagacagtgttatttttccagtaagcttttcacgtggttttagaaaaaatttctgaatcttcatttggactattcatatatttaggaatagagtcttgtatttacactctaaaatgaccattcttcctccccaacaacagtattttagtgcaagactcaatatgcaaagcactctattgcaaaaatatttttggtatgtacaatatttaaagtgattttaagattggcctatttcagtctttgaagtatttcccccccccaaaaatcccttatttaaattttttagggtgtgataaagcatattactagaaaagcatcaatcggtctttcaggtacaataccagaggaaccatcacagtttatttacctttcagaagctttaaaaataaagttacatgatgcctctgctctccagatttctaatcaaaccctggaacaaaagagccaagcacattctatctgacaatgcacacactgctaatcagatgccaatgccaagctgtctgctttgttaaatacttagcttcctagaggcaggaagacagctgctataagtatgatgaaattttgtagttcaatctatttttgctacccttgggctaccaagatactgttaatttagaccaccccaattggtacattttagggagttttttaaagagtttgtaattaaaatgataaaacatcgttattacattgaagaccttctgtaagttttacatttggcagatacctactgagataaccccagcatgtaatttacaatgatgtaatggttgtaattgcattttagaaaaaaagaactataggaggcaagtgcttccattagaagagtttttaaatctgcttctgtttcatttaaatctacttctatccccaaattacttacttataattgactagagcagctataaaccttaagatgctatctgaatatttttaaaaagttatcaccccagacactgccaccagggggaggaagctaaaatcttaaagttcttaactgatgatgatactgccagtaggtagattatattgcttagccctacatagttaactacttcctccagataataccgccttttgggacatgattctcacaacctgtaatatgtgatacctgtagacttagcacactattaattgtaaataaaatggaaactttcgtactctggtggttggggtcaggaaggggaaagaggaagtacaaataagcaacctggacatttttattgtttttctcttatctgttagtctacttgaagagctatccttgaaagtgagtgctttagatctatgaaactgggcagctatcatagcacatctattaagatctaataatcacataattaatgtagcaaaatgaatagactgtaaggtagttttctattttttgttactacactgtggttttgtttttaataaatagttttggctttattttaaacaattaaaaattcaaaatatttttatgaccaaagcttgtaggttctatccctggaaaatattttataaatgcagaaaatagttgcttaggattggaatccaactctgtttaccatgaacaacttaaaagttgatctcataatcttgcatgttgtggaataataccacgaaaaagttaattaaagaatttagatgtttgttctcctgtctagaactcaataacttttaagtagtaactctccctacagtttaactgttaaacagtaactcttctgacagttttaggttttattctgtgaagactcatgatttttaatttttgcatcttaatttttcagttatttcaggtattgaaattacaaacgacgggaaagaaaagtggttgactaaaaaggggatacaaaaggcaatttttagggcgatgtactgttctgtatggtactgtggtggtggatacatgatactatgcatttgttaaagcccaaagaactgtacatcacaaagggttaattttaatgtatgcaggttttttaaatgttagggatttcaggatagaatgcaagctgtaacaaatgaatctaattgtattacaaatgtatggcataacttcactgaatgggtgggggaaaaggagctgacctaagtaactttggaaaatggtgttttgattggacaatgtaaagctaaagactaaggaacactatagaaacactctattctagttggtaaatttgtttctcataacggtatgggtgaacagttctgaacctctttacatgtatcctggggttgaacaaataagtaaatggatgatgaatggtggaagctaggtttctcactgtcaggaagggatgttacagataaataaacaagaggggagagccagaatgaaacctgtggtactggattagagttggagatataagtatttactcatgtttagcttaatatatgcagatggatagatgcagaaataattatagatgcatgtgtatatgtggattagtatacatgcatatgtttcctagctgtgtttactgagaaggcctagaagcagtgatatcccagtagccacaaacacatctaacgctcacatcctggtttgtaaatcctattctccaataaaaggatccaggactccttttaaatatgactgattctggggctggtgatgggaaaatacaacataagcatggaatatcttgtagtgccagaaggcaagagatttcttaaaaataataaagattaagcatgccaaaagggacacatgagccaatgtgaaagaactccgagtggccgtagctggaataattagagcaacaaaataaaacatgtagcattggattaaggataaattattgagtaaatatacatgagttcacagtgttatgtataaattgtataaataagtaaatggaggagaagagataaatctccctgacagaagaattccaaataacatattgccccctccagaagggggatcctacttcccttctccttgagagtatgagctggattgagtgagtcatatccaaaaattgagtttggaagacagcgaaatactgacttgactatttccattggagaaagctggtaaacaactatgttaactaagtgatcaaggttaacatcacaaatgggaagtcatgctgatgtgaagaggtggaaacttcatctctctgatattctttccctaaacctgtagcctcaatctaatcattaggaaaacatcagacaaatcccaactgatggacattctaccacataagttgagcattcctgaaaactgtcaaggttgtgaacaatgaagaaagactatgaacatctcactgacaagaagagactacagagtcatgacaactaaatgttacatagtttcctggatcaggtccagaatagaaataggatattagtgtaaaaactggtgaaatctaaataaagtcttgactttagtcaataatccaccaacattggtttcttggtttggccaaatgtaccacagtaatgtaagatgctaagatagtgacattagaacaaattggatgaggggtacataggaagtctgtatattaaacttgcaatttttctgtatatctaagttcccaaatataaaataaatttatttgaggttgatcaatgggctgactatattgacaagatactgataggttacatgttgaagaaaacatacaatataaaatagagaaaaagtcagttccatcccttcccactccccctttacctacctgctccccagtactcatcattgtgatttagtcagaacagggtttagtgccagaggtcagggtgactgagggtggaggagttgtgagcaatgggttcatggctgtcacaataatgctgtggcaattctatggtttcccagctgggagttaggagtggggagggggctgcagcctgatgacagccagctgaaggaagagctacctctcccttccctagctgctcatcacctgaacccaagaccacgccaaacaagatatggatgtagatgctcttgctgagtctgttccgcaagagggaaagaaagggtagctgctccaaacacgccgtcctcatatacaagggtgaggggaacagaagcatgtggctgctaccagcaaaggaaaagtaggagagcaatagaaaggggaggaaatgggaagagcagaaaatcaatattatttaaaaagtgacctaagacttaaaattgaattagtatttgtacagaaagatgcaggtggaataactcactctggcctgtgatcaaaattatatggagaaatcatggtgggccccttcctctgtccccagtggtggcaccagttgctgagtgtgattagttagaatggattccagtctagtcgttcaggcagaggaagtagttgcagtgggcaggcaagaggggctcagttgctgcagcactggctcttgctggctgggtggttcttctggaggtccgtacctcagttttggcctggagcaccaggtgcactctggggcttattaggaatcttcttagctctcgccgtgtaaacttcattcacgttcattgcagtctttactgatgtctccatagtcaactgtcgtcgtctgcatagtcctgtgcttcgtggaattctggggctttcttgctggccaggtctgccttgttacccacaagtacagtgacaatgttggggctggcctgcctctctagctccttcacccatttcttggctggtgcaaatgtatcttttttggtgatttcatagtacatgggggctgggctatgataccgctcctgtccagcgctgccccagatctcaaacttgactattgtgtcgtctaagcagacagtctgtgtaaggaaggctgctctgattatgctctcctggtactcttgaaattgtcccttgacaaagtggaggacaaggctggatttggccaccatagactcattgttcccagtggctggtccaccaggtcgtgtgctgtgccttgccgacccgccactacccgtccagctgttgtgataccagagagcatggggacgggagccattgctatgcaaagaggcacttagttgggaagggggtctccaaaatgacgcaagggcagtagtattacttggggctggggctcacacaggctccgcttctctccccccacccctggtggtatctccatataaaaattttacttaaacgcagagaccatatatgtacttaaacacttgtctaaagaaataaaatatggccgggcatggtggctcatgcctgtaatcccagcacagaggccgaggcaggaggatcacctgaggtcaggagttcatgaccagcctgaccaacatggagaaaccctgcctctactaaaaatacaaaattagccgggcatggcagcacatgcctgtaatcccagctactcaggaggctgaggcaggagaattgcttgaacctgggaggtggaggttgcggtgagccaagatccccgccactgcactccagcctgggcaacaagagcaaaactccgtctcaaaaaaaaaaaaaaaaaaaaaaaaaaaaaaaaattcccctgcctctctccaccccagagggtaaccattatcctaaattttattattattattcacatgcttttctttataggatagccatacatgtatcactaactgttctaccatatctcataacctcttatatagtttcccttttttgtcatatttgctgtgttctggataatttcttcagatctatcttccgatattggtaattgtatcttcagcagtgtctcatattctgttttacctgacattgaattttatgtaataatcattacttccattttcatttcttcccctgaaatcagtttactttatcattttgataaactcatttcattctcatatatacaatcctcttgtttatttaaatatattaaacttattttctattttgtgcctagcctaatatttaaagcttatgcagttctgattttgctgtctgttgtttctgctggctgttactcaaactgccttattttcctgtgtgttagcttgtattcattatttgtggtgatttctgagactgagatgaagatacgtttccaaagagagtatttacatttgaatctgccaaaagcctggggatactgtcaacctgggaacacattcaaataaatgttgggcttaaagttttgtgggctgcataggtaacatgagttccagatccataaaccttcatgagggtgggcttgtggttaaattttcagggaagatgtatttacctgcacccagcatcaagtttgaaagaggttaatttccttgtttattccttctgtagggtagacatcattctattcaactcttacactaaacatgtatgtagctctttaggatcccaactttatgtggagagtctaattagacttcgtatcgttaatgtaccctagaatttatcccctaaaccttgggttcagtagtgtcctggtaaatattttaaagctggctgtccagggcaaaaaaaaaaaaatcctaatttctcacatttttctatttcacactatggctgatttcacgataccagcctgaagtcattgaacgtggagttgggaaaagatatgtacagttagctttctcaactccagtgtatcactgccagttctgtacatggctgtgaaaactgaagctcaatgcacagggcttggcatatccctcagaatgaaagaatctgagtgtttgcctacccctctggatttccatttttactttgttttaaccttttgagtattctgtgtcaactcagcaatatacttcaaaaaaagattcttttgttttctttttattttaacccagcatttgttgttgtttttagcaaaagtcctgtgttagggtacctatttagtcagaaatagaagtctctgtgcttgtttgtaagtataatgtattatttttctttttggggaaatatagaaagaaatagaagtctctgttcttgtttgtaaatttaatgtatttttcttttttgagaaatagagaaaagtacagagaatattaaaacacccataatcctatcatatatgttcattttatgtgcatgtatgtctctatacatttttatataatttgcattatatctactatttcagtatatgatttttgttaatatataatgaatgtttgctcatgccgttaactattcctttaaaacagcccccattatatatgagactaaacataaaatgctgcacacataggagttagtataattcagaaatttagtctgtattgcatttggaaataattttgtgaaggttattcatgcagcattattaataattgcaaaatattggaaaccatataaatgaccagttctagaagattggttgaatatactctggaacatacaatagactactatgtttataaaagctatctgtttttataaatatatggagtaatttccaggaaatattacatgaaacaaaaagcagaaacaaatacccatagtgctacttgtcatacaagaaaaagggagaattaaagaatgtgtatgttcaggaaggataaagcagaaaacagtaaaattagttacaagaggtagaagggagagtgaggtggaagggatgtgggagggagtgagacttggatattggggtatactttcttggcatagtttcaacttttgaaagcatgttaatgtccaacatattcaaacagttaaataaaaatgatatcactgggacagggacctaaaattgtaaacaaacaagtgaacttaattcatttttttttcttatttttttattattatactttaagttctgggatacatgtgcagaatgtacaggtttgttacataggtatacatgtgccatggtggtttgctgcacccatcaactatcacctacattaggtatttcacctaatgctatccctcccctaaccccccaagcctcaacaggcccctgtgtgttatgttcccttccgtgtgtccatgtgttctcattgataaagttaattttaaagtaaaatgaatactatatccataccgaaaggggataaagaagaaagaaatgaaggaagaagggaggacagatttatgaacaccagattcaactatatgtccttagcttggggtgggtgggagagaaatgaagaattgcaaacaaatcctgaactcacttttgtaggtttattttattttattttatttttttgaggtggagtctggctctgtcgcccaggttggagtgcagtggcgtgatctccgctcactgcaagctcgacctcctgggttcacgccattctcctgcctcagcttcccgagtagctgggactataggtgcccaccaccacgcctggctaattttttgtatttttagtagagacggggtttcaccgtgttagccaggatggtctcgatctcttgaccttgtgatccacctgccttggcttcccaaagtgctgggattacaggtgtgagccaccgtgcccggcctataggtttattttaatggtatgggcaaactaaatcagagactattttgagcaaatgagtgagcctggtttctcactatggaagaagggacaaacatatagacaggaggaagacaggtaagaattctgtgtagaggaattggattggaggtgtctgtgtacatatggacatttctgtgtgtgtatgtatctgttgatgtgtgtgcatgtatttttgtatatgtatatgtatgtgtgtgtgtgtgtgtgtgtgtgtgtgtgaagagacattcatatatttcttagctctattgctgaaagagcaaaggagcgaagtcacaatagtagtgacacacctagcgttatttcccactgttagtttcctaaggctgctgtaataaattaccgtaaacttaacagaaatttattctttcatagttcaggcggccagagctccaaaccgaaggtgtttgtggggttggttccttcttggggaggcagagggagaacctatccatacctctctcctagcttctggtggttgtgcataatccttggagcttgatggtttgtgacattataacttcaattcctgccttcattgtcatatgacattcaccctatgtttacctgtccaaattttactctttttatcagagtaatccactcattagggccgactctaattcactgtgactttatcttaacttccaaagaccccgtttctaaataagctcacattcacagggttagtacctgattatgactttttgaggagcacagttcagtccctaatgcctactaaaactaaagctcttcactcaaatgactggcttcagtctggggcagggtaggtacaagatgaacctagaacatgttgtaatgccaaaaagtaaggaaatgctaaaaagtaagataagttgtttgttaagtatacagaatctagcttgaagagttccccactggtcaaatctagggcaatttgagcatcaaataattaaatacagtaatgaattataagctgttggaaataaagaactttataagaccattccaatcactaatgggtggatggatagaaaatgaagatattttacttacagtggcatgctgaaagttgaccagcaaatgtggaggttgtgctagagttgggaaaaaacaaaacaaggaaacctcattttgcagtcatcatgttaaagattagatcaggcaaaaatcatcaatggttgtaacatctaagaggacagacatgttgatgaagaacagaatatttacatggtcttgaaatgttgtatgggagaagagaaaaacagcaacaatgcagtggagaaatcagacaacacattgacagggtgatcacaagtatcacctccagtgagagtcaaatgaacattgtttgcctccttatgtgtttatctgtccctgagaagtacacaacatcatctatgcagtttctggcccagaatgcatctcaactcaatcacaagagaatattatgcatacatacagaaaaagaaagaatacaactgaacatagatgataaagaaaatgaggtaaaaatgtgacaacagatgaaaatggataaaggtattttctgtgtttttatttttggaactttttgtacattgaaatgattgccaatggaaaagtttagataaattgtcctaaagttacagagaacttgcagggaaaaacatcttaaagtagactaatagtggagagtcataaaagacacttggcaaatcttcttagttgaatattattcaaactattcagtcagggaactgattttgtgctaattatgaaatgcattattgcattgactttatgtctcttacaacattaaattatgttacctaggatcaatttgagattcaacacatgatagtagtttaatacagtgaagtcataacttgcaacaaactatcccaattttaagaattaattctgagcaatttttatatgcatgaaaaagatggttagaattatttgcagacacttgcatattctttagtcaagtggtcttattaccataattcatatctgttgtgggagtagggaagaaagagatttaaaaaatatctatcagttctttcaatcaagttaggtataatattaatagactttgagctaagaaagttttcatgaccagaagaggagcaggaactgtctaacatagaaaatgtttatggtataccataatcagttatacaaatataaaaggaaaaaatgtttgactagtgatactctcaaacttggatatccagaagagtgattctgtcagtacactaaaagcaaattcatctatcaggagctttcatgttttcattcaacaaatatttatccagtgcctattatgtaccagatagtgttatactgtgaatcgggagcatatgttaaaatagacaatatagtagacattattctctaaaattattaacaatagtagctaatactcatatgatacttactctgggccacataccattctaagatctttacatatagtaattcctttacctcaaacaaccttattagattggtactattattacctctattttattgatgaagaaacagaggcacggaggtgttaactttctccaggtttcacagctaaaagtagcagacccaggattttgaatccatcagactggcttgtgtccaagctttttttaattaattttttttattttgacataatttgtagattcacatgcagttgtaatataatacagagagatctcatgtactttttactcagtttctcgaggtaacttcttacaaaactatagaaccatatcataaccatcatattgacactgatatagtcaaggctccaaatatatctgtcaccacaatgatccttcatgttgcccacccacttccctctgttcacctattgaaagacatcttggttgtttccagtttggagctattacagataaagctgctgtgaatatttgcacataagtttttgtatgaacaccaatttttggctgggcgtaatggctcacacctgtaatcccagcattttaggaggccgagatgagagaattgcttgaggccagaagttcatgaccagcctggtcaacgtagcaagaccccatctcattttataaaaataaaaaattattttttaaaaggaacatcaattttcattactttagactgcctctaagcttttaattcttacattctaccacctctcaatatatagtagggaataaatagtagagaatgacttgatggttaagttgacattcagaagaggcctgaaggaagtgaagaaaaaagccatacagctgtttggggaaagcacatttcaagcagagggaacaagcacagaggccttgagaaggaaatatgcctagagtgtttgagacagagcaaggcggctggaaggagatgagttctacaaggcagctatgagccaggtctataagatgtggctgctatatagaaaatagatggtggttgggcaagtgttgaagcatggggaactattaagaggctgcccatcggagcttgcagtgagccgagatcccgccactgcactccagcctgggcgacagagcgagactccgtctcaaaaaaaaaaaaaaaaaaaaaaaaagaggctgcccatgtgagagatgatggtagcttagacttatggtggaagtgttaaagatggttcagattctagatatgttttgaagaagagctcacaaaaatttttctgatgggctgacagttggatatgagaaaaggaaaggaggcaagaatgattccatttaccaggttccaagagaatgattacagaaaccaatagattgccttatttatttatagtaggaaatgtagttatcacatcggcccaaatgtttgtgtctgcttaatccgcatatctgtttctttaggcaaacttgcattggaatgtaatggcgactgcagaatcaggataaggggacttgaataaatcagtctttaaatgcatctgaggccgggcatggtggctcatgcctgtaatcccaacactttgggaggccgaggtgggcagatcacttgaggtcaggagtttgagaccagcatgcccaacatggtgaaatcttatctccactaaaactacgaaaattagccaggtgtggtagctggcacctgtaatctcagttgctcgggaggctgaggcacgataattgcttgaacctgggaggcggaggttgcagtgagcctagattgtgccactgtgctccagcctgggcaacagagcaagactctgtctccaatcaatcaatcaatcaatcagtaagatacatttcactccagcctggacaacagagcaagactctatctcagtcaatcaataagatacatttatctctttagtagggacctgaaaaaattaaattccatagacaaaaggctttctgagctcttctttaataagtagtgttggcagatgcagtggctcatgcttataattccagcactttaggaggccaaggcgggaggatccctgaggccaagaatttaagacgagcctggtcaacataacaagtccctgtctctaccaaaataataataataatatttagacatggtggcttgtgcctgaggtcccagctactcgagacgctgaggtgggaggatcccttgagcccaggaggtcaagcctgcagtgatccatggttgcaccactgcactccagcctgagcaacagaatttttatttttatttaaaataaaagtagcacaaacatttgcttttgtttctctttcataatgcaccaacactaccctaacccccaacataatccttttgtagatttgttaatatattcagacaggccatattccatatctgatcctacttagtggtttgatggttggctaaaaggcagtattaatatctgttatttccatgctattgagggatatctcacattgatcatccttgtattggcaatagaaataaatggtgatagtatttttttcatttagataaatttagcactgctcttagtattattgaaacttagtttaggaatgtatcatttatctataatcatttattgctgaagtgaacccttctttaaattttcctcttccaaatattgatgtagttctttctttcttcatcagttccatgcatacaattcaattttcttcatgacacgggatcatcatctataacgtctgttacttataggactattctatgagtctcttcaagtgtatacatgtatttgcttttattttaagttactcaaattgttatatattttgagtacttatatatacattttaataattttactagccctggagctggtggtgtgtcatcttcaacttcctttttaaattccttctaatttcttagggtgggaaaaatctaattcagtagattgaatttttagaaaagagtagataaactgatgtctaaatatttaggtatttgtctattctggaacctttttgcttcatgatttttcttttttactttgcattcctgagatttcctttcatgaactggaaggctttactttactaagtgactcagcagtagctctatgtatcttttagttggaaatgcctttggctctatgcatgcacacactgcccattaattagcaaaccaacatagaatcatctgttgatgacaaaattaccaaaatggatcatccataagtgtttatactgcaaacagtgtatcagaaatgtcataatctcattcattaagaaatttacatacacaccagattttagagtgctcattcatgatgaatgtctacttccacactgtttgtttggaaacattcaatagccagtcttgaatttaaaaaatttaattgaatgcttaaagaattacaagtgttcctttccttggctctaatgctaaccaaagtgcttttctaaactgctaagaatggactgaagattctgctgagggctgtagatacttatctgcctaattgagccatcatttgttgacatgaagaaaaccacgtgacctactttaatgcatttctcagtagcagcaggaggctagaatgtagttcatccaacagtaaaactagcagcagtattattagacatgtgaaaatagcattggttatgggattagttttgtaaagtaaggatagtaatataaaggtatatagtcataatataaacagtatagagtgatttttttattttcaaaattatttgaatccaataatcatttaagtcagtcattcagtaactatttaccaatgtttacagttgccagctatattaaaggaattgttgacttgtcaaagttgattcatatgagagtaacagtgttaaaatctgaaactggtatggattgctaaaacgaaatactttgagtacacagggaattactatgatcaaaactatgctggatacattaatttgaccatgtgtctttaaattggaggtgaggaagattagttacagatacattaattagaaaggtgttatattagtctaggttgaggctgatataagtaagaaagtaggaaaggatgcaaaagcccttggaaatgaatatttgtgtgtggtgaagtaaaatgaggtagaggttacccttttacatgacttgagagaatcatggctcatttagtaaatccagagggagaaatgattttctatatatataatgagtttggaatacaggaagaatgccaaaaataacatcttaaggaattcttcctaaatagtgaagaaagaaattagtatcaacagaagagacagaaaaggatggttatgaaagataggaggtcatcgctgtctaaaatgactgatggattttgattacaccactggtgatagaaaaaaaattattagagaaaagtgtagtctgagaactatttgatcttagtctgtaatgaatgaaatataaaatttgagactatttggaaactgtttaacaagtttacacccccttccagcaaatacaaaattacaacaaatttaaagatgttaattggtttttatttgcaattctaaaatcggacaacaacctcattctattaaatagaatgaatattccagtaagctgagcagaggaagttgactttatagacagaaaagggctgaggaaagcaaaaacagaaaacaaaatgtggattggtatttccaaaattacttttcttataaaggttaaagcagaggggacttccttataccagctaaaactggtctgtttggggatctggctattatctgtttctcctgatttcttggaaagtaagataaacaactatgttttagcttagtgatgtggaacttcagcttgagtgactccattttggtttggtctggtgggcctagtgcaggagcttagtccaaactaatgggatcctatacattttgtttaacactgccaacatcctggtgcacgatcatcagatttctcattgaacagggaatggatgactttgaatgttggagagcacctgtggtgagttgtttatatataatctgtaaactagttatgcacagtagcactatatatgggtctatgttggactagaggataaaaaataacttggccttcacctcagagagtttaagaatcactatgccaccagaaagatggtagtagtaggcacattacatcgagtgaagactgttgggtgagagggaaggtttgcttaaagatataagagatttgagtttgtatattgtctaaggaagatatgatagaacagaagactgataatgcagtgtggaagagtgataactgctagatggaattgagatcaaaggtttatagatgaagactttatccttggaaaaatacatttacatttatttaatgtttagtttttaaattagatattatgtaacttgagcctcacagtaatccaatgaattaggtgacatatggttggtataattcatccgcctttacatttaagaaaattgagacacaaaaaatgttgtgtgttatccacagtcatgtggttagtaaatggggagatattttcatgcccagttctatgctataactactattatgtctgaaaataaaggcagaaaaaaatacttgaagaaaaaatggcaaaaaaccgcccaaatttattgaaaaacatttgtttatacatctaggaagctctttgaacaccaagtacaataaatgcaaagagatgcacacctggcctcataatagcaaaatcttgactatttgacaaggacaaaaggaaaatcttaaactcagcaaatcacaacaggggaacacaaaattaacagcttacttctcaccggtaccaatgaagccagaaggtaatgagataacatatttaaagtgctgaaagaaaaaaatcatcagcaaataaccttatgtccagcaaaaatatgtcaaaaataaaatgaaatattttcctagataagcaagtctaagagtgttcattgctggaacatctgccttaccaagaaatactaaagaaaattctttaagctgaaattaaatgacaacagatagcaatttaaatctatacacaaaaaacaaagagcatcaataaaggtaattatgtaagtaattacaaaagacagtataatgacatatttcttcactattctctcaactcatttaaaagcaaatgcatacagcaatttgtgtataattgtatttaggccctatgacttattagaatgtaatgtatatgatgataacagcagaaaggaggtgcatggcaacaaagctctattggagtgagtaagaaaaggacaccagatggtaaactaaattcacaagatgaaatgaagaaaaccagaatggtaaataagaagattaatataataaactctttaaatgcttgtagtcctagctacttgggaggctgaggcaggagaatcgcttgaacctgggaggcggaggttgcagtgagccaagatcatgccactacgctccagcctggaaatcataaggaatagaaaatatatttactattcattaagtggaattgaatcatcataaaggtcttcatcctcttagtcttcatttactgtctccaaaaaaaaaaaaaagtttccatgactcttcagtagattatcataaattaagatgtatattgtaacccttagggcaactgatgagaaaataacaaaaaattctagttaaaaattattaaaatgcccctataatatgcttaactgatttttgacaaaggtataaagccaactaattggtgaaaagatagccttttcaaaatgttgctgtggcaacatgacgtcaaaagtgaaaagtggccaaaagaccaaaaagtgaaccttgacctgatacaaaaatcgagtaaatggatcacagccttaaatgtaaaacgatgaaacttttatgaaaaacataggagacaatctcagaatctaggggtaatcaaatttctactgaaaattttagtagccacagcaaataagcaataaatagaaagaaatgtcattaaggttggaaagaagtgaaactactcttatttgtagatgacattttgcatatagaaaatcttaaggaatccactaagaaaaataaaggaggacaggtagtgataaatgcaaaaacagaaagtaatgaaatagaaaacaagaaaatagaattaaatctaaagcctttttaaataaaattaacaaaataatcaaagtggtcataacactaagcaagtgaaaaaagaaaagatagaagcaatattataagtgaaaaacaatgtttaatcataaacaattctaagaaatttggaccaataaaagtttgacaaaaatctgaagttctctaatttgtttatatatttttggtatttatgtatttattgtcataggtttcttagttagattcatggccaaaagtaccatccaaaaaactatttccaaatgtatatttttagcacatacctcttttctgatctccaaacttaatgaccaactggttatttagattattatatgcaaatagacttcttaatatacagtgtcaatcctgtttctcttatgtttaatacatctctgtatatggtaccactgcagggtttgactcatgtgccctagccaaaccctaggagtcatccttgattttttcttttccttcaataagtccctatctttatatctggaacccatttactcttcttttatcagcaattaccattctattacagaccattagtatttttctcctgccctactgctatagtctcctgactgatctccttctactttttaaccctttcaaaccattctccacagaatagctggagtggccttttaaaaatgcaaaccagcataaaacattttgatgtttaaatccctctcatggctgccaatgattgctcatagaataaactccaaactttctgccatggtgtataaagccctacatgtcttacatggctttcctcctacctgtctaatatcatcttattctagttctttctcattgattattcctttaacaaccaagcccttttccttcaaaagtccttcactcttactcctccttcctggaatgctcttcactgttttctaagggctgactcatgtataaccttcaacattcaactcaaatgccatcctcttagagagtcattttctggttagctatctaaagtagctttccctgttcctccatgagctgttgtcataatatccctccaacccccaacccccaccttatataaccatgcttgtctcctttgttgcagttatctccatttgtaattaacttgtttaaatcctcctagaatgccagctaataagaaggtaaggtccttgcctctctctctctttttttttttttgagacagtctcccctgtcacccaggctggagtgcaatgacgccatctcggctcactgcaacctccacctcccgagttcaagcaattctcctgcctcagcctcccaagtagctgggattacaggtgcctgtcaccacatccggctaattttttttttttttatctttagtagagatggggttttaccgtgttagccagagtggtctcgaactcctgacctcgtgatccctccgcctcagcctcccaaagtactgggattacaggcatgagccactgcccccggccttgcctctcttaataaccatattacctctggcaaccagcatagtgcctggtatttattgtgctcagtatgcatctgttgaatattattattttgtatactctatagtgatgagcatgttgtaagcaacccgatatgtataaattcattgatggtgttctctctctaaattttctttattgttttcatggtgggttcatttcctcctttaccccctctttttaggttgtataatcattagttttattttcatctctgattttatatggacatgtttcaatgcatacagacagttaatattcttttcctcctaattatctattatatatatcatcttcagtatcatcaccattcaaaaaactcttttatatgttctagataatgtggcctattttttacgttagactacctgataaggtgtcaactgaattggctgcctttatctacattctgaaccaaaatttaattctagagtttgtagtcagcgtttttccaaatgtgtaaaactgtaatccttcataaaatgtcatatgtaaaagagtaagcaattctgtgtgtactaaaaggtgagaaagttattactttagctttcactgggaagacttaaagtttatcaaaaaggattatagaaagaacagatttatagcaactgtctgatatatgaccagaacccttatgttccactgaaagagacttgccctaggctttctagagcataatgcccttagcaagtagctttcaacatctttttcaggaagcaatattttccttcagtaaaagggtcactgtactgtttttctttttccttccctgtcttatcttttgagttcaggaagtactttaaatttacaggcagctttgaagacatgaagcaagttcagccccagaagtatttcctgttatggcattaatctaattccatgaaagtagaactgatttttcatctgtaaagtagataaagtgcctagagcagccgaccattattctgggttatcatgataaagaggcttagttttgacacaaaagagtttatcagcctacccagtggaagatttcatcctttttgttgaaagatatattaatggattataatctgtcttggcttccaaaagaaagttcacctttatattgaaaatgattagttaaatcagcaaatattttcctgaatatacattttataatatacgataaatcaagcaaacattctagggatatcacatataattaaatatctaatgttaaatcattttatgttattttaatgtttaaattattgtctcaatttgaaataatcacagattttccttataaaccaacttggtttaattttaacatatagactaacataatttctagtaggcatatatgcttcattttagaagcccctgttattaggttatataatttctccttacaacttataatgtagaaatagttttcttataataaggtatttctcttaatagttaataattaaacttagttgattattttaagtatatagtacatacaaataatatataattcaaaagctataatatatttttcctatccctatttcctggttcctctctaagctaaggcatttagactaatcctagtggcttagtattgtttaaataattttttatttgaaaattgattccatattggacatatttacaatatttccttgaataataatagcttaccacatagtaatacattacatatttagttctctcagtagccttctgagttaaattctgttatccatttgaaaaatgcaggaactcaaggttagagaggttaaataattggctaaaattcacctggctgataagtgacagatttgggctggaactcaggtcctctaataccagagcctatattcatagcccatactgtaggattatagaaataaggttattcccagttgtgccttttatacttgaaaagaacaaaagattccactgaatgcttattttacaattaataaattaagttaggctttatcataccctaatgagatatcttattatttgtttaaaataaatgatctaccattatgttcataaataaaaataaagatattgttttattatagatgttaatgttttaaaacttagatcatctaaacatgaaaaatctctggcctagtcaaaggcacactgagaactaaacttgggattggaaaatttggagttttcaaatggccctaccaattcagcgcataattgtatatgcttatcatttttccaaagagggttgaatagtattcttccattgtatatcttagggaggcattataaaggtaatatgacatcagatgttaaacttacttatttaaccagcattcattgaggctgcctactatacgtatcctgtgaagcaatgtgaccaatacaaagatgaagaaaacatgggtgctgtctttagtgaactacccatcttctaggaagaataagatctattgtaatataaacaagagtgatgagtccttagtatatgtgaaggtctcctcagctaagttccaaaaagtaacaagctaactgtaatttcaccaccttagtattttatgaacaccaccttagtttttatgaactcaggaccttacctccactttatgaaaacacatatacacaaagcaaggagttttaataagcacttgaaaagatgctaatcttagccatcagacagtggcataaccatgtgagctttatcttaacacccactaggatgtctataatcaagaagacataataccaagtgttgacaaggatgtggagaacttggaaccctcatgcaccactggtggaaatattggcagttcctcaaaaggctaaacacagagttaccatatgacccagcaattccacttttagatatataccaaagaaaaatgaaaacctgtgtttacacaaaaatgtgtatatgaatgtttatggcagcattaattataatagtcaaaaggtagaaatgactgaaatgttcatcaactgctgaatggataaataaaattagattgttattttacatgagacacaaaaatgaactcaaaacagattaaagatttaaacataaaacctgagaccttaaaactcagaagaaaacatattagaaaagctccgtgacactggtcttgcaatgactttttatgtatgacactaaaagcacaggcagcaaaagcaaaattaaacaaaattgtatctatatcaaaccaaaaagtttctgcacagcaaaggagacaacaaaagaaaaggcaactcacagaatgggagaaaatatttgtaaaccccatatatgataaaaggttaattatccaaaatatgtaaggaactcatacaactcaatagcagaaaacccgattaaaaaatgagcccaggacctgaatagacattttccatagaagacatacaaatgacccaggtatatgaaaacatgtgcagtgtccctaatcatcaaagaaatacaaatcaaaagaccacagtgaagctgggttcagtggtggtggtgcgtacctatagtgccagctacttaggagactgagataggaggatcagttgagcccaggggttcaaggccagcctaggcaacataggaagaccctatctctttaaaaaaagaaaaaaaaaattactcccccacccccactttcctctccctcacaatgagatactaccttaaatttgtgactgttatcaaaaagtcaaaatcatgtggaaaaaagggatcccttgttagcgggaatgtaaattggcacagagattatgaaaaacaatacgaaagttcctttaaaaacagaactactatataatccaacaatctcatttttggatataaatctaaaggagatcggccgggcatggtggctcatgcccgtaatcccagcactgtggaaggccgaagtgggcggatcacttgaggacaggagttggagactggcctggccaacatgatgaaaccccatctgtactaaaaatataaaaattagctgggcgtggtagcacatgcctgtaatcccagctacttgggaagctgcggcaggagaatcgctcaaacccaggaggtggaggttgcagcgagctgagaacatgccactgcactccagcctgggcgacagagtgagactctatctctaaagaaataaataaataattaaataaacggaaatgaaatcagtatgttgaagagatatttgtactcccgtgttcagctgcattattcacaatagtcaaaatagggaaataccctaggagtctgtcaacagatgaatggataaagaaagtatatgtatatataaacagtggagtactgttcaaccttaaaaaagaaggaaatcctgccatttgcaacaacataggtgaacctgcaggacattatgctaagtgaaataggccagacacaaaaatatagatactgtgtgatctcatttatatatgaaatcttaaaaagtcaacctcatagaaacagggtagaaagtgtggttgggggagggaagaagggtagtggaatgatggggagattttggtcgtggggtgtaaacttttagttataggatgaatacgttctggagacctaatgtaaaacatggtaactatagtttataattatgtattgtatacttgaaatttgttaagaaagtagctcttaagtcttctaccacacacaaaaaaagataaatttgtaagttcatggatatgttaattggcttgatagtggtgtcatttcacaacatacacatatatcaaaacatcatattttatactgtgaataaatgtaatttttgtcagttataactcaagaaaattgaaagaaaaatgtattatatccacacagtgaaatattatttagtaataagcaggatgaagtactttcatccatgctgcaacatagataaacctttaaaacattgtgctaagtgaaagaagccatttataaaaggctgtctattgtatgatctcattcatgaaaagtcttaaataggtaaatcaataaagacagaaggtatattggtggttgtcttaggctgaaagtgttgtgggacaatgctacactcctaatagatacaggatttctttgggagttagacaactaatctaaaattgactgtggtgatggttacacatctccgtcaatatactaaaaatcacgaattgtatgctttaaatgcaatttatatgtgaattagatctcaataaagcttttattttaaaaaatagatggtattaacaaaacttttagactactgtgaccacttggcacacctaacaacaaagcatccaaggagattaatatttaaacgtacattataatatgaaaggcatgaatttagatgggggcatgtaacctcttgaagaaatatataatgtaaaagtgttattattgctattttatttcttattttaatcaaacactgtgatagtattattcattccactgtaacccctattggataaatacattatagtatttagaataaaactcatgtgttagtaagccagtgagaaagaatcataccagagctttatagatcaccagttctatctcctgtccctccatttcaggtatatgcaactggcctacctgttcagagtattaactctatggtgcttcatcagtcagaccatccactatgcccaaatgagtaatatgtccaaactgtatttgcaaaatgcatttcttcacagaaattaatatcctgtgcaaatgctggctaattgattattactctttcataaaggcttaattaggtaggaaacccagtacctgcagcgagagaggaagaaaagtctttcctagggctagatcctgacccaaggttttggattttaatggggcagagttgtctgttttctattaaacacatacttgggagtaagtagacttgcccatctcctgttttatactgatcttttcacgaatgtgaacctttttcttgaaagagtaaatatctttaaatttttctgtagccttccctgttacaagttaaatgttcctacttctctagagtatttcgaagtgtttatttaaataagtaaacatggatagacactattttgtagcaaggggttgggggagtatactctaaggcagcttctctctgacagcttatctttcttataagtatagtgtaaacatataatttataatgtgggaaaagagggtttgatcttttaataaagccatttctttttatttcagagttaaggagtttaaattctttttctttagcatctagcagtgagttcaggggtgatggtcattaatatcttgatccattacttttcctaaaagataagattttttttcccataatggttcatttgtctgactgctttatttcccaccagaaatcacaaaatccatttttcctgtgacagtataataattttcacaacatctgattttagtggcacatacatgcagaagattaaaggtgtaggttagaaaagaagcagtaagaaggcattgagaataaaaacatggtagaatttatttctttaatgtcataataactaatttagaaaaacaaatataaacaatgggttgtaaatagtttattcaatattttaataaagaattaattcattacatgcacacttatttttacatacttgcccagatttcttaccaaaaaaaattttctcgccctattctcaaacaaaatttatagacattatatacagcctctgttgaaaagaccttctgttaaaatcagctgcccttagcttgacatatcttgagttcttagtgattaacatgttaataacaagtgtgaatgtcattaatgttcctataattaatttcagtattaacaccttatgtttcttattattcattcctcaaatgaaggatttttccatttataactaagtggcaattattatatcatttttatataatggagcaataaattgtatctgatgttattaatagtaattcctacattccttataacatacttttatactcattcctttatatattcctttactgttatataatactttttaagtgcctttaagtgaagagaagtggttgaaatgtaaaagaagctacttggaatgtctgtaataacaaatgtgttagtatatttacacctgcttgaaggaaagagtaaagtatttcctgaaaaccccacaattatataggtagttcaacctctgatctgcactgaggcatttaacctctcttaaccttggcttccttatttaaaggaagtggctgttgagccttacctaaatcataaagtgagtgcaagtaattgtttactgagaaatctaagaaaggctaatggaaaacatcaagtatgaatgaaacagttataactgttttcccctttgaaaagaattgctgttccacattgaatttctgtcatgaatctaactctttttaaatgagctatttaaatttaaatacataaatggatgttatattttgattttaattacttcagtagtaattcagaattaattgaagctacagcttaaacatattttattacatttaaatagttgggaaaaaataaacagttggttagctaaaacccaataaataaattgggaatagattctgctagttgaatgctgaaatgaatagtatatactttaaagggctttaattttttctttcatactgatttaagactgataatttatctctttacttattctaattatttgaccctttttgttggaggagagggggcaatcttgtcactaattgtgtaacccttgtttaatttactctttcaggaacccttccaaccttccccctctccaccttaatacactgatgttcattttggatttccaagagggagatatgatatgcaactttaaaaaacctattttccagtcaagccatttttcaaagagagcttattaacctctcctatggatcaaattgtgaaatactaaactaggttgcctgtggaagtatagtgagagacgacgataggaaagaagataggatggggtcagaagaaccttacattccatgcttaggagtataaactgtatacgataagcagctgggaaccataaaatccttttaagaagtattgtgatataagactaatttgaaagaatagtgagaaggtggataattgtacatttgattttattcctttatgctaataattcccatgtacatacagtgaatgaaatataggagacaaacatcttcaactattctcatttcttattggttttagagcttggaaatatgttaaaaagacatgtaaactagttccatcaattgtatttcctcctatttagatagtacagtgattttgagcaaactgttaacattgattttaaaatccaaaatatattattagtctataaatcactgcatggttctcattcattgattttcacttaggaggctttggggggttgttttgtttttataatgctttacccaaagcattttaaatcttctactctccagtaatagtttttgtcaaatatattttgatatctgctgtactatttgctatatttacttaaacatctctccactacgtagagcaggtactataggaggaaaaacttttcctctaccctcttatgttcagtagttggtgcttgcaaattaaactgacaaaaaattaggaggataaaaggattattttgtatgcacgtgagaagcctcacagaaaagaattgaaaaccccaaaaaaccaatgagaccaaggggcttacatatcattttaagaaagagtgataaagtatggagaagagactagacaaaatgggggtttagacttctggtggggtgagggtgggcattaatgataggtgactaaggaatgagtggtaaataagggttgtttagtaaggtttattaggcagagtcaagtgagaagagtctgcttcttctcttcctggtactggagaggaggacgccattacaaatatgaatttcctttacaaaagggaaatttatgccctatttttaggaagtaaaggggagggcagagagctcctcctatgtttgctgttttaattgcctgtagttcaaaataatccttatgctgaagtggcatatttgagggtgtcatactctgatccccttcactatagactactctctaataccagggtactgagttaagataattctgaaggcttcgctaataatctactactctttgtcaatttcctatcttagttttctcatctgtaaaatggagatcatgatagcacttacctcaaaaaatgataagaagtcaattaaaaaagcaccaaaaaatgcttaataaagtggtctgacacatagtaaattctcaatgaataatgtatatactgttaaggagtcatttccctctaagagtacaaagtacaaaagaaaaagttggagcttaagatttaggtttggctgggtgtggtgtatcacgcctgtaatcccagcattttgggaggctgaggggggtggatcacctgaggtcaggagttcgagaccagtctggccaatgtggtgaaaccgcatctctactaaaaatacaaaaaatggcagacgtggtgatgcatgcctgtaatctcagctatttggaaggttgaggcaggagaattgcttgaaccctggaggcagaggctgcagtgagtcgagatcacgccactgcactccagcctaggcaacagagtgagactctgtctcaaaaaaataaataagagttaggtttaatcccagctacttgggagggtgaagtgggagggtctcttgagcccaggagttcaagtccagccggggcaacctagtgaacacttccctccactccatctcttaaaaaggatgggagtgttcccagtgctgattatgccacctattagccgtatgaccttggacaactgtaagcctcaactttcccatctatgcaataagaatcatttttacctcattagattgttatgaggattaaatgaagcagcatgtatatatgtgtatatatatacgcatatatacatatagtatcttgtatataataagtatttattacatgcaatttcatcttttatgtagactttctagactctaaccttgccccaggaagataagtgacttttacattaagccatgttctctttttcctttatgacactcctcaatgcttaatgaagaactctggctacacaaaaaactaaagtaaaatgttgacagactgcttttttctacatctgggcttctttaattgaaagctgacatttaggccaagaattgttaggaattcctatttaggtttataccagttctcgcttatatacaagatgtatacttgtgtatacatgttatttacacacatacaataatatatactggctttctttttttccctctcatcccataacagatagtatactgccttttttaaaaaaaaaaatgcccacttttcaaattaaaaagcagaggcacacattctttccaaatgtattagtataatttgaaataatgagattgtattaataggattcagccacagaaacagacccattagggaagatagagtgagaataagatttatttgttggttgatcgattttgaggaattggcctatgtcattgtggagactggctaagtagtccaaaaccatagggcaggcaaccaggaaggggagaaagccttgaacttcttaggcatgggcagaagctgtcattcataggtggaatttattctctctgtcaaggaaacttaagccatgcttttctttttaaattttattattattatactttaagttttagggtacatgtgcacaacgtgcaggcttttactttcaactgattgaatcaggcccctccagattatccaggatactccagtaatagaagtcaactgactgggagttttaattacatctgaaaaatacctgtatagcaacacctagattggaatttgattgaataactagagtctgtagcctagtcaagttgtcacctcaaaaaaaccatcttgggataaagttttttgaaaaaagaaatagaaagttcagggcattttggtcattatttttgtgtattgtgcctattatatctttttattttaaatttttgagaatctgtttagtgcctagtattttgccaagattataaaggaaacaaaggtatcttaatgtttttttcaaatcttaacatcttaaagttgtttcaagcattttccctgaattcattgattaagtattgttagaagaagtggaacatggatgatgcatatgctttagattgaggcaggagtatgtgtggtgactaagagagtaagaaatgatgatctcgagaatactagactgtgagctttctaaaagctggtatcgtgtgttatttatccttgtattgccatggcctggcacagtaattgaaaaagttcaacaatggtttgttgtttaggttgattaaggaatgagcaaaaacgtaacttaaaagctatctgtattgaagtgtgatctgttatatgtattcagatctgattatacttggagtcgaaatcactgtatctaaattaatattaagactcagggccaggcacattgtctcacatctgtaatcccagcacttcaggaggctgaggtgggaggtcagttgaggccaggagtttgagaccagcctgggcaacatagcgaaaaactctgtctccacaaaaaattaaaaaaataaaaattagccggacatggtggcatgtgcctgtagtcctagctacttgggaagctcaggtggaggatcacttgaatctagaggtggaagctgcagtgatctgtgatcgtatctctgcacttcagcctgtgtgacagagtgagactttttctcaaataaaagaatcaatacagcaatacagccccaatttctaaattggagaaagtcattttctatttcgtctctctctgttcctccactagattgtaaactctttgagagtaagaattatgcagttttgtctgctcttcaatgttttattgccttgcattaaaaagataataaatactgcttgatgaattaattaaaaacagcatacagaagagatccaaatttaattttgtaataaatcacctctgagaataataagaaaaccagaatatttgaaatacatcatttaattgaataaggaacagtaaactgatttttaatgttcctgtttttatgtatttgaagttaatgtttagttattttgttttaaaatctttataaaaattctctgctttatcttccagtgaacaagacatattaatagcttttctgtagagcaaggcatattaatagcttttctgttgaatatgaaagaaagcagctgtagttttatcctactgagtacaaatatttgttggggaattaaagatttattagataaatggcttaaagattaattaattaactatactatctttttactttcctatcttatctgtaggccattggtctgttaatatatataaattgctctgtttcctgctatctttccatttcttaattaaatattagaaaaatgcccaaggaaaaacaatacaactgagcttcctttctggttttcatgcttttaaaatttataaaaattgtggctctgctgcctttttttttttttttttttttttttgtagttagatgaatttggcctgagattctatgaaaaaaataaaacaatagtttttatttcatgatttttttttcaagttgttctgattttataatatctagtcaagtgatgacatgcagagattttgctgtgaggagagggagagagcaaaaagtattctgccctgattgctttttagtgattttattactagaaagataaacattgccttgttattttagccagtaaaattgtctgcaaagtaggtaacaaaatgcaaagcagtgtatttacttttccactttttcccaaaggtatgataaaagcagggttccagtggaacaatttgctgagttctttcctagggagcactggtagcccgtattaaatgattatattttggaaaatgctaatgatgaaagatgagaataatttatattctttgaaatgtgactaaaaagttggaaatgaaacctatctttctgaagtgacatccacatttgtggttcattttcatcacacctgattcacttctgccagcaattcagaaagaaaggtggaggtgggaaagcatatatgtagctaagctactaaagtgactatttgagtatttcattccatctgtcaaaagattcagtgggataaagaatttggcataaatggatgtaattcattctctttttacaaagaagtaaatgatagaacaaaatcatcctaaaatgaaggaacaaaataccagaaagtgaaagaaaacaaaatttgtattttttgatagaatagtagcagaactcaatgtaaaaataatgattacattaataattatttgctcactttttcctgtatttggtattttgggaaagtgggcttgaaaaacagtggatacattgatgaaacatttcaattttcacttgcctgttgtgtttgctcatgttagacaaactataacttctcggtgtatagatatgatgtacacaaaattacacagaaattaagccatgtataataatgcatgactagaagaaagatatatctcccttgaacaaataacagttattttagtaaatttgtaacagagaaaataggcttgattaacaaaaatatgaaagatcttttaaataaatgaattttgaattttcagagtagcccagaattttatctaaactcggattatttcattagctagaacatgaaaataggcatttattctactcacctacagcttctgtagtactaaatttatggaatgaggctttgtggtgctgccttcagagctcaatgatttgctttttctgaattttggaagtctgtctctaattgattgacacatatgaatgtagtgggaagaaatgagattaagcatacaagctttctttttcatttaaacatcattgaagccatgaatttgtaaattgatataaaaacacaatcctttggatctgtattaggaaatttataaatgggagctttattttgctccagaaatgtgataattagaaatatattcaggtgattttttccctttggtttttgttgttttttaatttatttttctttcttatttttaccaaaggttcaagtcatctgtaatattcaggtgtttttaagaatttctcatggcaagttaattgtgggtgaacatttccctattggactaccagatgtactttgtggttataacttgcatagctccaggatttttcgtgaacaagtaataaaacacatttctggtttgctttctgccatagagtattaagagtttaacactttttaaatgttactttaatctctgaaattttcaacaatgattagtggcagtatactcaaaaaaggaaatgtgtaggctttactataataaaaataagaacaacttatataagctccacactttatagatttgtatggatatacaatcaaatgtactaatttttaaattatcctcattttgcagtaattttacattttgctcatttgtgcaaaccgtggtgatagtaaaatatttaacagaaattcaagcacattcttttaactctttctgaaaaatctcacaaatgagatttttttaaaacagttaagaatttactaaatttaaaatgtatatatacctgatgccatccagatgttttattgaatttctaaaataaaagtccacctaatgaatggctaatttactcaacacgtaagacaaagatgtatttctgtgttactaagaacatgcatcctatctccttgacaatggctctaattacctcagcttggactgatcaatatttgatctttttcccaccatgcaaacatgttactttgactttgtctcttcctcttcttttcagataatttgcagccatgtgagaatggttcattttgtttgttctccctggcttgaggccaggggtctcttattagtataatgcagttcattgatgtgaatttgttgatctcctgggtaggttttcacaaatttaaggcaattaaaagcttttatatggcatttcacttgaagttattagtggcctttcagtgattttgcttttaaaaattacttcatcattttatgattatttcctttccttctcttttctctactctccccatgctataaaattctatagtaaaggattgaaacaactatttcattgatttcattaaaagtaataatttataaacttataattcaatagcttaatattttaattaccacaatttttaaaggactaatgaaatttttggttttgtgttttcaaaagctgctttgttttaagcatataaatattcatgatagaagccataatttggagaataataagaattgaatctaaaaattattagtaattgctaaaaaattcaaaaagcacatagtgtaaactttgtgtatatgagacagaactttttctaaattgcagtttcattaacatcttaaagttttctcgtagctaacagatgtccatgatatttttgcttccttaacttttacagtcaatggaccattctccagcaggtcataagtaagaatgttaaataacggccactaaatcttaaggaatgtgacaacattgattagattaaaatcctttgacttcattgacatatcttttttctttccccatttaaaaaattgtttcagttgttttcctactgtttgttggtggcatactttgttacagtacttgatccagtttgtttcattggtgtgcttggtaaatttgaagaaatgatcactggagaggatttgaaataactagcaaaagttttgaagtattgcagtgagtatatggaatgtgttactcatttatgcaaaaaatattggtgtttttatactttttattttaaaaaatatataacaataatagcaaatatttagtaagaatgtaactttatgccatactaaggcaagaatagtatattgaataagaggatataccctgaaggcagggtataaatccaagttgcgctgcttactagttcacttcttaagcagttaacttctgaatctctctttatgtgcaaaatggtataggagaggaaaaaaaatatctttccctcctgatatgtacatgactggggcctctataacaaaaacagattaacaagagaaaagtatactataatttaagtgtaagttttacatgacatgggagccttcataaggaaatgaagacccaaagaaacagctaaatctgagtgttttttatattaggttcaatggtgaaatgatagggtatgaagtaaatgtagtaaactgggtgaaacttggcaaggcctttttgtttggattcccctctgtctctttgtctttggagaaaagatgctcctttatagagagggtaccattcacataagggtcttgtgacctacttaagggaaaggtcaaaaaacagttaccaggttttatgatctgtttctagagaaaagggcaggggacagtcagagagaccttcctgcttctgccattttctcacattccttcaccttaaaattttcaatatatcaaggtgctatattttggggtagtatatcctgaaccgtgcctataggaatgatgataataatatctactttataaggataaaatgagacaatatgtataaattgtatggaacagtgcatgaaccacaataaacactcacaaaatgtttgctataaagatattttcgaccttccatggtggttcatgcctataatcccaacactttacgaggctgaggtgggaggatcacttggagccaggagttcaagaccagcttgggcaacatagcaagaccccatctcttaaaaaaaataaaaaataaaaattacccatgcctatagtcctaattacttgggaggccaaggcaggaggatcacaattgatcctcaggaagatcatgcttgtctgtaaaggattttatatccccttgacttatgaagcttagtttggctggatatgaaattctgggttgaaaattcttttctttttttttgagacagagtctcactccgtcaccaggctgaagtgcagtggcatgatctcggctcagtgcaacctctgcttccctggttcaagcaattctcctgcctcagctgccctagtagctgggactacaggtgtgcgccaccacgcccagctaatttttgtatttttattagagacagggtttcaccatgttggccaggatggtcttgatctcttgacctcgtgatcctcccgccctcggcctcccaaagtgctaggattacaggcgtgaaaattcttttctttaagaatattgaatattggctcccactctcttctggcttatagggtttctgcagagagatctgctgttagtcccatgggcttcactttgtgggtaacccaacctttctctttggctgcgcttaacattttttccttcatttcaacctttgtgaatctgacgattacattgtgtctgggggttgttcttctcgatatgtatgcacccaatacaggagcacccagattcataaagcaagttcttagagacctacaaagagtcttagcctcccacacaataatagtgggagactttaacaccccactgttaatattagacagatcaacgagacagaaaattaacaaggatattcaggacttgaactcagctctggaccaagcagatctaatagacatctacagaactctccaccccaaatcaacagaatatacattcttctccgcaccacatcgcccttactctaaaattgaccacataattggaagtaaaacactcctcagcacaagcaaaataatagaaatcataaaaaacactttctcagaccacagtgcgatcaaattagaactcaggattaagaaagtcactcaaggctgggcgcggtggttcacgcctgtaatcccagcactttgagaggccgaggcgggcggatcacaaggtcaggagatcgagaccatcctggctaacatggtgaaactctactaaaaatagaaaaattagccgggcgtgatggcgggtgcctgtagtcccagctactcgggaggctgaggcaggagaatggcgtgaacccgggaggcggagcttgcagtgagccgagatcgcgccactgcactccagcttgggcgacagagcgagactccatctcaaaaaaaaaaaaaaaaaaaaaaaacctcactgaaaaccacccaaccactgctcctgaatgaatattaggtaaataatgaaattaagacagaaataaagcagttctttggaaccattgagaacaaagacacaatataccagaatctcttggacacagctaaagcagtgtttagaaggaaatttatagcactaaatgccctcaggagaaaactggaaagatctaaaatggacacactaacatcacgatgaaaagatctagagaagcaagagcaaacaaattcaaaagctagcagaagacaagaaataactaagatcagagcagaagtgaaggagatagagacacgaaaaacccttccaaaaatcagtgaatccaggagctggttttttgaaaagattaacaaaatagatagactgctagacagactacttaagaagaaaagagaaaagaatcaaatagacacaataaaaaatgataaaggggatatcactactgatcccacagaagtacaaactaccatcagagaatactatagacacctctacgcaaataaactagaaaatctagaagaaatggatacattgctggtcagataccccctcccaagactaaaccaggaggaagtgaatccctgaatagaccaataacaagttctgaaattgaggcagtaattaatagcctaccaaccaaaaaaagcccaggaccagatggattcacaactgaattctatcagaggtacaaagaggagctgttggtgggagtgtaaattagttcaatcattgtggaagacagtgtggcgattcctcaaggaactagaaccagaaataccatttggcccagcaatcccattactgggtatatacccaaaggattataaatcatggtgctatgaagacacatgcacacatgtttattacagcactgttcacaatagcaaagacttggaaccaacccaaatgcccatcagtgatagacgggataaagaaaatgtggcacataaccaccatggaatactatgcagccataaaaaaggatgagttcatgtcctttgcagggacatggataaatctggaaaccatcattctcagtaaactaacacaagaacagaaaaccaaacactgcatgttctcactcataagtgggggttgaacaatgagaacacatgaacacagggaggggagcatcacatactggggcctgtcagggggtaggggactaggtgagagatagcattaggagaaatacctaatgtagatgacgggttgatgggtacagcaaaccaccatggcatgtgtatacctatgtaacaaacctgcgtgttctgcacatgtatcccagaacttaaagtacaattaaaaaataataataaaattttaaaaagaaaaagattgggtatttcacatcttcttgaatgtaaaactgggggaaaataatcttttttaatgtgcattaaaactttttttttttttttttttttttttttggggggagaaggtctcactctgttgccctggctggagtgcagcggtatgatcaccgctcactgtggcctcagcctcacaggcccaagtgatcctctcacttcaggctccaagtatctggactcaaaggcgtgcaccaccactcccaggttttgtttttttttttttttttttgcagagacagggggttttctatgttactcaggctgttttctaactcccagcctcaagcaatcctcttgcctcaggttgccaacgtgttgggattacaggcatgagccactgtgcctgacccagtgaaacattttagtgcagaatagttgtgaatttttgaaatagataaccaagaaaatttaacttcagatatcacctagttgtaagttatctctccgttttgtcattcaggaatgggttttctgagactttctaaagaaatatatattatcgttcagtttggctttggaaattttattattgccctatatttctagtaaagtaatgtagatctagtttgatacaaaccattctatacactacaccggtactatcagctttcacttttcacagctcccaaaacaaataaataaaagaaaatagctttcttttctatgccgtttctttctgaaatagtactaatctgccttacctttaatactatcccatagacccacctagtagctcttcccttacgagagagttcttttgatcagataaggtttaatatggaaaataaaaagaaataatcatttaaaacttgaccaaaatattttaaaaacatacacatatatactctaccttaacatatggtgaaaagcaatttttcctaaaatatattctatgaaaaaaaaattttggccaggcacggtgacttatgcctataatcccagcactttggaggctgaggcgggtggatcacctgatgtcaggagcttgagaccagcctggccaacatggcaaaaccccgtctctactaaaaatacaaaaaattagctgggcacggtggtgggtgcctgtaatcctagctacttgggaggctgaggcagggagaatcgcttgaacccaggaggcagaggttgcagtgagctgagatcacaccattgcactccagcctgggcaacagaacgagacctcatctcaaaaaaaaaaaaaatttatttccaatcagttggaaaatgtaagaatatgcaaaaatttaacagatttctttaatgtgggtttttcctagaacacctttttacatttcagaggacattagagttcagcaggacacagtttggtaaatattagtataaaaagttaggctcagccgggtgcggtggctcatgtctgtaatcccagcactttgggaggctgaggtgggcagatcacgaggtcaagagatcgagaccatcctggccaacatggtgaaacctcgtctctactaaaaatacaaaaattacctgggcgtggtagcacacgcctgtagtcccacctgctcgggaggctgaggcaggaaaatcgcttgaaccagggaggcagagattgcagtaagcctagatggtgccactgcactccagcctggcaatagagcaagactccatctcaaaaaaaaaaaaaaagaaaaaaaagaaaggagaaaaaagaaaaaaatcaggctctctgtagtcaaaagtcaaacatttttactgctaaaataaggcattattttttttccttgcttaattgccatgccaacttttattggttctttcctgtctcccaatgagttaaaaaagaaaaaagtatccaaatgtgttcccaccccaacccaagcctgtgatcacttctttgtttttttgcttccctgtaagggtatttctccctataattatactcacactttaagaagtaggagccattatactttattttcaaatttcaaattagaaagtgatttgggtttggaagcttgtttctgtctctggctatccaactgtttctcggctccaagatgtgaaactgtttcttcaccctaacggcaaaagggcacctgctattgagcgtgctttgagcgttattctcccaatagtaccctagataggtaagacatttttgaaatcaaaaataaacaaaaacttcttgttgtgatttctctgtataccaaaacatcctcttgacataaactgtgttatcctaatgacacagacaaacacaaattatcttcatttgggttgcagagttgggggtcatttcttgtgcttatgagcctgctattctgcaactgtgagatttcagacatgttcaatttgtggattttattttttattacacacacatgtgtagtattattgcttgtaataccttgtatgaatataaaaagattgtcatttttcaggtgtatattaacttcattaattttttacaattcaaatgatggagagattcctattgaaggatacttagctttttctaataattcagttatgattttatattcaatgtaaatgattttgtctctctggggccagattatcctatttaccttgaccccctaccatgacaatttaaatactgcatttaactgtagtatatgtaagattgtccttaacaaatatgagacttgaaaggttgtttttgtttgtgtcctctcctctgaagttttccttttaggatgacagcatacgatagatgtgttctagtaaagtgcttcttttattcatgaattacaaatagcttaagaaaatgtttaaagtaaagctataatgattagtcctggtagtctccattttattcagaatgtctctgtcagaaattatgtcatcactatggactgttagccaggaagttctgtctagcagatgaatgaatagggagtactgagttttctaataaaagacactgttgtaatattgaaatactgctaatggaggttgccagttttctgttcttaaatttacaggacatcttctgtgattaaagtaaggaatacttagagcaagtccttagagtaaaccaactataaacttaagaaaccggaaatagaattttttttttttaaacaatgccatttaagtccctaacttgtcttggttcagctgctagacatttgttcctttgtctcaaaaacgttagcagaaagcaataaatatagttcttgctttactcagctaacatctgattttatctgcacattgcttccatcttaaaactttcttaccttactagtctgaatggcttgtgtagcctaatactgttataattgtcagaacaaagggtttgattattttggcaaggaaaaaagcctggtaatagtatttgcatttcaattaattgtttcattctgatttgaaatgtgacttatgttagatacatctctgatccttccctatctcagtactaatactaatatgttgtatttccactacaatagcattacatcttacaaacatttatttcctttataactgacgtagagctttccacatagtagatatttaatataattgatggtttggaattcatacattttgtaggctaagtataactctcctactgtttcacctacttcctaagctagatttatctttacaggtactagactttatagaactaatggtaaattcagtatgcatatcttctgtagtaaacatagaaaaacatttttgtaatagtgctccccaaattttagtttcttgactagtaatgaaatatcttatctgtactagagttttgttatacaataatgacagcattttcatgtgctatgttatggccagttaactaaaaataagtggatatttaaaatggaaaatgaaattatcctgttgcctgaaatatcttgactcaggttctattacaggttgcatatggtatctgttagagctttgaatctatgttggttgttgagttattatgtgcattaactattgcattcaaaagttctttaaaagcatatgtctgttttaaatcttatacaaattccttgcaggttttgagagcagtctttttgtatgtctttcttgtttgttgttttgtttttataccagagcaccatgtcctaagcagcagtaaatttaaaacattgcttaggatagttttataatatcattaatagatttttatattagatagtttctctgaattattgacctattatagggaacatggaaaaatttagaaaaattagaagttatacggagtattaagaaaaaaactttatattttggtactcccaggaaaactaaaacctctttctaagagtatattttaggaaattttctaaaattttgtaaatcaacctacagagaaaaaaagtatagaaagtattttgaaatatttgtgtgtatatgtgtgtgtgtgtacacaagccacattttctcctagaactcactactgaaatttctgaaagtgattcaataagatatatatttcatatctggtttttaaaatccatagaatttttgtgttttgaccatcaggtagagtcttacagtttagtcacagtggaatcatcagcttcaaaatgaaagaacaagatagtctcttggcattcaaaaatttagcatactttaactcatatttgctgtgatgttaggtagtgaattattcttgttaactatctagcgtccaatgtgacatgtgtttgttgttacctacaacttatcaaataaacagttaccctctggaatgataagaacttgggctttttatgaaaaataccctctaaatgaggacagaaatctatattaaggataggctattgattaaatttagagatacacataaagatgactctcatataaaatttagaataaacatgaaagttttagcatgtccagactttagggatttaggctttatgaaggtctcaagcctgtctcctggaattccaacattgtgatgactcaaattttatcagtaaatatggaaaaataagctaaagttcttgagaaattgctatctaataagtgattattttattttttttctagttttaaaataaaaaatctttactatttattagattcaccagtgttttatactgggggtccccaacctttttggcaccaaggactgtttcgtggaagatcattttccacagggcagggtgggggaggggtggtttcaggattattcaagtgcattgcatttgtcgtgcactttatttctgttattattacagtataatatataatgaaataattatacaactcaccataatgtagaatcagtgggagctctgaacttgttttcctgcaactagacagtcccatctgggggtgatgggagtcagtgacagatcatcaggcactagattctcataaggagcacataagctagatccctcacatgcacaattcacaatagggttcgcactctaatgagaatctaatgccgccagttatctgacaggaggtggaggtcagacagtaatttgagcaatgaggagtggctgtaaatacagatgaagcttcacttgcacatctggcactcacctcctgctgtgtggcccagttcctaacaggccatggatttgtatccgtccatgtctgaggggttggggacccttgttttatacaattctaattgtgtcattgaatttcttttttcttttttctcattgttaggaggctaaaaacaaacttgtcttgtgcagattcgtcgtctttaccaccaaatttttgtcatggtatcttgtcttttttttacgtctttctaaactgccttaatccttgtaagggaataggtaaggtgtaaatataattaataaggtgcaaggaaatgttattagaaagaaattagattgttatttgaaaacatacagagcctaaatgtaagagaaatgtcctaagcaaaacttattaacaggaaatttactgaattggaaagtactcttgattttatgactaatatgaattgaggtattcttatagacactcagagattcctgtacacatgttacttgtgtttttccaaaactatatacgtatagtctttttacaaataaacagtggccaccaagaaaaattacagcagtacacataagacataccgtatacatgatactcaactttgtctatatcctttgtgttcaagtttctagaaattttcatctttgtaaggatatcatgtgagtgtgctcaaggtttgttctaagaatctagctgagcacagtggctcatgcctgtaatcacaataccttgagagtctgaggcaaaaggaacatttgagcccaggagttcaagaccagcctgggcaacatagggagacccccatctctattaatttaaaaaaaaaaattacctggacatggtggcatgcatctttggtcccagctacttgggaggctgaagcaagaggatcaagaggatcacttgagcctggaaggtcgaggttgcagggagccacagtcatgactctgcactccagccttggtgatacagcgagaccatgtctttaaaaaaataaaataagaatctatacacaattcatggaatgatgttgttttatagttttactgtatatttgtttctgtcataacttccaatatcccaaaaactttttaattatttttattcaagacatacatacagaagcaggccaggcacagtggctgatgcctgtaatcccaacatttttggaagccacgatgggtgggttacttgagctcaacagtttgatgctacagtgagctatgatcatgccactgcactgcagcctgggcaactatttaagaaaaaaagagagagagagagaagcagaaattcaaaggacactttttgaaatgcacttaatgtaaaggctgctttgcatggttaatttattcctattaaaggaatactacattcctgccacttttctaggtggtgaatttatagcagcgaccaggtaaatattgctgtcctcagggtgcttacctttcagtgggtaatgctttaaacaaaatatctagtatattagatggtaataagaaccttggagaaaaataaaacagaaaagagtgttcaggtctagcatgaaaggttacactttcaaatctgatcattagggaaagtctcacccaagacagtgatgtttaaaaatatttcaagaagcaagttgtgcacatattagggagaaaaacaatcagtgaataaatagcaagtataaagtctctatgccaggagcatagcatgtttaaggaatagccaggagattaatatggctagagtaaaatgagcaatgggaaaagtaagtaggagatataattacactgggaaagagtctaggggcatattaaataagactttataggtcattataaagactttgttgtttttgttttgttttgactctgaatgagatcaaaagcctttagagggttttgtgcagacgagaaacataacatgacttatattttagtagggttattctcactgttatatggacaaaactgaatggggcaaagatagaaatagggagatcactttggaggtcattgcaataatccagtgggagatatgatgacttggactagagaattagcaatggaggtgttaagatacaatcaggctctggatatagtgtgtaggtagatttaatagaaattgctgttgaattgaagaatagtttacgagagaaatgagtcaagggtggaagcttcattaactaagagagggtaaatggggataatttggtctagttttgtataaattatggggaaagtcttggtctcatagtttagcattccatagtacgttctccatagtgtataagtgataggttttactaatttaataatttttttgtctcaaacttgtgacttagactttgataaacttctgtttatgatagatggatttttaattgattttattgtttgtattttataatggattttaaggcatattagtgaaaacacaacttaaaatttattttcttaccttactaacattccaaaaaaggaacatatactgtataatgtttttttgtctcactaatatattcgtatccctcttcccccttcttggcaaacttgtctgaaagtatactgttgcatgttatgtcatggatgtaccggagcatgtgtgtaaaatacatgtcataaatggaagcagctggtttcctatgcagttaagagaagaaatgcatacagctgagctcttcaaacttcagaactcattggattcagtttctatcctgtgtaagcatgctatgatttcaaatagtacaaatgtataacaagttaccttaatagcttaaaaaattattttgtttcgatagttgaactactaaatctgttttattctctttccctctgccttcagtccctacttacctatcctacctcttgaaaagaacattacacctatagtcttagttttaaattcgaatctgaaaaggccttggcaagagttgggaaaaagttatcatctcaaagggaaaagctgaattcatacacaggaactgcaggattactctggcgttttactagtcccttgcagcactcgcaagtcccataaatacctaatggaaaaacagcagaaaatgagatctgcagcagccttttgagatcaaatttatgttgctgaacatttttttgaggttgagtgtaaaggtcaaaagaaagtgggtagattaaagttgctgatttttgcaaacttaaggccatttttaaaggtttctctttctgtagcaagaaaatttcaagataaatggctttgcttcattagctgaaatgtcatgtcttcctttaatatctgttacctgagacatttagtgatttagtggtatttatatacaacaaataaaaatctcaatccactttaacaaatctagataaatttatgaaattgcagatctttccaagaacagcatgatgataaattaatgtatatatacatgtttgtattgccatgtatatatgtatcttaaatgacatattttagatgtttttgtatgatacagaaggaaaagataataatcaaagttttgtatttttaaagtataggttattgatccagcagtgtaattataaccatctttttttaaaattatttcttatattaaactattacaatgaagataaatgacctcaaagaaaagatcgtgcatgtaatagcattaaaacaaaattcatggatgcttttaatggtctcttaccttttgaacaacattttaacacgttgttactggtgcaagcctatatctaagaaactgtgagttactagggtactgcagacttgatgcaatgaagaacaataaactgccatttctggacatctctatcctgagttgatagtacagaaagccaccacatatgttaacgtgaagttatagattatttatatctccagggcttgcttcgtgtctttgatttcgtagttcagattgcccagttattagtacttagaattcaaaagaataagataaaaaatttttacttaatacattcatttctgcatcacaataaagagttttcatggaaattatccagataatttcatagtagaataatatatgaaatgaaatcttttcttttttatggtagttgataattaatagtaaatctattcagtttatctctaagaagtcagattatgggagacttgtctctatttttctctatttaattttcccaaaaaaattcataaggaaaatattaattttcatttaaatctctatattaaacattaagtgatctttttatgccttggaatcacaatgaatataaatgttatttttattgtagttgattttgcagtttcaattcatttctattaaatattttaataaacatttttatgaaactaggtagaggtcacaaatctcattagtcactgacagccaattctcaaacccaggtcttttcctgtataccacatttcctcattagttctcactacactgtatggctatttccgcctcttaactttttatattttattacactcttaaagtacaactgtacttctcttctcaagtgcccttttctattcagtaagggtcccaggtgagcaatgattctgactggggaagagggagaagatggtgttgtagcaagtagtattaaaaggcccttaggaaggtagatagatgtataattttgtctctttcttctcactgttttcgtaaagacaaaggctatgccttaacttttttgccattcttatttttgagactacccattagggattgtttttgatgttgttgagatgaagtatttggtgaagccaaaacctccttgacttttatagttttaataagtttgtgctctccaaaccttcataaagtaatgtctagtgatcctttcagatatggcatgctgtcatgtcagctttaaataattgttaatggcatgatttttaacattttacctagttagaatcagtaaaatttattatatatactctttgctgatcagtagagcctcttatgaaggagtcagtatgatgtgctggatagagcattagatggcaaattgggcctcagatattattaggcatagttttgccactaatttgtataatgtgcaagtttaataacctttctgggcctacagttctcctcttctgaaatggaaagatgaataggttatctctaaagtctatccagatctaaagatctattttattatagaaaacttttaatcatacacacaaagatagaataaaaataaatggcattatgaatccctgtgtattcattacctgtcctcatatgttatcaatagtaaccccttagtatcttctaatacctagttcatattaaaatttcaattaaagtatctagtccatattaaaatatcatctcagtaataatagtttctagttgctttgttttgttcaaattataatctagacaaggggtgtgtgtgtatgtgcatgtgtgggtgtgtgtgtgtgagagagagagatctagttgtgtttttaagacttatggtcaaaaatacatatcataaaatttcccactttaggctgtacatggtggctcacacctgtaatcccagcactctgggagaccaaggcaggaggattgcttgagcccaggaatttgagaacagcctgagcaatgttgcaaaaccccatccctacaaaaaattatgaaaattagccgggcatgatagtgcgcacttgtagtctgagctactcgggaggctaaggtgagaaaatcacctgagcccaggagtttgatgctgcggtgaactgtgattgcaccactgcactccagcctgggtgatagagtgagcccttgtctcaaaagaaaaatattttttaaccttttaatttattttttagagatagggtctcactgtgtcacccagaactggagtgtagtagtgcatagcatagctcactgtaaccttgaactcctggggctcgagtgatcctcctacttcagcctccagagtagctaggactacaggcacacaccacctcacccagctcattttaaaaattttttgtagagctggggttttgccatgttgcccaggctgttctcaaactcctggcctcaagtgatcctcctatcttggcctcccaaaatgctgggattataggcataagccaccgtgcccagtctatcttaaccatttttaagtgtaaagtacagtaatgttaattgtatgcacattgtgtgcaatagatttcttgtacaaacaccttgcaaaacggaaactctgtagccattgaacagtaattcccctttgcccccttcatacagccccaggcaaccaccattccactctgattccgtgaatttgactattttagatatttcatgtaagtaggatcatggtttatggctggctttttatggctggcttatttcacttcccttaccatgatgtcctcaaggttcatccatcttgtagcatatgacaggatttccttctctcttttttttaggccaagtaatattccattttgtatatataccaccttttttttttttttttttgagatggagtcttgctgtgtcacccaggctggaatgcaatggcgcaatctgagctcactgcaacctctgcctcctggatttgagcaattctcctgcctcagcctccggagtagctgggactacaggtgcgcgcaaccacacctgactaatttttatatctttagtggagacagggtttcaccacattggccaggctggtctcgaactcctgacctcaggtgatccgccttccttggcctcccaaagttctaggattacaggtgtgagccaccgcgcccagccacattttctttatacattcatctgctgatggacatttagattgcttccacttctttgctattttgaataattctgcgatgaatatgggtgtgcaaatatctcatcaacatcttgttttcagatcttttggatatatttccagaagtgagattgctggcatttttaattttttgaggatacttcatagtgttttcatagtggctttgtcatctaacattgtcagcaatagtgcacaagcgtttcaatttctccacattctgtatcttctttgaaaaatatctattcaagccctttgacaatttttcatttggattctttcgggggtgaggtgttgtggagttccttatatattctgaatattgatcccttattggatatatggtttgtaactattttctctcacttcataagttgcctttttactctgttgtttcctttgctgtgcaatagtttgtaagtttggtagtcccatttgtcttatttttccttttgttgcccatgcttttggtgtcttatctaagaaattattaccaaattcattgctgtgaaacttttttctccagtgttttcttcttggagttgtgtagttttaggttttaaatttaattgtttaattcattttgagtttatttttatatacacaataaggtaagggtctaactttattcttttgcatgtggatatcctgtttttcccaccaccatttctcaaagaaactatcctgtatgcattatcagtactatactttttctttttttttttttttttgagatagattctcactctgttgcccaggctggagtgcagtggtatgatctctgctcactgcaagctccgcctcccaggttcacgccattctcctgcctcagcctcccaagtagctgggactacaagcacctgccaccacgcctggctaattttttcagtttttagtagagactgggtttcaccatgttagccaggatggtctcgatctcctgacctcgtgatccacctgcctcagcctcccaaagttctgggattacaggcttgagccaccatgcctggcctatcagtactatactgttttgattgctgttgctttgtgtaatatgttttgaaatcaggaactctgaggcctctatctttgtttttctttcttgagattgttatggtatttgggggcctttgcagttttatatgaattttagaatttttttctatatctgcaaaaaaatgtcattgggatttgtataggaattgcatgtgcaaaggaatctgtacattcctttcagtagtatggatattttaacagtattaagttccaatccatgaacacaggacgtcttttcatttattggtgtcttctttaatttctttcatcaatgttttgtggttttcaatgtaaaaatcttgtgcctccttggttactcataagtattttattcatttttaatgctattattaatatatttgttttcttaattttctttttgggttgttcattgttagtattttcaaacacaattaattgttttatgtttattttgtgtcctgcaactttgctgaatttatttattcctcctaataggtttttttgtatgtgcagtctctaggctttttatacatacaagattgtgttatctaaagaaataattctacttctctgtttccaacttgtatgcctcctatttcctctttcctttctttctttctttagctgactgctctggatacaacttccagcactactgtgttgggcctggtggtatgctcctgtagtcctacatacttggaaggctaaggcaggagaatcacgagttcaggagttcaaggttacagtgagctgtggtcataccactgcactccagtctgggtgatagagcaagatcccgtcggtaaaaaaaagtggcaaggggggcatccttgctttattcattgtctttgagggaaagctttctgttttttaccatcgagtattatattacccatcggcttttcatatacagtctttattgggttgaggtgatttcctctgtgccttttttttatttaattataaaaagatgttgaattttgccaaatagtttttctgcatcaatagagatgtcatctagttgtgatgtctgataagattcttctttctgtaagtcattttcctcccctccactccattttttagctttcctttggtttgtcagagaagccaggtcttacatttgtctcatataatgttctacaaggttcagtgcttccttttgtagtgttgttcctctatcacctaatttcctaataagacctagaaatgcattgtcgtctggtagctactagctacatgtggctctttacctgtacatttttaaaaattaaagtttaaaattttcagccattgtagccacttatcaagtgctcatatagccaaataggggtagtggctaccatattggatagtgaaaaggaacatttccatcatcgcagaaagtggtctcatataaagaactgatatgacagtgttttttccatactctattttgtctttttccacatgccagctatctcaacaccatttggggctatttttagatgtcataattttagccaatactaatgggtatttattgatatctcattgtggctattttttcatcaatagttttttgtttgttttggggggcagattttgtttgtttgttttcatttttttgagatagggtctcactctgccacccaggctggaagacagtgatgtgatcatggctcaccgcaaccttgaactactgggctcaggtgattctcccacttcaacctcctgagtagctgggactgcaggtgtgcaccaccatgcctaatataaatatatatatatacacacacatacatatacacacagacacacacacacacacacacacacatatagagagagagccactgtgcctggcctaaatagttttattttgaaataattttagatttatagaaatgttctaagatagtaaaaataagttccatgtactcttcacctagcttctcctaatattaacaccttaaataactgtaggatcttcatcaaagctaaattaacattggtacaataccattaactaaactacaggtttattttcccagtttcttaagtaatgtcctttttctgttccaggatctgttggaggatactacttgacatttcattgtcatgttgctctgtcttgccttctcttttgtggccttgacacttatgaagagtagaggtcagatagtttgtaggatatctttcaatttgagtttatctgttgtttccttgtaattagactgaaattatggggttttgagaataccaccactgaggtgattttgctttcccaatgtatcacatcaaggtgtacgtagtatcaatctgttactgttagtgtgaaccttgaacatcaagttaaggtggtgtccattgggtttctccattgtctatttgttcctttccatatacagttcattagaaatgaatcactaaatccaccccacacttgggggtgggggggtaaatacaaaatgaatagtgtttagaaacctcatagaggaaggatatagccaccacagtaattaataaatattagtggagagatattatgaaattatgcaaatattctagttttttaaagttttacccactgatttatagcatttattagtggatattgcctataccaattacaactatggtgttctaatggtgattttctatttccctcatttattctatatttaataattcaaattctttaaggaagatttgtctctttgcttccatttttaatattctttaatttttttttcgagatgggttctcactctatatctcaggttggagtgcagtggtgtgatcgtgactcactgctgcctcaaccttctgggctcaagtgatctacctgagtagctaggactataggcatgtgccaccacgcccaattaactaattctttttttaagaggcagggcctcactgtgttaccgagcctagtctcaaatgcctgaactcaagtgatcttccctcctcagcctcccaaagtgctgagatcacatgtgtgacccaccacacctactctgtattcgttttttacaaattcagtagtcttttcttttctttctttcttttcttttcctttattttctttctttctttttctctccccctttcctctcctttccttcccttcccttccctttctttcctttctttcctttctctcctttctccctcccctcccctcattctctctgtgtcatccaggctggagtgcagtggcgagatcatggctcgctgaaacctcagcatcctgggcttaattgatctcccaccttaggctcccatgtgtgtgggggtgtgtgtgtgtgtttgcatgtgtatgtagatggaatttcactgtgttgcccaggctggtcttgaaccttctaggctcaagcaatcctcacaactcgcccttccaaagtgctggaattacaggcctgagccactacacctggtttgtttccatttttcataaattctgcctggtgcggaggctcacgcctgtaatcccagcactttgggaggctgaggtaggcagatcatgaggtcaggagatcgagaccattctgaccaacatggtgaaaccccgtctctactaaaaatacaaaattaactgggcgtggtggcacgcacctgtaatcccagctacttgggaggctgaagcaggagaatcgcttgaacccgggaggcagaggtttcagtgagccgagttcacgccactgcactccagcttgacaacagagcaagactccatctcaaaaaaacaaaaaacaaagcaaacaaaaaaaaacaaaacaaaaaacccttaattgtcatttatatcaatagggctcatggatatttatttagttctttgggttataatctaaaactgtgtcacttttactactcaaattcgagatttaactattgagagctttgtcacattggcttctgtatcattgtgacagacctgtcatctttttattactttcttactttctggcactacaagatcatctagactttctgtaccccagcttgtttctccaaggatcactggttcactttatcaaagagaaggaccaggcatggtgactcaattctctaatcctaacactttgggatgctgagacagaaggatcacatgaggccaggagtttgagaccagcctggacaatgtagtaagacccccatctcttaaaaaaaaaaattagccaggcatagtgacatgtgcctgagacctagctacttgggaggtttaggcaggagaattgcatgagcccaggaggttgagcctgtgtgagccatgatcatgacactgcactccagcctaggtgacagagcaaggccctgtctctaaacagagaaagagagagaaagagagagcgaagagagaaagagagaaataaaagaagaaaagagagagagggagaaagagaaagaaaagaaagaagagaagagagaaaaaggagggagagggagggagggagggaaggtaggtgggaaggtgtttcaaaaccagcatctgagcactgttttctcgtaagctactggcagtaattgcttctaggttctctcagcagatagaattaggaaatatgcttatgtctgctaactcatgtatacatagacacacattgtatttaatcctgttacctatgtgtgtttataatatatataaaatcgtgagtttataatggtatctcttactctaattcagtaccacagagttcatgctagcatttccctttgacttattttaacttccttctctgatagtgagaaagctggctctgattatttgacatgtatttacttatttatgcaaacctagtatacatataaagtcgtttaaaaattgctggctgggtacagtggctcatgcctgtaatctcagcactttgggaggctgaggcgggcagatcacctgaagtcgggagttcgagagcagccttaccaacatggagaaactgcgtctctaacaaaaatacaaaattagccgggcgtagtgacacatgctgtaatcccagctactcgggaggctgaggcaagagaattgcttgaacctgggaggcagaggttgcagtgagtcaagatcgtgccactgcactccagcctgcgtaacaagagcaaaactccatctcaaaaaaaaaaaaaattgctgaatcatacctctgtgataaaccaatttaccagaatacaatgcttatatatagttctttttgtctttagcactatagtatgtaaaggaaatactgttggctacagttatttagggtcttttcattcccaccactttcagtaagtttatttcatacatatttaatacatttagactaatttatcacagtttgcattccatcttgggttcccttaacatcctaattgatatttttaaattagtatttgctgaaagaaacctaaaatattgctcctttacggtagttggtcccttccacctgccaaccatgggaaaagttaatctgtttttcatctctgtagtttggcattttctagaatgtcacatacatgaaattataaaatatgtagactagtggttctggcttttttttacttagcaaaattcatttaagattcattcttattgtgtgaatcaagtttgtgtttagtatgtaaaatatatagtttaaaccagatattttggggctgatttctgttattgtatggtatgctttctgtactatgaggattttttaatttgtttctatcttttgccatatcctcccactttggtttgtgtgtatgtttcttccaataatttgtgagacttgtatttttattcaagtgaccacatttagatctgtaacttcatgtaacatgattaagatttttttatttaaaaaaaggtcttttgagacatggtctcactttgttgcctaggctggagtacagtggcatgatctcagcttactgcagctgcaacttcccaggcacaagcgatcctcccacctcagcctcccgagtagctgggtttacgggtgcatgccaccaggactggctgttgttttacaatatgtttttagagatagggtttttccatgttgcccaggctggtctcaaactcctaggctcacgtgatctacctgccttagcctcccaaagtactgagattacagtagtgcaccactgcacctagccaagattttttaaaagataataagtattctttttcggggaattcttcattctcttttcctagaagatttttctttcccttagtgtttttaagaatacttagacctcaattacatgatttatcagcttttcaggatctccttgacccctggctataaaagatgaggaaatctttcttaccctcatagtctcacaccttccctctcccaattactctattttgtatatttgttcccgagatttataacatttatattgttctgtaaccaaacatattctcctccctcctgcaaatttttgatcttattcataacagttaaaaggcaataaacagaatcaatgtttatagctaagcctttcataatagtcattttatctcttggtttgctgaggtttgttctggtggtttcttcagaaagtcacatagaaactatatttcccaaattattttatgttctaaattttgtctcttcatttatacttacatggtagtttgaccagatacaaaattaactaggctatctttccttgaggaggtaatagacattgctcttttattatagggttttttggtttgtttgctttaatgagatagggtctcactttgttgtctatgctgatctccaactcctggcttcaaccaattctactgcctcagcctcccaaagcactgggattataggcattagccactatacccagcctatcttagaactgtatttatttatttctagagacagtgtttcattatcactcccaggctagagtgcagtggagccatcacagctcattgcagcctcaacctcctaggattaaatgatcctcctgcctcagcctcctgagtgtcagggactccaggcatgtgccaccacacctagctaatttttaaaaaaaattttcatagagatgagtgtcagtctgttgcccaggcttgtcttgaagtcctggccccaagcagtcctcccaccttggcctcccataatgctgggattaaagacatgagtgaccacacccagcaattctttaaatgatactttgaagaacctgagcacgcacatatatttcttccctctttgttagtaactctcagttccttatctagctttatttttctgtcacctggtgtatatattccttggattatttgtttgctgtcatctccatctatagaatgcaactatcaatagtaaagggatttggtctgatttgttctctgttgaattccaaatagcttgttagtgtttaatacttagcatatagctaatacacatttattgaattaataaggtcagaattcatgattctgccccattctccatccttataagtactttgatgggtttgattgcttacaaaaggattcgtttcacattttgaattcccgtgcctttactcagatatgtcttggtcttcactactgtgtgtcagtgttgtgctctttccaactatatttttctgtgctatttctagaaagttcttccacatgtatctttttttaaaaaatatttttttgagacagggtcttactctgtctcccaggctggagtgcagtggcatgatctctgcccactgcgacctctgcctcctggtctcaagtgatcctcccacctcaacttcccaagtagctggaaccacaggcacgtaccaccacacctatctagtttttgtattttttgtaaagacgtggtttcaccagttgcccaggctggtctcaacacccgggactaagcagagctcacctcggcctccaaaagtgctaggattacaggcatgacccatcgtgcccagcctcacatatctttatattaggattgcagcttctgttttctactattcccactggcctggtttatcattctctatctcttttagccactttgttttttgttggtttttttttttttttcattttttttctccctacccctctcttttagccactttgaattggtttgttttagtgtctctttgccatacagcagagaattttcttttgcttcctgaggcaatctgaatatactttcatgtcaataagctgctgatatatttggcctcaaacctgtcatgttattctataattactaaatatatatgtatactgtttttctgtgtgatttattatctctgctgtttttaaattttttattctggcattttggaaaggtttatatttcttttctagccattagcttttcttttaagtgtgctttttatggtggccttaatccccatttttcttataacattctactctccaatcagttttaaatgatatcctttgattctcacctattatctatacaacagtgattttattctgcatttttctctcacttctttgttttaaaattgtattacttctactttgtcagaatatgcagtgcttacaaactatgttctttccatcctttttaatttataattataattatcttattaaatgtaatgaggtttaccaacaacagtcctgtgtttgagttttcccccaatcatgcttggatgaagcttatcttctaatacatttctcaggaaaggcgtatgtgtacagtatcctctgtgttcttttttttctattactttatactttttcctacacaaagacagcttggctgcatataaaatccttgactttatttcttggaaataatgttctagttttgtcttgctttgtgttttgctcttgaagtctaaggcagcctaattttctttctttctttctttctttttttttttttttaaagagacagagtctcactctgtcacccaggctggagtgcagtgtggtatgatcatactttactacagccttgatctcctcagctcaaacaatcatccaaccacagcctcctgagtagctgggactacaggcatgtgccaccatacctggctaatttgttgttttttgttgtttatttgtttggttggttggttggttttgtttttgtttgttttttgtagagacagggatcctgctatgttgcccaggctgttctcaaactccaagcctcaaatgatcctcccacctcagcctcccaaagttttaggattataggcatgagccaccacacccagtccctagcctaattttcttattcttatttttctaatttcttactcttaattttatctttttgcctgtaggcctgaaaatactgtttcatcattaaggtctaataattttaccaggatgtgtcttagacctttcttgtttggggtcagtttttccaggtatgcaataataagctggaaatatagtttctagcttatagagtaatatggtagctcatgccttgcacatgcttttacaccagcagcacatcttttaaatgtgtagatttaaattttcatctatttctggaaagttttcttagactatattttaaatatactattccattgcgttattttttcctcaaggattctgtgtttatgttggatcttcttttcctgtcttccatttcatctactttctctctttgttatgtctttcttctctcattttcattcttttggttgtttgccttcattttttcagtgtacctttttagattttcactttattaatgtattcagcatggtgcactttgtaatttatttctgggattgttttttccttttattgcatttcttccctgattactttgtcctagtaatgttgaagacatggtcatatattgttttatttgtacttcttgtggcttattgagagaatacgaagataaatttggtttcagattattgccattatcctgaaatagattttgaactgtttttctgtgctactactttgttactctaatttaggaatgccatttatattatcttagattcacttttcctcttgttctgtccttttctcaccaatttattttattacctttgttagttcctatttcattttgcttgctttacacagtcctgacctccattttatttactatatttttatcagtgtttttttctccatttctttgatggttgcatttttctttcacactctcttgagcccagccagtttgtgtttcaccatctgttaatatgtttaattataacttctctatactttagtgtctctgcttaatagggataattgcttcatgaattttgtccatgcatttgcttataattgatgtgtgttccattactatatatttctgttaaatgtcttgtatgtgtcatttactttgctactttttttttcttctgtcctcatacaaattctgttctggttcctttttcatttctcatcttcgaatatggtattttcctacattagctattttacatgaggtttaattaaggaaggggttacacatgtatttcatactatgaagaattgtccatatgatgcacatatgccagttcaattaatggtcttaactcaggacaatacaaatagtacctattgtttcctaccactattcctaagcaccttatatcagattttcttttccttaacccttggagacatctagggaagattcatcgtagtttttagtcactttcagctgttaaggaaattgccctgcttttggttatttaaacaaattttaagtctgttgttaaaaatgtcagtcttaaactgtgtttgtattagtcctttcttgcactactatgaagaaatacctgagactgggtaatttataaagaaaagaagtttagttggtttatggttctgcaggctctacaggaaatgtggctggggaggcctcaggaaactttcaatcatggcagaaggggaagcaggcacatcttacatggctggagcagaaggaagtgagacaagggggagacgctacacactgttaaacaactatagctcattgaaaactcatgcactatcacaagaacagcaaggggaaaaatccaccctcatgatccaatcatctcccaccaggcctctcttgcaacattggggattacaatttgacatgcagcttgggtggggacacagaactaaaccatatcattctgcccctggcttctcccaaatctcatgtctttcctacagtgcaaaatagaatcatcccttcccaacagtcccccaagacttaactcatctcagcattaactcaaaagtccacaatctgaagtctaatcagagacaaggcaatctcttccacctctgagcctgtaaaatacagttagttacttccatgatacaatggagatacaggcattgggtaaatccctgttccaaaagggataaatcagccaaaagagaggggctacaggccccatgcaagtccgaaacccagcagggcagtcattaaatctttaaactccagaataatctttgactctatgtctcacattcaagccacactgatgcaacgagtaggctcccaagggcttgggcagttctgcgtctgttgctctgcagggctcagctcccatgtcagctctcaagggctggcgttgaatgcctgcagcttttccaggtgcatgatgcaagctgtcggtggacctaccattttgaggtctggaggacagtggccctcttctcaccattccaataggcagtttcccagtggggactctgtatgaggactccaaccccacatttctcctttgcattgccctagtagaggttctccatgagggttcacccctgcagcaaacttctgcctggacatcaggtgtttccatacgtcctccgaaatctaggcagaggctcccaagcctcatctcttgccctctgcatacccacaggctaaacactaggtagaagctgccaaggcttacagcttgcaccctctggagcagtggcctgagatgtatctggggctcttttttccatggctgggacgcagggagcagtatcaaggttgcacagggcagctggtccctgagcctggcctaggaaagcactcttcgcttttatgactctgggctggtgatgggaggggctgctgcaaatgtctctgaaataccttagcagcattttccccactgtctcggctattaacatttggctcatttttacttatgcaaatttctacagccaacttaaattcctgcccagaaaatttctcttttctaccacacggtcaggctgtacattttccaaactttccaaattctgtttcccttttaaatataagttccagtttcagatcatctctttgctcacatatatgagcatatgctgttagaagcagacaggatacatcttgaatgttttgctgcttagatatttcttctcccagataccataaatcatctctctcaagttcaaagttccacatttccctaaagaaggagcacaatgctgctagtctctttgctaaagcatagcaagagtgaccttcactccatttgccaagaagttcctcatctccatctgagacctcctcagtctggacttgactgtccatagcactatcagcatttaggttacaaccatttaacaagtctctaggaagttccaaacttacccgtatcttactatattcttatgagccctccaaactgtttcaacctctgtgtgttacactgttccaacgttgcttccacattttcagtcatctttatagccatgccccagtcgtaggtaccatttttccgtattagtttgttctcgtactgctataaagaactacctgagactgggtaccttagaaagaaaagaggtttaattggctcatagttccgcaggctctacaggacatatggcttgggaggcctcaggaaacttacaatcatggcagaaggggaagcaggcacatcttaaatggctggagcagaaggaagagagacaagagggaggtgctacacactgtttaacatccagatctcattgagaactcgctcattatcacaagaacagcaagagggatatctgccccactaggcccctcttctaacactggggattaaaataaacacgtgattcggatgggaacacaaatctaaacctatcagtgtttacattttttatttttattatttttattacaaagctcagctttccaatatactctgcttataaactgaaatttttaatattatttaaaatgtcaattctccctacagtgagccatagaatcaatgcctttccaaccaaaaaacaagatttttgtgaaactttaccatacatttctatggaaaagcaaaacggcaagaatattcaaactactcctgaagagggacaacaaagtgggatgtagcctaccatatatctgaacattctgtgatttttgtaatatagcagttcgctattaggacagtggtagaccagtgtaatgggacagagaggacagagacagatgccttcatttccataaggaaatggttgattattcaataaatggtgctgcgataattattttttcataacaaaaaagtgaaatcaaatttctgttttatactatacacaaaaatcaatttcaggtgaattatagatctaaatatgaaggtaaaatgacagagcttttggaaggtaacttttgagaatatctgtatgatctcggggtgtggaaaaatttcttaagcaggacacaaaagcataaaggcaaagactaataagttgtaccacattaaaattaagagcctttgtttatcaataggtacctttaaaagattaaaaggcaagccactgagtaggagaagacatgtgtgacacaaataacccagaaagaattaatatccataatatattttcaaaattttagtaatcaatatggaaaagacaacacagaagaaaaatagtcaaaagataccaacaggaaatttaccttagaagaaaatcacatgtgtattgaaggaatgaaaaattgttctacctcatcattaattagggaaatgcattagccgggcatggtggcacatgcctgtattcccagcaattcaggaggctgagacgggagtattgcttgagcccaggatgtcaaggttgcagtgtggtatgatcttaccactgcactccagcctgggtgacagagtgagaccctgtctcaaaataaataaataaataaataaataaataaataaataaataaataatcctttgaaaaataagggaaattcaaatgtaatccacaatgaggtatcattttataccagttgataaaaattttaaagtctaaaaatttcaaatgctgcataaaattagaattactgactcttacacacttgaagatacaaattccctactatccccagaaaatgttattgcttttagacactaattatatccaatatctagaacttagtctaataaactatgaacaaggcctctaccaagaacacttaaaacataattgtgagaacttaaaatgtaaatggaggtgtgttttaaagatgtttatttattagaagactcaatactgtaaagatgcaatatttgtccattttagtctgtaatttcaatgcaattctgattaaaatcctaacaagtaggggtgtatatgagtgtaaattgacaaactcatttttatatgtttttggaaagtcaaaggataataatagccaagaccatcttcaagacaaataagatgggagaatttactggtgatatggttaggctttttctcccatatccccaaatctcatcttgaattgtaatccctataatccccacgtgtcaaaggagagacctggtgggaggtgattggatcatgggggcggtatccttcaggctggtctcatgatagtaagtgagttctcatgagatctgatgatattataagtgtagttgtcttttccacacttgcacgctctctctctctctcgcctgccaccatgtaagacgtgtgtcttccccttctgccataattgtaagtttcctgaggtcactctagccatgtggaactgtgaatcaattaactcttttttctttagaaaatacccagtcttgggcagtactttataaccgtgtgagaacagactaatacaactggatattgagtcatcttataaagttaaaataataagacattgtgacattggtgcagtgataaataatggaacagaataggaaacccaaaaacacaccaacaggtatagttttccattttgattgttcctttcattagatgtttaaaactttataatgaatatgtacttttagtcaaaatttatttacttgagaagcaaagtgatgtatggattatggcctctgaggctataatgtgagtttgacccaaataatgatccaaatgtgagttccagtcccagttttgtcctatactactagctgtttgagcgtattcaactggtctgtggttcttagtttttttatctttaacacaagataataaaattacctctcagaattatggtgagaatttgacataacaagtataatcctgctggcacatgctgttcccttgatgaggggaatttgttattatgtttcttaggaacacaaaacttctgtttattcttggtaagaattcatgtttcccagatctatgtgtactatttgttatatttaaggttatcaaattgtatccttggtaatggttgccactggatcttttttggaatatgtacaactccttattcaaagtggctttctaatcatgattagttttttgtagttttggaagagccatattactgccctgcattcataaagcagtcttgtaaacactgattatgatagtgttttgaaaaattaaaagcctccaaaatcactaatttttaaaaaataatgcagttaaatatagaaaaggattagccatagatattttgtagttaaccctattatcattaacctaagtgaatagaacctaatttttgtacttgctaataattgctattaagaattttgttaatcgtgtgtggattggtgcttgagttcagaatgaatgattgataggggacaactctaagaaatacagcacttacattaatgttttattaaacagaaaaagctttaatgttttattaaacagattttaagagttacagtcttaaaatctttattatttattttatgaaatatttcattttgttttttttctgggcactttaaaattgagatgaggatggtagaatttgccagtttattttttggctattttttttttaacccatcttattttgagaacgaatttagtaatatttttctcaacatcctgaaattgtgtaacctgtagaaacttcccactgtctttttaaacttattcttaaataccacatttaatataggataaataagtcacaaagcttgcttatcaaaacagaatattgtattcagctttccatcggagcttttggggaagacatcacagtattgtactgtctcccaagatgcaaagtatcaggctttaaataatgaaaataagggaaatgccaatagaaaattagaaaaaatgttagaacagttaaaaacagcatactgaagcctgcattatttggcttatctaaaaatcatatgttttcaaccaatcagtacttatagtcattctatttaatcttttaagaaggagacataatccaccctcaccaagtgattcagtgtagcatcctaactaataatgacttaatgtgtgtccaaatggcatgtaatgagaagtatgaaacattgtctgtatactttcttgcctaagatacttaactgagtctaatcataaagttcagacatatcttcactgtggaacatttctacaagacaacggcctggactcttcaaaaatgccactgtcatgaaagacagtaaggagaatggaaggagactttcagattaagggagactaaagagacttaagcaaatgtagtattagatccttgactatatattagataatactacatcactgccacattttgtgcttatataggaaaatctccttggtcagtatgtatcataatagggtcataatgtctgcaacttattttccagtggtttgaggggaaaaaagacgtgtgtgtgtgtgtgtgtgtgtgtgtgtgtgtaaagaatatgttctaattgatacatatacgtaaatagcataggagtgttcatttgtactactctcaattttttctataggcttggtttcaagatgaaatttgaaaaaccttaagggaaaatatgtttaaagtatgataataacaaattagcacactagataaactttttatagcttttgtgagtttttttccttcagaaaatcatatttatgtagatagcaggattaaagaaaacttttctaaatttcagatgtcagaaatggagacatctaaattgtttttccatttcatctctaaatgctaatgaaaactggacttttacgacattaaagacatttaattgatctctgtgggatttcatgtttagcttttttcaacagctatatattgaacatttaggtgatgagattgagtagctaatcttagaggcgctctattgagattgtccagattccaaccctgatcccacaacttaccacctttgtgatcttggacaagtaatttgagatatctgtgcctcattctcctcaaatattcaacaggataataataatacataccagtttcttaggattgtagtaatgcttaaatgaattaatatatttggagcacttaggaaagagccaagtacatagtaattttctaaaaattatacctacttattatgtggatctttgctgaggaaatatgagtaagcatacaagactggacaggctttgagtagtgaagatgttttactcacaagcaaggtaattatgccttttatattaaaagaaagttcatatggaacactctgcttatatgcttcatcttcttttcaatcagataataagttctccaatgtagaagggaaatgtcagcctcacacataaaaatatacctgtcagagattatataagtgtcaaaataatactatctagagaaattcaggacatttggataaataaaggaatgtcatgtagtttggatagaacatagagaagtgaggaaaggagacattcccagatagaataacagctcaatgacttgaacaaggatacagatgcatgtagtatacacagtggactagaccatttatgtgtgtatgtacatatgtgaaaaaaagtctttgaaatgtttgcatttcaattaaattctgattttaagaacttattttccccctgtatcctgtgtgtgctagcattctgtttcctaaggcattctttcagacagacatacctagtcctgaaaatgctgctattattgttccagatacaaagcaggatgtcataattttttttttttactattccaactggaataatatggctcaacttaagttctgtacaaaactacttaatgataactcacaaaattaaaccaatttatattttctgcagttaaaatagaatgcacagatttttaaagacctaggacacattattatatctagttcctgaaatcattaaatgtccatggggaagaaaaaaacttgtgtaagtaggaataatataattggatttgcaatgctctcttaagagattctttaaaatcatgtgaaataagtagagtttctatgattttttaaaaatcacaaatagcatatatccgttttatctttaatagtgtttgagcccatcatttgaaagcattggagcatgtaaccaatatttctgaaaatgaaccatggttccagtcataatctatatgctttaaaattccttccctttattctttcttcccaaatccatgacatctgaatttcaataaggaagaaaataagcatgtttttaaaatgttttagaaaagattttcaaaattagattaaaatgtttgaggaaataaaaacttctttatgtattcattgtgatactgatttttatcaatgtctttttgtaaaaatacctatatactaactttgaataggtccaacatatggtaatgtgttatgcaattaatgataatgtagaacgatgttaaacccacagaatattgccaaggatttaccaacaaccaaaaatgtaattatatagaagaaaagtgtagttacaaatgcagtcttttgtctttttacattctctatatgtagagggtaacagaaatactgtatcactttttagtatatgttctcccagaataagttgccacaattagaacagagtttaggagcctatattaagctttactagttatggttatttccatagtgctagtaaataagagaaaaaaactttttgaacccatgtctcattgtaggtctcctaaaggaaagtggcccaaagtccaaatacttcaataccgttcgtctctgcctgataacaaagtgttttgtttttgtttttaccctcggacaagccagtcagctgatctttgtcctaatttgttcctggtagaattgaacaagatgtttgcagaagcttcctctagtttgaaaattgtattgattttttttccccatagtaactcacagatggcttctcaggttggaaataatggtgtccatgtttaggtaccacgtgttagatcagatttgtactcatggatctgtgattattttaactttttcttgttatttataaaaataattatgtacttctctctggggtttaatgtgtctttttattctcaaaaaatgtagtacattgatcagccacctaaaatactagccctatagaattctaatagttaggttttatatacagccatttgtcgattaaatattaaataccggatcagcttaaaatggacacacaaaaaaacactaccacataagctatacagtgccttttttcacagtgtcttataggtggaagatactcagtgagtgtttgttgagtgaataaaggatcttcacttggtgcatcccatttccttacaatttattattttttattttactttactttgagtcaggatctcactaggttgcccaagctggacttgaacttttagatccaagcaatcctcctgcgtcagcctctcaagcagctgggactacagggatatgtcactatgttcggctttaatttttattttattatgaaagttttcaagtagcaaaagcgatgtaatgaaccccatctacccattactgagattcaataattactaagattttgccacacttgctttatctagtctttaaagaaatttctccactgaatgatttactttaaaatacttgacctcctggccttttactctgtattttaaagaaagctgtagtaatttgtgacataaaccaatagagagcagctaaattttgttatatcttcatagcaattgactatattttggtttgtcttaccaataatttgatgaatgacctttcattttcaatttatctttggtaactaagtagataagtgggagtgtaggtttacttatttaaattctttgaatttgtgtgtgtgtgttgctttcccccccgatagaaactataaatggtagtgttattgtggttaggagtatggggctatggagttggggaaaacatgtatgaatctcagttctactactttaccttttgaatgtgggcaagacaagtctcagagttgttttagtttttttaattttaactttgaaataattgtagaaaaatagcaaaactagtttaatgaattcccatatgttaatatttaccacagctattgtatgtatgtatgtagagtttttttcctgagtcgtttgagagtaagttgcaaaaataatgcctctttaacctctaaatacttgaggtgtggttagtaaaaattcacgttttgttacataaccacagtatatttatccaaaacaggaaattaacatggataaagtattactgtcttatctagagatcttattcaaattttttcagttataccactaatacccttcatggcaaaagaaaaattattttattcttaggttgaatccaagatcacatgttacatttagttgtcatctctagaaactgctggtagtcctagctatttgggaggctgaggagggaggatcacttgagcccaagagttcgagtctgacctgggcaacataataagactctgtctcttaaaaaaaagaaagaaaagaaaagagacagaagaagaaaacagaataagctcatggactgttataaaggcaataaatgtgacataaaggatgctaaccaaaacagataaatagtaaaaggttaaataacagaggacttagctatttgcaagtactgacaaattttcatgattgggcaatgaatgatgtgacgttaacacatctgactttatctttcatgactttgatatttttgaaaagtataggctgcttattttgtagaatgtaccttaagttttttttatgtttccttatgattagatttaggttatgccttttcataaaatactatggatatgacctatccttcatgtaccatattaggaggtacatgatacctgttttatcctattgctgatgatgttaccctttgatcataacattatattttcaaatttctctaccataaagttaccattttccttttgtaatggatctcttgtgggaagatactctgagagtacctaactatcctatttctcattacatgttcacatgctagttttgacatccattcttcctagagacagttattactatggagattgccaaataatgatttgtttttcattccatcattttttctgcatttgttagttggctttcagcttcaatttttatatctgtaaaatgaacctaattgatgtaaaattggttaataacacccaaatcatgtagggtataagataatgcattttattttattttattttactttactgagacagagtctcagtctgtcacccaggctggagtgcagtgagtgacatgattatggctcattgcagccttgaactcctgggatcaagtgatcctcccacctcaggcctccctagtagttgagaccacaggtgtgcaccaacacacccagcatgtatgtgtgtgtgtgtgtatatacatatatatgtatatccacacatacatacatacacacatctttacatatatagacctcatctatatatatatatatatctcatctatatagaagagatatatatagagagatatatagatatagagagagatatagatatatagatatagatatagatatagatagacatagatatatatctcatctgtatatatatagatgaggtctccatatgttgcccaggttggtctcgaaatcctgggctcaagtgatccacccacctcagcctcccaaataatacattgatttgggacaattcttagcacataactctttaaaatattagatattataatttttattatgctagtatctacttttcagttgaagaaatagatcattttaaagatctttgaaaggtcataggaaatgttaaaaatatcaggtattttatgtgtacctaccatgaatgttttacctcatctttggtaaggtcagaagtgagatgatgtaacagccatcatatgtatgtgtattttttttattgacctgagacagtttttggttatttaatgcagaaaatatatttgcagtgtacttcatatgatatgcagtactttaaatacttgttgtaatgtggtcatttaataggagagaaacttagagacatggtaaattaagttttgatttagtatactgaatgatgaaatagaattatttatggtcattttaattctttaaaagtttttaaattagtattttaaaataatatatgtacacagtttactgattttgtccttaagggtatactgtggaaaagagcaataccctgccctgtactttgacagcccttttagctatttcttcttttacctacctccatatttttaatcacctcacctatccaggttagatattatgtacttaccaacttcctactatgataagataaatatttgtctctcttatatacatacattctgtcctctcctcctctccagttctccagtagagtttttgataaatcagttttcagcataaataatattatacagatgtatgtattatttatttctgagacaaattatattctatggtgttttacaacttttagtttctcctagagtttagaattcccttatctttttgtttccttaggtttctttatacctgtggtgacttccatacacatatcttccaatagcttctcacatttattttgtgcatagttaaaaatgtgagttttaatttgtaaaggtaattataaatcatgtgctctgaaagctttgtttttcttatttttttctttctctctctttttttgtttttgagatatagtctcactctgttgcccaggctggagtgcagtggcatgatctcagctcactgcaacctctgcctcccgggctcaagcgattctcctgcctcagcctcccaaatagctaggattacaggggtgagccaccacacccggccaagttcttttgatggctcacatccttcattaactttctgagaaaaaatacaagggagataaatattttgagaaccaaagtgtctcaaagtatctctgtttactcactctggattaatatatgggctccatgtggaattctagtgagaaaatttattttctttagactcttgaaaccattgctctattatattctaaacttacatattgtttttgagaggtctggttcttttttttcctaagcctttatatatgatctgccttttctctagaagcatttatgatctgtctctggttttctaaagtttcatgataaataataatgatgtagatctcttcattaattcattatattaatacattattccctataaatttagacaataagtcagttctgtgaatttttaaatgaaattttacttcctgggttgatcctctatttttcattttttctttctttttgatttttttttccttttttttctctttcattgaagttgagctttttgcatactcttctcaagtgtctggtaatgctggtagtgcatttatatttaagagtgatgcactagacaatgtacaaaatgagacctttcaacttccttagggtatttgagtaaaagacagctttttcataggggaagtaatttacatgcaccttctccagggctatttaatttctccaaggaaaaatggattctctaattttctttttgggtgaacttaagcctaagtactggtcaggaaaagggtcagaagggctatttggtatgtaagtgttcacataaccagcccagcctgttcttagttcagcacttcacccatttccctatcttcctttgtgcttggagttcctgagtctgaagcctttccagttctttcctagcctaccttccctccattattctgcagaggtaggaaaaggacacttgtcaggctatatgaggtgggaatggggtctgaaagttctgctgttaattatctccctattttcagctctactagttacctggtaccaccattttctgaattttccaaggtttggagggtgaatcagcttgatttttgttggaatctcctcttagtaggcttttatactttagctttcttccccctgctaatctaattaccttttctccatatactgtctgacctcagaaattgtaatccaggattatcagtatcttctagtttttttactaatatggttagttgtaatttttcattattgtcttgagatgatttttgataggagaatgtgcagaaatgtttatattttggcatcagaaatatcacctttggagggggcgagggggtcttacctaggctggagtgcagtaatgcagtcacagctcacttcagcctctacctcctgggctcaagcaatcctcctgcctcagcctttcaagtaacttggactacaggcatgtgccactgctatggttttgctctgtgtccccacccaaatctcaccttgaattgtaataatctccacatgtcaagggtgggaccaggtggaggtaattgaatcatgggggtggtttcctccatgctgttctcatgataattaatgaatctcacaagatcagatggtttaataagcatctggcatttccgctgcttgcattcattctctctcctgccaccttgtgaagaggtaccttccgccatgattgtaagtttcctgaggcttccagccatgctgaaccatgagttgattaaacttcttttctttataaattacccagtctcaggtattccttcacagcagtgtgagaatggacgaatacagccaccatgccacactatgtttttaatttttttgtagacacagaatcttgctgtgttgcccaggctggtctcaaactccttggctcaagtgatcctcttgcttccacctcccatagtgctaggattataggcgtgaaccaccatgcctagccagaaatactatcttaaaatcaactctgcataattcactgacccatcattaaaatttgtcagtacttaaaaatagctaagtcctctattattttatttaaccttttactgtgtagtttatttgttttggttggtatcatttaagcctcatttattgcctttacagcagtccaaacagaacctattctgttttctttctcctcctctctcattttttttctcttttttaagagacagagtcttacagtgttgcccaggttggactcaaatgcttgggctaaagtgatcctccctgctcagcctcccaagtagcagagactacagggactacgggcgccaccttgcctagctccccctctctcttatcttctttaccctagttaaattatttctgctttgtcccaaaaaataatatttgtacattactctccacatggctttatggtggagtaagggtgatgcttgagtgtaagaagttttacactgggatgtggtacttttccttttttcacttatagttgttttgaagtttgggcattctttttgtcttcaaattgtgctgaaggcatggtgtttttgtagatttatttttctgtccttgttctatattcttttggagagaaacagggcttaggtggcaaccattgcttcagctgtctggaattcctcaatttattttaactttatataccatcttttctcccacctctctcttcattataagcagactcattcattcacagtatgtttagtgagtgctatgtgccaggcatggttctagggatatggtaatgaacaaatgtctttgccctcataaatattatattctggtggtagagacaaagaataaaacaaaaaagtgaatatatactataatgttaggtagtgattaatgctatgttttaaaaaaataaacaagatgagtgcagtggtacactcctgtagtcccagctgcttgggaggcagagacaggatggtcacttgagcccaggagtttgagtagccactgcacgtcagcctgagcaataaaacaagactgtgtctctaaaagtatagatatatcaatcaagaacctggggaagttctagtgctacctacaagagttgaggaagaccttttcttttttttttttcttttttttgagacggagtctcactctgtcacccaggccggagtgcaatggcccgatctcggctcactgcaagctccgcctcccgggttcatgccattctcctgcctcagcctccccagtagctgggactacaggcacctgccaccacgcccggctaattttttgtatttttagtagggatgggatttcaccgtgttagccaggatggtgttgatctcctgacctcatgatccacttgcctcagcctcccaaagtgctggaattacaggcatgagccactgcgcctggccaaggaagacctctttgaaaaagtgttacattagcaaattttgttttgttatagaatagtaagtacatctttttatattagcatttaccttatgtaaatcattaagattttaccactgatcaggtttccatgataaattgtttaattttaaaacttctgtagtagaatgggcatgtggtgttatggaattcataccaaataagaagaattttacagaaagtaaaaccataagctgtctactattcaactcttctcattctgctttagagaactgctattgataaaagattatttgagaaacatataatctatccttttctctaataactctacactttattttttatttttattatactttaagttttagggtacatgtgcacaacgtgcaggttagttacatatgtatacatgtgccatattggtgtgctgcacccattaacttgtcatttaacattaggtttatctcctaatgctatccctctccccttcccccagcccacaacaggccttgtgtgtgttgttccccttcctgtgtccatgtgttctcattgttcaattcccacctatgagtgagaacatgtacactattcacaatagcaaagacttggaaccaacccaaatgtccaacaatgatagactggattaagaaaatgtggcacatatacaccatggaatactatgcagccataaaaaatgatgtgttcatgtcctttgtagggacatggatgaagctggaaaccatcattctcagtaaactatcacaaggacaaaaaactctacattttatgcttggactatcagaaaaactgtttacttgaaaacagtttacagaaaaactctttaccctgacatgtattgatttgttgctttgtgttttttgagacagggtcccactctgtcacccaggctggattgcagtggtatgatcatagctcactgcaacctcaaactctggggctcaagcaatcctcctacctcagcctccctagtagttgggactacaggcgtgtgccatcacacctggctaaattctgagttgttttttatattgaagccttaatctttcattgaggaataccacaataaacagactgagcttgctgttgagaagttgttgaggacaacatagtcttctgtattaatgtttaacatattaaagaccctatgaaaagtttattttagaatcacgtgtttcttataagaaagtgacatttttggccgggcacaatggctcacgcctgtaatcccagcactttgggaggccgaggcgggtggatcacgaggtcaggagatcgagaccatcctggctgaagcggtgaaaccccatctctactaaaaatacaaaaaattagccaggcgtggtggcgggcgcctgtagtcccagctgctcaggaggctgaggcaggagaatggcgtgaacccgggaggcggagcttgcagtgagcagagatcgcgccactgcactccagcctgggcgacagagcgagactccatctcaaaaaaaaaaaagtgacatttttatctcttcaagcatgaaaagtagataactaggcatgtcttactttttgctttcactgtcaagaaattggaaacaaattcagagctaattcaagacgcctctgccatgtatttctttttctccccaatcttatactgttctgttttctctgatcattttttttaggttgtctcactaattatggaacaatggcagggatgtgtatgaaagagtgagcaggtagataagtcaatagatgaatgctgttgcctcctcaaatcattagttgtatgagcttgggtgagttaaacaacctttctgcactgttaatttcatctgcaaaatgagaggattaatagatcaaatatttgtagctgcagaactctgttttcatgggaaataatttggaagcccgaaatagaagccaagtagtagcagaactgttgtgtcaggccagtgccatagtggccgggaaactaagcctcattttttatccagatcatattagaactgcctcttggaacaaagaaacactacctctagtgtttctgcaatacagtgttctgtattacagccttgactactctactttttcccccactccagtcaagttttacattttgtagtaggcctcctttttgccatcttcgtgaagattctgaattttcctggatggataaaaatcataaggataataaatggatatttcagtgtttttttagtcagtggtttgcaaaaccacctggagggcttgggaaaacacaggttgctgtgtcctacccacacaggtttctgattcagtaagtctggggtatgaccaagatattgcattttgagcaactttccgagtgattcagaaattatactttgagaactactatcctatgtgagtattaaaaatgtattttagtcacttttcttattttaaaaattacatcaaatcatataacttcataaagctcagaaaacaatgtctgagtaatatatggtttttgaaaaataacatttaagtgacatattccgatgtcatggagcaagtgagaaactggtttgaaatgtttgctatctagtgtcaagggctatctatccctttttgacttcttgtgctactggtgcaaatggatagatattaatcctgcagcaatcaggatttgcttcagcaataaagaaattattgatgtctgaaagcaatcctttccttttgacatgttggcagcacctaagaagaaaatgtcagggtcaatataagtgcatttactgacagtttggctctttcctatgttacagaaaatgatttcacatttagcttttatcaaaaacagaaacactgaccactctgaaggatataaacaatagctttcagcttagtcattttccacttataaagtgatactttcatagaaataaacaatgcaaacttcagagagccaaaacaattacacagaaaaaaatcattgcatttttgccatttttaactcagatttaaaacaactgtgtctggtagtaactggagaaaaatcactgttttgtgttctgttaagttaaaacagttaaaatcactttatgataaaatatggccaaaaagaagaatcatcttcaattaggtacttcaagatcacttgtattctctgcttctctttcagagcctgatccatgtatttcttaaacttcttcatcatatataaaatttcgtgtttataaaatttccactaaaacctcaattattagtttcatgaatcagaagttacaattagtttcatttctggctcaccaagatttgtcaatttctggataaaagggactccctattcagaatatccctttaaatcttttttaaaagtgcacctttgatgtgtacatgtttttatgttatttatggcttctgaaaatattatgcaaaaaaattgttatggaaacaacccaaatgtccacaagcaggaagatacattgtgatagatccatacaatggaatatcattcgttcataaaaaagaataaagtactgatgcatgatagaatgtgagtgaacctcaatatcaagaaaatggacgaagccagacataaaggatcacatattgtatgattccatttatatgaagtatccataataggtaaatccacagaaacaaaagcagattggtagttgccagggacttgtggggagtgaggaatggggaataactttttaatgggaagatagggtttcttcttggggtgctaaaaatgttgagaagtagatagaggtcatggttgcacaacactgtgaatataattttatgtgaattttacctcaattttttaaagaaatcagttgatttaagacttaactgaattctagaatttttgaaatgaaggtgtttctcaaggtcatccaacccaatctcctgtttttcacaaatgaaaaaactaaaactcatcaagattaaatactatatatcactaagattgcctagtagctagtccaaacccaggccagaatttgagtatctggatttttagcccagtgatttctttttaaactactgcatgctgctttattatcaattgctattttttttaaatttttttctgggaacatactacaagtgttagtttaaaagtaaactaacataaaagtaaatacaaaaagaagcatagcttcctttgtgccacatataagaaatgtagacatagagagtgtttattgcagtaatttgccaaaaagcaagccatagtttaaattagaagaggtttattccctgcagcactttcacaatcacagaaggcacctatattttaaatgtagtctacattggcctggcttatgaactgcaaccttctatgattgcaattcacttttttaaattaaaaaaaatttcaaaataatttttgcataattattagcacattctaccacttgataattttttgtttctttcaatagacgaaagcactcacattgtaaaaaaattatataaatgaccttgtcttgtgatgaagctagaagatctgttttcaacgaaactattctcagaggcatctagggagaaacatttgagtcaggttgggagttagagatagaaagcagcagcaattaaagcaagataatgtattaccccctggaaattgggtgttatactcaaatgtaaaggacttgtattgatttagtgctagcctcagaaaatagtcagatgtcctcattttaagggaaaactttaggaaatgtaattatatcgtttctttctctctaaatctgccttagttttcaatttctttatgtagttcgttactaagaggaagctacactctcattaccacactaaatggattttctattaatatttatctccaatgttatttttatctgggttgttgttttcatttctacttagtatgtattttcttctttccttttagttcagaggtcaacaaagtatggcctatgagccatacgctacaatagcagagttgagtggttgcaacagataccatgtggcctgcaaacctaaaatatttattggggcattttacagaaaacacttgccagtccttgctttagttgaccaagtagaaaaggaagagcagattctacagagtgaataaatatcaccagcaaaggaaaggatatagaaaggtacaggatttatacttaggctagctagaaactccatatggtcaaagtaagagttttgtggatgtgagtcatcagagattatataggaaagatagattactgtcagatttagaggatttttaatgccacttcaggaacttgagctactattgtttaggaaatgagtcatttaaggttttttgaacaaaggagctttgccagagcaggaaagtgttgcagtagggtttacaaagtaatgagagttatcaactaaagttatattaataggaaggatgacatagttccaggagttgctgtataattaaaattgataggaccttagacactgcattttgagacaaagagataatagtttaaagattaaaacttcattgggcagaaaaattattatttatacacatattagggaagtaaagagctaatttttgtggaaggtttaagttgatggagaaggattataacactacataggataagaaacaaaactgattactagttatcagcattactgaagttgttcactcatcccaggcacaggcaattttttactcgccatattttatctccagggcacccagctgccatcatcttgtcagggtccatctctttataaaatcctcttactttgctctccagaatcccaccctgatacacagatttacttacgctacctcatacagaataaagtacttccattttccaagtactctgaaccatgctcaagaagggctttagctctctcaaataaaaagacttatctcaaggtgtttaattcaagtagagccacagttccgaaactgtgcactgacaccccagggtactgcagcagactcacaagagtgctacaggatattttatatcggtttcaaaattaaattttgctacattccttttggatgatgtctttttaaaaaataattactgttgttgttttttttttaatatgtacctcctgaaaaatcaatgcagaatgggaaatgaaggtagcagtatccacttggaatacaaggcttgaagagtgtgcagtattccataagcatacatattcatttagtaaatacagttaacccttgaacagtgccgggggttagaggcactcccctcccccgggtagttgaaaatccatgtataacttttgactccccagaaactttactaagagcctactgttgaccagaagccttacctgtaacattaatcattgatgaacatgtattttgtatattatatgtattatacagtgtatttttgtaacacagtaagctagagaaaagaaaatcataaggaaaatatattcattgatatggtttggctctgcttccccactcaaatctcatctcgaattttaatccccataatctccacatgttaagggagggacctgttaggaggtcattagatcatgggggccatttcccccatgctgttcttgtgatagtgagttctcgtggaacctgttagttttataagtgtttgacagttcctctctcatgtgccctctctcgcctgctgccatgtatgacatgcctgcttccccttctgccatgattgtgtttcctgaggcctccccagccatgcagaactgtgagtcaattaaacctcttttctttataaattagtcagtcttgggcagttctttataggagtgtgaaaacggactaatacatttattgttcattaagtggaggtggatcatcataaacatcttcatcctagtagtcttcacactgagcaggctgaagaggagggtggggaagagctggtcttcctgtctcaggggtagcaggggtggaaatgatgaaggaggtggaaaggatggcagaagaggtaggcatactcagtgtaactttacagaaatacgttgtaatttctgtcttatttttcatttccctaaaaatgttactctaaaaatgtttctatatggcacctatccttccaccttttgcttttggttcagtgcccatatcatagaagggtccatgttgtaaaagaagtcaaaagcagtcttttgaataactggaatcattctgttatatggtctaatatgaatttgtttctggcactacttattctacatcttctttctcatcatctggcactgatttggaagcactcatctccatcaagtcatcttctgttaattcctgtgatatggtgtctgttagctcttgaattactccaagatccgtatcttgaaactcttcaacttccccccacttttttttttttttttttgccatatccacagtctcttttatgatatccttgattgactctgttgtaaatcctatgaagtcatatacaccattggacacagtttttctctagcatcaatttatttttttgggcttgatggctttcatggctacttttgtaacaatggcgttttccatgatttgattctttcagatatccttggtgttctctaagttgaggtctacttccatagcattgacaatcttttctatagattaccatgtgtaatgatctttaaaggtccttatgaccccctaatctagatctgaattagagatattgtgtttgatggcaagtagaccactttgacacctttgttgttgaactcctggtgtgggtgacccggggcattgttcaatatctaaagaaatttaaaagacagttccttactgacaaggtacttctttgtcagcagaagttacttctcctcttatccattttttgaagccaaacctctttctaaaaatgtcaagccatcctttgctgacattaaattctccagctttaaatccttcaccttccttttgctttaagttgtcatataatgacttcaagtcttactagagtatgcctttcttatagcaattctgtactcacattgtattttaaatataagataaaaagatattttacagaaacttcaaggttttcatgcctgctgtcgtagctgcagtgatggctccacaaagtcctcccccaaccacaatggtccttacactggattcatctatcttgaaatggtgggcaaccacagctgcagacctcaatctacggtacatatcaagcaagtcagcttttttttgtaatgatttttctctgcttcttgggagcacttccagcatcactagtgacatttcatatgggtcccatggtgatgttcaagatttacagtattgcactaaacatgatgaaaaataattcaagaaccatgagagatcactttttattgcaatatgcaatttactgtaagatgtagggttcactcagagatgattagcatcagatgtcattttcaatggatacaacacttgagctcactgcaaaagcaacaggtggtagttacaacgttgttacaatagtacagtatttactgcagttcattttatgcagttaggatttaatactgaatttttacatttgtttacatttctcttgactcaaatgctgccgtgtatggtctgtaagtgtttgcctgtgtaagttttgatagattttaactttttataatacatttttatagttttatgatagtgataaaatagtatctacatatactttatgagttcatgacatacttaacaatttttatcaatatttctaggctacacagtttgtctgtagagtatttcaaactatcacaaatttccaaaaaattttctgatatacttcttgaaaaaatttttacacacaagtggatccatgcagttcaaacccaagttgtacaagggtcaactgtattgtagttattttttaatgagattttaaaaacttttttcaatttatatgtatttttcttaactgagtattaaattctgaagctagtacttattaaattgtttggacttaacattaaacaggactgttaggcatttgttagcataccatgaaaaaatgaaaaaaataacaaaaacactaaaaacactgtaaactgggaaagtttcagattctctgaatttgagagagttgttcaactctaaaatgaatgcattcttccataagcatgtgaaaaggcagcagtctttcttttttctctttttttcaaaattgctttctagactgggcacagtggctcacacttgtaatcccagcattttgggaggctgaggtggacagatcgcttgagcccaggagtttgagaccagcctgggcaacatggtaaaaccccatctctacaaaacatccaaaaattaaccaggtgtggtggtgcacacctgtagtctcagcttctgtggaggctgtgaggtgggagaatcgcttgagcccaggaggcagaggttgcagtgagccgagatcgtgccactccactccagcctggtgacagtgaaatcccctctcaaaaaaaaacaaaaaaacaaatttgaaaacacattctagtgacatgggattttgtgtagcatcttaacaaaaatgtaatcacatatttaaaaattttctgtgctttttgctgtatcaaacaaaaaaagtaagaagtgctcttccctttaaggttatggtcaggtcagagtggtaagacaaatacaagttgcttatatcattaagtaaaataaaataattaccctcatttatttcataatatcacatattatgggcattcaaagaagaatgtgtacatctgttagtgggaatgaagaaagaatttgttagattttaaatgggcattgacatgttggtaaattctaacatgtagaggtagtggacatttcagatagaaggaaaaacataaaaactcaagatttattttgggagaagcaaattattctatatgactgaagcaaggacatatgttatgaagtaatgtagattacagctggtttactataagttggagtactatcgtggagcactttgaatgctggggtgtgaggcatttggattcaatttactaggaaaagaagagtgattagggtgattaatctgtcagcaagatataggatgattaaatcaaggagagaaaggaggcagggatagctttttaaaagggaatgatggattttgctttatgtatatgtatttcaaaggaaacaccaaactgttgatctttaaagagcatacttttgttcagcactgtaactaacagttgtaacataaaactcacttttctgatgggaggcagaagactttctaactttcttgttatttctagaggaataatatcaatacaatgtaaatatgtatggaatgcatactataggccaagaactatattaagcatttatttaattctcacaacccttgagagacattattattcccattttacaggtgagaacagtaaagcctagtaaagttaatgttgtccagagtcacatagttaataagtagacagattagcaaaaatttttaaaataagtttactagttggtttaaactaaggagaattgagttaattctccttgggtcttatcaaattatcttcatctgacttaggcatagtttctctctttttttatttttcatatcactcctgatctcttcccaccatgggtactcttaatgtgtttgatatggctcttacatttggatgtgtcctttaagactgtattgtgttattttagatgcatgcatatgtgtttaaattatacataatatataaaagggtaaattatagcttgtctgatttgatatatatgtttctactctattgcttttatatttttattttataagaaacacacatttttattttataagaaacaaggtcttgctattaatatgttaccaagaccagaatgcagtagttattcacaggtgtgatcattgtgcagatagccttgaactcctggcctcaccctatcctcccacttgagcctcctaaatagctggaactacaggtgcatgcagctgggcctggcttagtttactgcttttttaaaaataatttacaaataataattgtacatattcatggaatacattatgatttttttttttttttgagacggagtctcactctgtcgccaggttggagtgcagtggcgcgatctcgcctcactgcaacctccaccccctgggttcaagcgattctcctgcctcagcttcctgagtagctgggactacaggtgtgcaccaccatacctagctaatgtttgtatttttagtagagatggggtttcaccatgttggccgggatgatctcgatctcttgacctcttcatatgcctgcctcagcctcccaaagtgctgggattacaggcgtaagccaccgtgcccggcccataatgatgttttgatacctgtaatgtatagtaatcagacagggataaatagcatatccatcatctcaaacatttatcatttctttgtgttaagaacatttaatatcctccatctacctatttaaactatttaatatatttttgttaactaaatagtcatcctgcagaggtatagaattctataacttactcttatctagttgtaattttggtatcctttaacaaatttttccctatccttcctttccccctactttcccagcctccaatatcctctgttctaccttttacttctataagatcaacttttttttatcttctacttatgagtgaaaacataccatgtttaactttctgttcctaacatttcacttaacataatgtcctccagttttatctatgttgccatgaaccacaggattttatgcttttttatggctgaatggtttttctttgtgtatacattacacattttctttatccattcatttgttgttggacacctaggtttgttccatatcttggctattgtggatagtgctgcaataagcataggggtacacatgtcccttaaatataatgatttccattcctttggataaattcctagtagtaggattgctggatcatgtagtagttctacttgtggtttttaggaaactccaactattctccatagtggctattcccaccaacaatgtattaagagttcccttttctccatcctcaccaacatttttttttctttttgataatagccatcctaactggggtgagatgatacctcattgtggttttgatctgcatttctctgatgattagtgatgttgggcactttttcatatatttgttggccatttgtatctcttttgagaaatgtctgttcagatcatttacctattttttaataagattggttttttgctattgagatgtttgagttccttgtatattcttagtattaatcccctatctgatgttatgaatagtttgcaaatattttttcccattctgtaggttgtcttttcactctattgattgtttcctttgctgtgctaaagattttcagtttgatataatctcatttgtttatttttacttttgttgcttgtgcttttgaagttgtattcataaaatatttttccagatcaatgtcctaaagcatttcacctgtgttttcttctaggagggttatccttttaggtcatatatttagttctttgatcatttttttgagacagggtcttgctgtgtcacccaggctgcagtgcagtggtgcgataatgactcactgcagccttgacctcctaggctaaggcagttctcccgcctcagccagctgagtagctgggactacaagcatatgccaccatgcctggctaatttttatattttttgtagagatagggtttcaccatgttgtcgaggctgatctcaaactcctgggctcaagagatccacctgccttgacctcccaagatgttgggatcacaggtgtgagccaccatgcccagcctctttgatccactttgagttgatttttgcatgcagtgagaggtagaagtgtagtttcattcttctgcatatggctatccagtttgctcaggaccatttattgaacagactattcattccccaatgacaattcttggcacttttgtcaaaaatcattttgctgtagataatgtggataaatttctgggttctctatgcctttccattggtctatatgtctgtttttatgctggtaccatgctgtttgtgttattatagctttgtgatatattttgaggtctgatagtgtggtacctccagctttgttctttttactcaggattgcttcagctattcagggttttctatgtttccatacaaattttagaatttttttccatttctgtgaaaagtgtcattggtagtttgatagggattgcactgaatctatagatgtctttccatttatttgtatgcacttcaatttctttcatcagtgttttgtaatcttccttgtagaggtcttttatcaccttggttcagtttgttcccaagattttattttcttttctagctattgtaaatgaggttgcctttttgaattcttgttcaactactttgttgtttatgtacagaaacactactgatttttgtgtgttgattttatatcctgcaactttatggaattcatttatcagttctaagagttttttggtagagtctttaggctttttaatatgtagaatcattacatatgcaaatagggacaatttaacttccttcttctcaattttgatatggtttatttctttctcttgcctaattgctgtggctagtacttccagtactatgttgaataagagtggtgagagagggcatcattgtctgttccagttcttagaggaaatgctttcaggtttcagtaagatgctagctgtgagtttgtcatgttgaggtaatttcaacatgttattatgttgaggtactttccttctatacctaatttattaagagtttttatgaaggaatattaaattttatcaaaagcattttctgcttttcattgagatgatcatatgatttttgtccttcattctattgataggatataagacattcattcagtgacatatggtggaccatctttgcattcttgggataatcctcacttgctcataatctttttgagacactgttgggttcagtttgctagtattttgttgtggacttttgcatgtatgttcatcagggatattggcctatcattttctttttttgttttgtccttatctgtttttggtatcacggttatgttggcttcatagaatcaattaggaagtatttcctctgcttcatttttggaataatttgggacaaattggttttaattcaacagtgaagccatccagttctggactttttttttttttttttggtgttggaagactttttgttattaaatcaatcttgtttcttgtcattggtctgtttaggctttctatttcttctttcagtcttggtaggttttacgtatccaggaatgtgtccatttcctctaggttttcaaatttgttggcatatagttgttcacggtagtctctagtgatcctttgtatttctgtagtatcttttgtgatgtctccttttttgtttcctattttaattatttagatcttctctcttttttcttattctagctaatggtttgtcaattttgtttagaagccagctttttgttttgttgatcttttgtattttttttgtcttatttttgtttatttctacactgatcattattatttctttccttccattaattttgggtttagtttattcttttctagttctttgaggtttatcatcaagttgtttacttgaaatctttcttgttttttgatataagcatttattcctataaacttgactctgaatactgtttttgctgtgtcccataggttttggtatgttgtgtttctgttttcctttgtgtcaaagaatttttaaattttattcttaatttctttctttatccattggtcattcaggagcatattgtttaattttcatgtaatggtatatttctaaatgattctcttgttatagatatctaagtttacgccattgtgttcagataagtacttgatattttgatcctttaagaatattttgagacttctattgtgtccttacacacgattgatcctgagactgttgaatgggctgatgaaaagaatgtgtattctgccactgttggctgaaatgttctataaatatctgttgtatttagtctatggtgcagtttaactctgatgtttctttgttgactttttgtctacataatctgcccagtgttgagagtgggatgttgaagtccccaactgttatttcactttagatctaataatatttgctttacatatctgggtgcttcagtattgggtgcatatatatttacagttgttatattctcttgttggatcaatccttttataattatatagtagccctctgtcttcttttacagcttttgacttgaagagtgttttacctcgtataattatagctattcctgtttgcttttagtttccatttgcactgaatattttttccatccacttccagtctgtgtgtgtatacaggtgatacaagtttcttgtagatagcatataattgggtcttgtttttttaaaatccattcagctagtatgtatcttttaaatgtggaacttaatctatttacaatcgtgttattattgataggtgaggacttactcctgtcattttattgattgttttctggtggtttgtatatcctttgttcattactttctctcagtgttatttttgcagttgaatggttttctctagtgaaaaggtttgattcctttctccttctcctttgtacagcagctctatcagtgtgttttatagtttcacatattttcatgatggtgattattgtttttcatttccacatgtaagacccccttgagcatttcttgcaaggccagactagtggtgatggattcccttagttttgctagtctgtgaaatattttatttgtcctttatttctgaaggttagctttgctgggcgtattcttgggctaataatttttttcttctagtactttgactatattatcctgtcctctcctggactataggatttctgctgagaaattcactgttagtctaatggggattcccttatatgacttgatgcttttatcttgctgcttttagaattctttctttgtctttgacttttgacaatttaactgtaatgtgccttgcagaggtcctgtttgaggtgaatatatttgagctttctcgacttggatgtctctctgtctttctgttattatttcattaaatatgtttttctcacctttcccttcaccttctggagatatttatttgcttaatggtatcccataaatcctttaggctttttcattctctttttttttttaaagttagtctgcctgtgttatttcaaaagatcattcttcaagttcagaaattcttcttcttggtctagtctgttgtttagctctttattgtattttttatttcattcattaaattcttcagctctaggatttctgcttcattcttttttatgatatctgtctttgttgaatttctctttcaaatcataaactcttctcctgactttgttgagttatctatcggtattctcttgtatcttattggatttctttaagattattattttgatttttttcccacatttcatatatttccttatagtttggagtctgttactagataattattgttttccttttgacattacatgttttcttgctttttttccttcttcttcttttaagacaagttctcattctgttgcccaggctggagtgcagtggcacaatctcggctcactgcagcctctacctcgtatgctcgagtgatcctcccacctcaactccccaagtagctggaactacagacactcaccaatatgccctgctaatttttgtggtttttagtagagacagggtttcaccatgttgcccaggctttttcttgctttttcacggttgatgtgtccctgtgttgatttctatgcatctggtggaaaagtcacctcttttaattttatggaatagatttcataagaaagaatacgaatgagtcttgggttgttggtttggtggggtacattagccttatttctagatacagttttgtagtctctgagtaatttcttcagctgtaatccactctagtggcatttgtgagtttctcagtggcatgggctgagagagtttgtggcaatggtgatgccactttgccaggggtgggctcactagactgtttctcaggtctggggtatgtatgtgcacatagtaggtcagccaacttggttggtgagattggcttactgagactggggccacaaggctgttactctgaccagaaatacaagtataaggttgcttgggcaacctggggacatgcctgccaggagcagctttcaggtcggggacgtgggcttttggccacttggctggcttggagatattccctgtggcacgggggcagtctgcgggactatctctcaggccattattgggggtaaaggactgttgggcaggccaagggcgtgcctatgggggacctgtgtgtctgtttctcaggttctgattgcttgcaggtagccctactctgctggccctgggccatatcaccttctcagaggctcagggaggtctcctgcttagagaagggagcccagcagtttggccagcttaagagcaggcttgctgtgggtaggactggcagactggtttctctgttggtggtatggccatggttcttggttttcttgctgtgcaagaccagaataacagccagtccagggtccagccttcaccagcttggatcatggtgttcagaaacttgtttggagttggcataatgaagatggagccccagttctggagaggtgcagtggccactttccccccagaggagggcatactacacaggtggctattctcaagatgacgccatgttacagcagtttggctcacagtggtgggatggggagtacacaccttgtgctcttaatccaggtcagtgcgtctgcatgaattcctggcagctctccaaaatgggctcagggcttgtgaggactatgggattcttgtgtagtaaggccttcatgtgtttgtggtggcaaagaggctggtagggatcttctgctgacttttttccctgcaatagcaattccctcccgtctccaggcagatctgatctaggtggggaagatgggaccacgagtttgagtgcctctatgctgccttcctagatttccaatcaccacaggtgcatcttcattctatcagtgcaccccactactcttccttcacactccagtcaaatcttagctgtttgtttgttgccttgatcctttttttgtgtgtgggttagacaagcaccaggtatccctactcagccatcttgctgatgttactcctttattgcttttcttttcttttcttttctttttttttttttgagatggagtcgcgccctgttgcccaggctggagtgcaatggtgtgatctcagatcactgcaacctccacctccttggttcaagcgaccaagtagcctcagcctcccaagtagctgggactacaggcacccaccaccacacccaactaatttttgtatttttggtagagacgggagctcaccatgttggccaggctggttttgaactcctgacctcaagtgatccgcctgcctcagcctcccaaagtgctgggattataggctggagccactgtgcccaactcctttattgcttttaatctctgcatagtagtgtgtgtattagtctgttttcatgctgctgataaaggcatacctgagactgggaagaaaaagaggtttaattggacttacaggtccacatggcttgggaggcctcagaatcatggtgggaggcaaaaacagaaacccctgagaaaaccgtcagatctcgtgagatttattcactaccacgagaacagcatgagggaaaccaccctcatgattcaaattatctcccaccagtctctcccacaacacgtgggagcacaattaaagatgagatttgggtgggaacacagagccaaaccatatcagtgtgcattcaccacattctcatcttttcccctagaaatagacttctaggatttctcacactttatgttcaacagagctatataaatatgctcctatgtattcccttaaagcccatcttctttctactatatctttttcctcattttacttccttttttgagggagttatgtgggatagaagaaaaatggacttcttcatttataacatacctgaagttgggagtattttaatccttaaacagattaaaatgagctgggtgtggtggctcacacctgtaaccccagcactttaggaggctgagggaggcgtatggcttgagctcagtagttggaaaccagactgggcaacatgacaaaatcctgtttctactaaaaatacaaaaactagctgggcgtcgtggtgcatgcctgtagtcccagctacttaggaggcagaggtgggaggatcacctgagcccaggaggtcgagggtgcactgagctgtgattgcaccactgcactctagtctaggcaactgggcgagtctctgtctcaaaaaaaaaaaaaaaagagtaaaagatatgcagactatgtgattttctgcttccaaaaggaaccacatagacaggaagaagatccaagtgaattattctcttctatttctttacattgccttctgtcattggtaacataacctttatggcattcacaagtatatttgttctagctttcttcttttagtaattctgttgctgtcgtttgtgtgaaatactgcatattataacattgtaattataaatgatttatacattatcttaatcgttgtcagggccaacgtttttcttacaagcagataggaactatgctttgttgtaactcatatttgatcgactctgagaacaaaatgtattttatactttcttggagtagtcccacaaaacatgtaggacccattaagaggaagaaagcatgctatatggttgttatatttgttatttttgacttgtaatttattcattctctcagccctgttctctgactagtgttactatggcacctaagttatggcatggaaaacaagctaattatgttcttcagaacagacgacagtgatacatcttgagacacaagcatctggtagtcttagccctttcctcatcagtgctagtctaggcttggttgggctctctggttgtccaaatatttttctgttacaacacatccttctttattttatttttcttctataaatagtggtttatgctttctaaagcctctagtctcatatttagtttgttcctttttgagccttctgtctactcaaagaagtaatatagacttactcccagctgtgtatgatctactcttactcctgtttattgagttaagctttttactatttgtaaacatctcttggttgtgtagacacaaatacaccaaaactaaaaatggttaaattggggtgaaaacttacggatatttcttacaatttatttttcaaaattcagtgatgtagttagatggctctcctgataaaaattgtttaagagatatgagtaatcaatacttttttatcagaagtgacatctaaccatattaccaaattttgaaaaacaaagaaaatattagaattatccacaatttttgtacctaaacttaaccagttttacttttgtttattcccttataatcttttttactattgatttaatgtaggttataatcatactgtgtacacactatttgtatgtcttctatttaattgaatatttatgtgccataagcattttctactttactacttagttttcatcatcatcatcatttgtaatatctttaaaatattctctggagtggtgctattcaatagaaatataatttaaaattttccaggacccatatgaaaaatgtaaaaagaaacagcttaataatggattttatttaatctaatatatctaaaatatttattgtttcaacatgtaaaaattatataccgtattagacataaaaattattagattttaaccttcttttcatagtacatctttgaaatgtacctattttacatatataccagtgaattacgtcactaaactttcaatgtcaaaataaaatgtagtcctaccaaaacaataaagctccagcagaaaaatatgaaatgcttcaatttttacatttaaattaatgaaagtaaattaaaaatttagtttcacgatcatactagccacgttacttatgctcatcatgtacatgtagcttcttcatttaaatttaaattacatttaaaattcaagcctctctttgcactagtcacattttaagtgatcagtagtgagctttagagtatatagccaattcttgactgttcctctgtcatttttttacattgatttcaatgaaataagtacactgataagtttatgaatgtatattttcccatgttttggattactttcttaaagtagactctcagaagtagaattactgggtcaaagagtataatcaacccttcttcatcattgttaccatattgtttctttagttactagagaggaatatttctctacatatttatttactatgtatttctctttcaatggaatactttttaatgttatggtttatttatctattggtgtcctaatgtttgtttaatttttagtctacttttaaatttctttgtggactaaagatactaacgctttgtcttgtttttcctcatcttttgtttatttgtttgtttttttccttctgggagtaccaactgaaccctttacttttactatagcaaatatttagataatacttcctctgtaagcttcaaagtttttcccactctagaagtttgatatttacttctcttttatcatagattttctatgtatttttaaaaaatgtttttatcaaactggaatatatgattatgtaattgtgagaaaataaactaaattacaagttcttaaccttcagttgaatccagtgcttacccattatttttagataaagcctcattatatatagttgctgaccaccactgcatagttttacgcatatgtgtagttaatcaggaagtagatggacccaaatagattaaaatctactgtttcaaatatttcaaaataatatcatatattcttccctattatattctgatcagaatattgttctcagtaaaaacaaagtcttttttttttctatatcaccatgtatccacagttgattaattatagtcatggttattttacataggtttatttccttttgaattaatatagacttatacttccaagagttataaataactgaaatttacatagttgtgtatgcacacatacacatacacatacccctattcctcacataattggtaatagaaataatgaaaagaggttgtgttcttaggcaaggacaatttaaaagaaccccaaatgattaccttgaattaaggtaaacactggtaaaaaaaaaaagagcaaaaagggcaattttttcctttagtatattaaacaatgttgtttctaacattccctcacgtttagactactctgaaaaatccttagagtggttgtgtaatgtgtttaagttttttcgatttccaagcattaagtctggctccactaaaacggttgtttggttctattttagtctgtccctatctgtcctactgctaccactttgtgttgttttgttttctgttataatgaatacaacagtcccacttcattctcagttctaattaacgttatccagcctctaagtgttagcatctactttgcttttggttataggatcaacgataaacagctaactgttgtgcagactgaaatccctaattagtaaagcacaagattttattggttatatatttttctaaactatagacttgattttgttgcaaaccttacatgtagaaaaaaaattttgtaatggcactgtttttatttttggtgatactatagtctggaacatgtggcccagcaaaggttataaatctagcaagaaaaattatggatggcatcaattttaacagtctttgcgatctaacagagcataaaccccaaattgtttaaatactaaatatttacttaaagaaaaacaagagatcattcaaaaatagaatttaaatagtgaatttgccttttatttaaaagttgacaagttttgtatatttataaaattaacaaaattgacatcatactatccatatcacaagactcttgtgttgtattttaaaggaaaacacacacacagcatacatacatttggattggggccagatttagactccaggggcacagtgttctgtaccttaaattacaatcagatgtattttagcacagatcaaattttcagtctgaagttggtgagaagcctaattatttgaccaggttactatttatgtagaccattctgtggctggctgtggttaatccacagctggcagaatgctagctatgggaggtttttatttgatgctggaacagtttggggagaaatagagggggaaagctttaaaatcttctcattaaatgaaagactaaaaagcaagacagtacatccatattactatggagacaagatgctgtataaactgttcgttttaattctccaagtgacagaaatagcaaagcagcagcttggatgctcatagtttgcaagtgataggatacttggttaaaaaagaaagataaaaacatttaaaaataataactaagactaagatttgttgcctcttagaacacttgaatattggtaaagaattaatggattcaatttttaaatgatgagaaatattgttattatacaaaaacattttgtatttcactaaacatactaaaacatttagaatttcactagcagtactttaaagtgataagaggcagttgtaggggagaaaaagtaacatattttcctcatccatcgcaagggtcatgactgaaccctctgtaacgaaacagattaacaagagaaaagcataatttatttaacaaagttttacatgacacaggagccttcagaaattaagacccaaagaccagcaaaaactgtatttttatgcgaagtctgatgaaagacatggatagttgtagagaaacattagacaaaaggggtatgatctaatggtaataaacctagggttgaaggatgtggaagccagcaagtcctgtctgttagattattcttggccaccaggtataggacaggacccctttggaaaagggttttatggccagctttcacacagaaaggtgggagaaggtcagagtgaccttgcttctgcgggttttctcaattgctagggggccatattttggggtattgtattctgggccctgacacaattatagtagacgattctctcttaacgtctcagaatatgtataaaggcaataaacccttccttaaaagatggaccccaatacacatggctcctgccactaaattaatttttttagtcttcttattgtagtctatttgaaatttgaaagtaatattttaaaagatttttttttctttttaaacttttcagagtttgcattatggaaatcgttggtccctcagttataagtgaatatctcagtagcatttttgtaacttttaacagaagtttcttttatattttcaaggttatttcttccatttataagccagttcttctccccttctagtttccagtgctcccacttcctctagttctttgctctaattatcctctctcccttgcctcttcattcttctatttctccaatagatccttttctttgaaaagcaaaatctttccaactttccctgcccttaaaagcaaatctcttctttcctcccttccctgcccacccttccccgcaaaaaagcgtttgtgccttttcctcctcttattatctgctcaaattagcaacatatctggagtcatatgaatccaggcttcatcacatgtaagctgtgtgtcctaagaaacatctcttaacttctctatcttgctttatttatcaaaagaaactaatatgtccacctcataggtttgatgtaaggaaaaaacaataactgagttgctgtatagtatagtgcctgggacacaataattactcattacatttcagatggttttattatcattactgatgaagctttgaaaataattattcttaccttactttctcaccattccttttttaacaactacttctaccatcatactaagtgctttctgttaatcatcaaatcttatgacttttactcattcctttctttctctacttccccatagcaccttcttaaaatttcccttgcttagtttctccaccatcacttctcctctcctcatttggcctcctcttgttttctccttttccttttttatttcctctaatttttgttctccattttttccttcgtcgtcttttgttctgtgttctctgccttgggaattacaccacctctttgacctcacctctttcatgacctttcctctaagtccaactttctggtagatacttagagatcccttagaacctcaactgtagtatgaccacaactaaacactctttaccatctaagccagatcttattctggaattttccacttttattaatggtagaaccagattcaaaaatctcaatcatcttttgactcttttcttctttgccttccacatcttaaacaattgccaagtcctgtatgtagtactcctaatatggttttcttttacacagccaaatgtagacatttattaactgttgctgaattgttgctgcccaggttaactttgctttaaattttcccataagcttgttattccttcctttcacggaaatattcattacccatgatccacccctacccctcttgcacattgcccaccaaatagattcctaccctgccatccaaggccctttgtattcttaacttcgccgaccttttcaagtctctattattgccctttgtgtattcctttacttgtttgtgcaccatccaaactaatttcctgtatatacatgtatgtctttgcttatgctttcctctagaaagcatgaatatgttttaataagactttcattaatattaaagctgtacataaatagcattttaaatgcagctttcctgacatgaaattttaaagaaatttaaagaaaattttaaagaaaaattaaatatttttcttttgcattactgcattcttttctcattatttgaaaattctaattcagaatcttcctcaaaaatcaatttagatatttcttaaggtaacaagttatgattgattgattgattgatatagagacaaggtctccgtgtatttcccaggctggagtgcagtggtgtcatctcggctcacttcaacctccaccacctgggctatagcaatcctcccgtctcagtctcatgagtagctgggaccacaggcacacaccaacacacccagctaatttttgaaatttttgtagagacagagttccgccatgttgcccaagctggtttggaactcctagactcaagtgattggcccaccttggcctcccaaagtgctggaattccaggtgtgattcattgtacccagccagaagttatgatcttaattaacagattattttaaagtcacttataagaatacaaactcagccaggctcagtggtgtgcacctgtaatcccagctacttggagggctgaggtaggaggattgctttatcccaggagttcaggaccagcctgggcaatatagtgaaaccttatctcaaaaaatatatattccaaactgtttgtaagaagctaaaaggattcagtttgccttcatagtacaatttccctaattcgaatgtaattattgtcttgaatgagacctttcaaacattttttctttcatgaatttccagaattctttagtattgagcatataaacctagtatgaaataagtaatgctttattctctgaagtaatggcatgtatcaagcatatggtactcatatgatcaaatatccttccagtcaaatgttgctattttctgccttgcatcttataattgtattttatatacttttgtattttgtataggtttcttttattctcactgagagtgactgtggagatggtatttctaattttccctccttttttcttcatccagggcttttttcttacagtttccccagagtcagtattaaaggtggctcaccatgcttctgaaaacaacaggattttcactttgaatctatctgcaccgtttattagccagttctacaaggaatcattgatgaaagttatgccttatgttgatatactttttggaaatgagacagtgagttacctttcctttttcaaaagaacctgggggttttttgtttgtttatttctgatgtgtgtatatatgtttagaaatatataaattaaatcctaaatttttgtgtaaatgtccttgagaattgtgcaacaaaattgcctcaatgtcaactgctctcagtattttcaatatttccttcagtatatactaacttctttcttagtgaagcatttatttatttatttttatatttttatttttttgaggtggagtttccctcttttcatccaggctggagtataatggcatgatcttggctcactacaacctctccttcccgggttcaagcagttctcctgcctcagcctcctaagtagctggggttataggcgcatgccaccatgcccagctaaattttgtgtttttagtagagacagggtttcaccatgttggccaggctggtcacgaactcctgacctcaggtgatctgatcgcctcagcctcccaaagtgctaggattacaggtatgagccactgtgcccggcccaacatttatttttttaaggtgtttgacgtttgatttacttatagtaagagtcatcctttttactgtaatttctgtgagtttttacagatggatacctgtcctgttactatgaccacaatcaggataaaaaagcacattcatcacttttttaagtctcttcagagtctaagtccatttgatatttgtttaataaattatgagtaaattttgatatattacatttatatttctttattaataatatttttaaaatattgtctgttatagttgaaggtgataaaatggaatttcatctcaacaagtacagttttttctttctaccaagaatgtattttcttccattctaaattatggaaatgcttatttacttaaatgcttatttactttgattgcttgtttactgtttatacctcttatttactgtttatacctctttaaaaatccatgaaagaggaaaaaatccttcagtgtgtcttcctatgacttggccatgtcacttgatggtttaatgtatacaatgaaggtattgtattaatcatcccagaagttcattctgattctaattccatagttctaacatagtttgaatatattcatcaattttatatctaataactgccatctgcctagaataacataaaaattgacctggaagtttacgagatcacctgggtaaagattaaaggatgatccatagaaataatatcacagtgtatctgcaaaggtgatggttacattggttataaatggtgacattggaaggaaatgctatattcttgataattcacaaattgagatactggcaagaaatagtggtaatagccaagtgccatataactgctagaagcctaatttgactaagatctaccatttagtttttccttattaacagttttattttgtaaagggtaaaagaagtaaatgggaaaagtgctattcaagccttttgaataacattaaagcattggtctcagtagtcttgagaatcattgggagaagttaacatttggtctcagagttctaaatagtcaagaaagatcagactggcagcacttaaataagttctctagagtttaagagacaaatcttaaaacttttaaaaaagataaatatgattccaaagaggccgggcacggtggctcacgcctgtgatcccagcactttgggaggcagaggcgggtggatcacgaggtcaggagattgagaccatcctggctaacacggtgaaagcccgtctctacttaaaatacaaaaaatgagccaggcgtggtggcgagtgcctgtagtcccagctactcgggaggctgagacaggagaatggcgtgaacccaggaggcggagcttgcagtgagccgagatcgcgccactgcactccagcctggacagagcgagactccgtctcaaaaaacaaacaaacaaaaaaaaaaaaacataaatatgattccaaagaatgaaactttggaagtaaagaaagcttagggagattgaatgccataaaaaatgctatttggactttatagtcacaaatgatcttaattaaggagagaatgtggagggaccttttgaaaaaatatagcagagcacgcagaaaactctttaataagagctcaaatttggaggataacgagatagctgcctctgcctttgccggtgcagtgagagcagcttcaggaatcttatggcctctgaatattttggcatcttcagcctaccaaaactgtgtcaaaaatgcctctcttatttctgcattgtccactggacgttttagtcatattcagacaccagttgtttcctccactcccagacttaccacatctgagagaaacctgacatgtgggcatacttcagcgatccttaatagagtggccctcttgcttccaagtgtcttgaagctgccagccagatctctaacatacgtcagtacaggaaaaggcaagagaaggattgtgaaagctgtcatctataggtttcttcgacttcattgtggcctttggatgagaagggctggttataagaaaaaattatggaaaaaggcacctgcaagaaaaaagcgattgagggaatttgtattcggcaataaaacccagagtaaactcttaagataaaatgacgacgtccttctggaagaggtgaaactggtatgtccatgatccttatcagaagtgtcatgatcgaacaaacctgaaagtatagatcagaagtttcacttgtttctcagttattgaatatgtatctttgtgtacatatctgcaaaaatggataagtaaaaatctcgatgtaaattgtatcaatgaatatgtaaacatacagtgacaacactgaacttataaaagttttaaaacttaaaaaaaaagctcaaatttgtaaaagacatgtaaaaagaaggtggaaaatgtatttagaatcagggaatgatgctaaaagtttggtagagacaaaagagaaaagaaagtcccaaaagtggtttaagtttgcagcagatgctgatgatatcaaaacaatcttcacttaaaaaaaaaaaaaagactccaaagtacaagcaacaaatggaaaaaatagataaattagacatcatcaaaattaacaatttttgggcatcgaaggacactaacaagaatgtgaaaagacaactagtggaatgggagttaatatttgcaaatcatatatctgataaaggattcatattcagaatatttaacacagtaacaactcaacaataagcaaactaacaacataattcaataatgatcaaaggaatttaataaacatttattcgaagaagatatacagatggccagtaaacacatgaaaagatgctcaacataaccattcaagaagtgcaaatcaaaaccaaaattagataccacttcacacccatcagaatgacaattgttttaaaaaatggaaattaacaagtattggtgaagatgtggagaaattggaaacacttgtgtattgctggtgggaatgtaaaatgggaatgtagaagacaatttggtggttcctcaaaatgttaaacatagaattattaccatatgatctagcagttctacttctaggtatattacccaaaataactgaaagcagggactcagataattgtacaccaatgtccatagcagcattattcacaatagctaagatagaagcaaatcaaatattcatcaacagatgaataaacaaaatttcatgtatatatacaatggagtattatttagccttaaataaaattttgatacatgctacaacatgaatgaattttggaaatactatgttaagtaaaataagccagacacatcagacaattattggattttctaagaagaattccacttacaagaagtatctagaataggcaaattcatagagacacatagtaggatagtgattacctgggagtggggtggggaggaatgaggcattattgtgtaataagtacagagcttctgtttgggatgatgaaaaagttctggaaatggatagtggtgatagttgcgccacactgtgaatgtatttagtgccaatgaattgcatacttaaaatggaaaattttatcatatgtatagtttaccacaatttttttgaaaaagttttattctacaaatcagtaaacttaaaagttggatcacagcttagcatagattattaaaggaattatttttccccacctagaagaggaagtggtaaaactgtaagctgctacgtggctgtaagtcatggggcaagaaaatcttttctcttttggtatgattattgttcatttgaattcgcttcaagaggtatttatatagtacctaagtacctattatggcagaccaataagcagtggatacatagtatattttagaacatctgtcattacgtggactatagaataataaagattggctataagacaattagaggtatttggtattttattgaagcagtctcaaaaggtctgttgataaataaattgatttctaggggtacgcctcagtgtttaccctgcctttgcttaagtaaacagtgatttagataaagctatatttgcatataattcaaatgcaaataatacaacaccttaatacatactaggtaagttgaaggtcaaaatcagatttttttaaatgttagtagactctaaatatcagttgagtgatgaaatttaatagggataataaaaattatatcgtatttgattataaaaagcaagtagagtaaaatgctttatccctttaatctcatcatccattgtttttctccttgaatactatagtgataatgttatcttcagttttccaggaaaaaagagacattttacttctaaaatgtgacgaaggataaaatatagttatcagagaatatacgtaggattctttaatatttcccccctcaaaaaaataaagtatactgtgtttagtataaatttttaaaatgtcaaaactcagctaaaatcaaacacacttggcccttattttctacatgtcaccttcctcttgtcagaggattgtacagtagtaatgatgatttaaaacttctgatagcctcaatatttaaaaaaaataataccttgtccacaaagattatttcttcacaggcaatgatcaatgatccctgtgagacaagaaataaataagataaacctgatgattaccccagctaactccttggagataatttccaggcaacagaagaaaggtaactaaggccaagcacagtggctcacgcctgtaataccagcactttgggaggctgaagcgagtggatcctttgaggtcaggagttcaagaccagcctggccaacatggtgaaaccccctctctactaaaaatacaaaaaagcctggcagggtggttgtgcgcctgtaatcccagctactcgggtggctgaggcatgagaattacttgaacctgggaagcagaggttgcagcgagccaaaattgcaccactgcactccagccagtgtgattgagactctgtctcaaaaagaaaaaagaagggtatctcaagtagacccttgcagtctcttttaatgaggagttggagccggaagttcaaggagtctaagacagctagtgtttgtaagttaaaagtaccagagaagaaatagctgaatagagggagaacacaggacatttgcagaatcccaacaagtcttcagctgagtatgaatcagtgcatttttgtgaagaaattaaggaagaccacaaaaagaaccacctaaaaagattgtagaagacaatcctcagtgcacacatgaggacctataaccattcctatcctactagtcagagtggataacctcgtaattcacgaggcttcaagtagagtattaaaaggaattttgtctcattagcaggttaaaatcagctctagactagatgttctggtccctcctgtcaatattattacaatatatttgacaacctttatgaaatggacaaatttgttaaaagacacaaagtactaaatcatactcaagaagaaatagaaaaagtctgtttagattattaaagaaattgaatttgtagttaaaacccttgctacaaagaaacttcaaaggctgaattgcttcagtgtttaattcttttctgtttgtttgtttgtttgttttgagacaaggtctcactctctcacccaggctataatacaatggcacaatcatgtctcactgcaagctcaaactcctgggttcaaatgatcctcctacctcaacctcccgagaagctaggacgacaggtgcaaaccaccacagctggctaatttttaatttttgtagagaggaggtctcgttttgttgcccaggctggtttcaacctcctgcactgaagcgagtccttctacctcagcctcccaaagtgctgggattacaagcatgagccactgcacttggcagtgttgaattttaacacagatttcagaaagatgtagtaccaattgtatacaaactgtcccagaaaattgaagagggagaaatatacctatcttatttcatgaggtcagcattaccttcataccaaaaacaaagtattgcaagaaaactacagaccaatatccctcataaacacagatgtaaaaattcttcaaataattttagcacatcaaaccgaacaatatattaaaagagtaattcatcatgactaggagtgtagaattggtttagcattttgaaatccatcaatgtaattaaatatgttaagactaaaaagaaaaatcacatgattatcctaaaagcttttgaaaaatccagacatctatttctgttaaaagccctcggaggctgggcatggtggctcatgcctgcaatcccaatagggattggtgagggtcaggagtttgagaccagcctggccaacattgcaaaacctcatctctactaataatacacaaaatagcagggcatgttggtgggcacctgtaattccagctacttgggaggctgaggcaggagaatcgcttgaactggggaggcagaggttgcagtgagccaagatcatgccaccacacgccagcctgggcaacagggtgaaactgtgtcaaaaaaaaaaaaaaaacccttggaatagtagaagcatgaaaaaatccagatttagaaagaaggaagtaaaactgtctctattatcaaaagcatgatcatcttcatacaaaatctgatgtcatcttcaaaaagctattagaactggctgggcatagtgcatcacgcctgtaatcccagcactttgggaggccgaggctggtggatcatttgaggtcaagagttctagaccagtgtggccaacatggcaaaaccgcgtctctactaaaaatacaaaaattagctgggcatggtggcacacgcctgtaattccagctacttgggaggctgaggcaggagaacccgggaggctgacctgaggcaggagaacccaggaggcggaggttgcgatgagccgagatcatgccactgcactccagtctgggcgacagagcaagactctgtctcaaaaaaaaaaaaaaaaaaaaagctattagaactaagtgacgtagcaagattgtagcatacagaataaaaaatttaaatctcaaatgtatttttctatattagcaagaaacaaccagaaatttaaaaatacgatttccaataccatcaaaaagtataacaaagtatttactttgggataaaccagaccaaagatgtatacactgaacactacaaaacattgttgaaaaaatttaagaagacccaaatgggagatatatcatgttcatagattagaagactctgtattgttaaatataaattctactcaaaataatctatagtttagtgtaattcagtcagaatttcagaagttttttttaaagtcaagttgattctaatatttatatggaaaagcactggactagagtagccaaaccaacgtggattttaaaaaccaaatcagaagacctttacatgatttgaagacttattacaaagctacagtaatccagacaatgtggcattggtgtaatgatagacaaatagtcaatggaacagaagggaacgtccagaaatagacctaaatttatttttcaacaatgtttcagaggctttttcatggaggaagaaaacagtctttttgacaagtcgttctggagcaattaaatatccatatctaaaaacgcaaacttcaacccacgtaacaaacaactgcacggctattagaatgtctgaaagtgtgaccataccaaatattggtaaggatatatggagcagctagaatgtaaaatggtacaactactttggagaatggtgttcttgtttcttacaaagttaaatatacatcctccaaatgacctagctatcccactcctagatattcacccaggacagatgaaagcatctgtccatgtaaagacatacacaggtgtttatagcagctttatttgtaatggccaaagtctggaaaacaaaccaaacatccacaactagtaactggttaaacaaattgtgatatttccatagaatagaatactactcaactataaaagaattgtactattgataagaaatgaaccaacagcatagaagaattttagaatacctatgctgagtgtaagatactgtaaagtacattctatatgattctatttatattctagaaagtgctaacaaatttatggtgatggcagatccattgttgtctggggacagggttatgctatgaggcagtgatcacaaacgggcatgaggaaacttttaggagtaatagatgtgttcccattgaggttgtggttgcagtactttatacatacgtcaagttttatctaattaaacacttttagtttgtgcagataattgtatgtcagttatacctcagtaaagctattaaaatgaatatatactttgattccatttatatgtttaaaagtaggaaacattattctaaagccattaagttccaaaaatacactgctaaaatgaagaagtgccaatttgttattttttgatcaccatatatgaaacttctgttatttccatggaagatccccttatatttaagtagcaatgtcaagccagaggaagagtgttttgatagtcctgggttctaatcatgacaactaaaaattatcataacctaccattgaataatgctttaaagttaaaaagggtattcacaaaaaccgtcatttaatctacaaggcaattccatgtgtttttctaatgcatgtaaagtttcagcttggctcatggaatatattctcaatttttgttaggtaatgttggtagtagttttaggagtattgatcatgttatctattaagtttcacttcactttaacttgctttgataactcacactcttcattcattcctgttaaaacataatgaatatagtaccaagtgcatgagggaaaactcacagctattgggctgctctctgctataccaccttacttctgttccaacaaagttatttgcttacaaaagttaattatgtttttcctaaacttggtgaaatttgtgttcattatttaattatttaacattatatattctgatgaaatatgaatgcaagtagaatgagaattagtttaatgagttaaggttggttccaaaactaaatacatatgagttatttttaatgttgctattgaattggatgtgggcatgaaaagtataaaagattaaaggcagtaaaaagctgtaaacatctgtattcaggagtgcttcataggtgtttttatgttttctctctgctttaaagaagttgaaactaggccaggaaccatagcgcacacctgtaatcctagcactttgggaggttgaagtgggaggattgcttgagcagaggtgttggaaaccagcctgggcaacatagttggaccccatctctccaattattttcttaaaattagccaggcatggtggcacacacttgtattcccagctattcgggaggctaaggtgggaggatcgcttgcacctgggaggttgaggctgcagtgagctacgatcatgcaactgcactccggtctgggtaacagagtaagaccctgtctaaaaataaaatttttaagaaagtaaaatgagaattcataaactatgaattctagatgtggttctacaagaaaaactctagaatgtcagtctgtaggcatgctcaaaggttttgaccctatttttttttttttttttttgagacagagtcttgctcttattgcctaggctggagtgcagtggcaccatcacagctcactgcaacctccacttcccaggttcaagcaattctcgtgtctcagcttcccgagtagctgagactacaggcgtgcacaaccatgcctggctaatttttgtatttttagtagagatggggttttgccatgttggccaggctgattttgaactcctggcctcaagtgattttgaactgcccacctctgcctcccaaagtgctgagattacaggtgtgagccccccacccagctgaccctattttaaatattagcaaatgatgtatctttatatattaaaataaaatgtttagattatgaaagctattttttgttcccttaatttaatcatcactctgatttatttatcaactactattccttttcctcatctgtaaattgaggggatttgcatagaaatactagataatcttttaaattttttcttaaagcttaaacatgttataaaactgatgattcattttttttccacattctaagattaatactgttagattttattataaattaataaagttcctcttttaacatgtaaaataatgcctgacatttcttttaggtagttctgattttttattatgagtgtagccttaactgtagtgcctttgaagctgaattctccccatttgtgaccccagtattccttttttgtttagtgaacctaggggaaatgatatttctctccaaaaaatacctgaaaatatttggttagacacgtgctgggacaaaaagtgaagtatccacagtaataccattgctatgttcttgtgatataaccagattataattactaaatgatacaatttactttctttttttaattctggtaaaaaaaaaatacacaatataaaatttagaccattttaactatttttaagtgtacaaatcagtggcattaagtacatttgcaatgttgtacagccatcaccactattcctctccagaactttttttttttttaatcaacccaagcagaagctctgtacccattaaacaataactcactatttcctgtttcctccttcctcctcacccttggtaactgttttactgtctatctatgaatttgcctattttaggtacctcatacaagtaggatcatacaaaagttgtctgacttaatttcacttagcataatctttttaaacttcatccatgttatagcatgttatcagaatttcatcttttttaaggctgaataatatttcattgtatgtgtgaaattttgttttttgcttcattttgttgatagacatttaatttgtttccacctttgattattatgaacaatgctactgtgaatgttaatgaacaagtatctgtttgagttcctgcttttaactcttttggatatatacctagatgtggaactgttggatccacaacaggtacaccattttacattcctaccatcaatacacaagggttccaatttctccacctcctcaccaacacttattttgcatttaaaaaataatagccatcctgctgggcacgaggtggcatctcactttggttttgatttgtgtggtttactttcagccaaggttcagaaatacatagtgacaaatttctgtttctttaatttaaaatctttggtaacctgttacattgcattttgtacttttaaattacacatctgaattgattggttatccttgttaaagtagttccaaaattactgtagtttaaaaactctttaaatattacattgtagttttaatttgtttctgacatcttcaaagtttgaaattttcccttcagcaacaaccatttgttagctacattcacacgaaagcagcttaataaaggacattctacacaaaggtaattataatccattgatgccccttaatgcaagctgctttgtagtcattatctagcagtagatgactaaagaacttgattattcttgtttttcatttttattaaattaagaaggtttttttaaattatgtcattttgcaaatggttcttaggagtaatgcctttcaaggctccataatcactagataattaacctgcaaggattaagtacactcaactttgcctcaggatgcttaactctcaaatacagtcaattatctcatgataataactgctttgtcaagagttaccacttaactccacagtgaaaagtcaaatcacccataccatgcactttaagatagtttcaataataaaataacagtttgaaatggggcagaagaattcagttaaattttttcatagggataagaatgatatgctttagataaagctccccctcatatctagtattttgaatttcacaaatgacttcaatttataaagataatataggccaggtgcagtggctcatgcctgtaatcccagcactttgggagaccaaggtgggcagatcacctgaggtcaggagttccagaacagcctggccaacatggtgaaaccccatctctaataaacacaaaaattagctgggtgtggtggcacgcgcctatagtcccagctgctcaggaggctgaggcaggagaatcctgagaaccctggaggcggaggttgcagctagccaagatcacaccactgccctccagcctggcaacagagcgagactccgtctcacaaaaaaaaaaaaaaaggtaatgtattgctctgcttcatcagtccttttgctggcagtgttcctgcattgcaaattttcttataggaaagccattttgtctgttaacctcacagaggattcaatatattaaaaatctctaatatacaccaagaaaatggaaattactttctttacatattgatttaacttttaaaaaatctcgtttatcaacaaacgaattacaaaacagtgagcaaaattctgcagtttgttgtggttgttttttgttgttgagtagcttcactcatatttggacaggatatgccaaaaacagaaagactgctagatagatcaggacattttgaaagaaaatataaaaatgtctttaggtttgttatccatgtcctctaagcctgaatgatgcttgtatctctttataagtaaactatcattatctttttactaaaccagatgggatacattggctttttcttctgttatatattttactgccatggggatgggaagagactttattgatattttgtttacacttttaaaccctttttaatgtttctaatagttaattaataatttgaaaccatcaattctttaaattgtaaataactttgatacaggttatcttatttttcagtttctatacttctgtaaaatagaagtcatttgctcttttaagataaaaaatctgtgtgaatctatgtgtaattatgtacaccaaatagtgctatacatgcatacaacttctttcagatattcttcttttggttaagagcctttttttctttgtaaaggtattattttaatttttagaactatttttctgtgcactggagcacatgtttgggaggaaaaaagaaactttctgtcaagtccctatacacagagaattcttgtttgaatttttaaaaaattttgtcaagtctagttcttttatttatttatttattatcagttagagacagggtctcactgtgttgtccaggctgttctcaaactcctggcctcaagcagtcttcccgccttggcctccctaaggttctgggattacaggcatgagcgaccaagcctggccaagtctaattctttaaaggatgtgatttccaagtatttccaggaattcaagactgttacctagatccgtattctgacaaaagagatgatcttttctttcttcatatcagaatatttcccccatgaattgagggaaatggggctgtatctaaaaatggtaactctgccctttaaagtatacagaagtgccctgtttcttcctaagagaggtggaagtcccctttctgagactgtgcatatagatctctttattcccctttttctgctataagtgataagaggggctatgtagacaaaatgtaaggttgttataaaatcatcaaggaattgggaaagaaactttatcggaggatatacataaccccttcagaaaaaaaaacaaaaacttatggtgctttttggaagaaattctgacatagttgtattttctgagaaggataatgaaatttcagttaacatggaactgtaacttcgtaaaattgctgctcagctcctagatttaactttctccctagggtttttctaatatatttactcatctgaaaaaagtgagattgactgtagcacaagggagacttctgatgtcagtggcatgttgtaaagatgtgctatgggaaagattcagaaaatgcaaaggctatttaactatatgctctgcatctctcttcctttctacatagctctctcctttctttcttactccttcgtctccctctttacgccaactacattgcctctctgaagatgaaatgcttttaaatcatccccaatctaacatccatcactggtaaaaagccatctaattattatgtgttgatttttaaaaattaaaaaaaattattagaaaattaagaagagcatttaaatgtttttaattgcaaggagaaaataaatacactcaagtaaagaaaaacactgtgtaatttgaaatagtttgaattactacggagataatcatattttatgcagtaatgcctttctattttattcactatttctattaatctttatttgtttcagttactgtactataaatttgtaagtgattattttggtattatttgtatagtatgccataatataaaaataatgaaaaatattaaatatatatttaatgttcttatttaatgcctttaattttttttttctttgagacaaggtctcactctgttacccaggctggagtacagtgatgcaatctcggctcactgcaaactccacctcccaggttcaagcgattctcaagtctcagctttccacatagctgggattacaggaatgcgccatcacactcagctaatgtttgtatttttagtagagatggggttttgccatgttggccaggctgatcttgaactccaggcctcaagtgatccacctgcctcggcctcccatgtgctggggttacaggagtgagacacctcacccagccaaaaattattgtttattaaaaatcatttaatgacattgacatccttataaataaaaactgtaaatttatatcacagtagaaaaagtgctagacctaaatttagaaaacctgtcttttatcctagctcttgagtttttcacagagaaaataggagtcaagaagccaaaattctgacatgagggaaataattagcaaaatttaaataggtgccattgattagtcaatggtattttatcaacattaatttttattttattatttatttatttattttgatatggagtcttgctctgttgcccagactggagtgcagtggcatcatctcggctcactgcaacctccaccttccgggttcaagcaattctcctgcctcagcctcctgagtagctggggttacaagttcctgccaccatgcctggctaatttttgtattactagtagagacggggtttcgccatgttggccatgctggtctcgaactcctgacctcaggtgattggcctgccttggcctcgcaaagtgctgggattacaggcatgagtcaccgcacccagcttaacattaatttttttagttttggtaattttaatatggctatatagaatgtttacatttggaaaaatcctaatatcctttttgactgatccagatccagtccaggttgctcacattgcatttagttaccacatttccttcgtctctttaatctagaatggttcttcagtctttgtctttatgaccatgacaattttgaagagtcctgactggttttttgtagaatgcccttcagtgtggagtttcctcatgattaatacattttttataggaataccatagaaacagcctgggcaacatagcaagatgctgtctctacaaaaagtaaaattcaccaggcatgatggcacattcctgtagtcccaactacttgggaggctgaggcaggaggattgcttgagcccaggagtttgaggctgcattgagccatgattgccaccctggactccagcctgggttacagaacgagaacccccacacaccccccccccctaaaaaaaaacaacacaacacagaaatgctattgtgtcttttttcatgcgttatactaagattttagtgtgtttcgttactggtaatactaactttgatcacatggttaagaaaatgttggcccagtttattcacttcaaagttactatttctggccaggcatagtggcttacgcctgtaatcccagcactctggggagccaaggaggacagatcgcttgggcttaggagttcaagaccagcctgggcaacatggtataaccctatctgtactaaaaatataaaaattagctgggcatagtggcatgcacctgtagtcccagctacttgggaggctgaggtaagaggatcgcttgagcccaggaggtcacatggtgaccttggaagcaaatgctccctcaaacacgagatgactgcagccctggtctacatctcagttgcagtcttgtgaaatcttgagtcagaggcactcagctaagccatgcctggattccttttcctggaaactatggagataataagtgtttgttattttaagtcactaagttttggagcaatttgttacacaataataactaatatgctgtgaaaaacaaatttactaagagctcaatatctgtgtacaattttttttgtctttagccttttgtgtatattgtcaaaacacaggcttttagttaaagttagttcctttccccttcaagtattttaattttttttaaatatgtgaaacatttatatggttcttaacatcagaactatatgaaaaggtttactcagtagtgtcgctcctcccttatccctcatcttcctcattccccattctgtctctattcctaccctgtttcttcctacctaccctctataaataatctcattagtttctggctcacatttctaaatttcttttagcacaaattagcagctaaatgcatattttactgtatcttctttgttacatgaaaggtagcacactatagatagatcctctttgaacttagctttttttcaatcaagtgcatcttagaaatcattccataaaagctcatagagatccttctcatttttaattttattttagttatttatttatttatttatttatttttttaatgagatggagtctcgctctgtcacccaggctggagtgcagtggtgcgatctcggctcacagcaacttccacttcccgggttcaagggattctcctgcctcagcctcccaagtagctgggactacaggtgcctgccaccacccacggttaattttttgtatttttagtaaagacggggtttcaccatgttagccaggctggtcttgatctcctgtcctcgtgatcctcccgccttggcctcccaaagtgctgggattacaggcgtgagccacagcgcctggcctatttcatttaaaaaaaaaaaaaaaactgagacagggtctcactgtgttgcccaggctggtcttgaactcctgggctcaagcaatcctcctgcaatccttctgccttgacctcccaaagtgctggtattacagacatccagccacaataatcctcatttttttagttggattttccccattgtgtgaatgtaccatattttacccagtcactctcttatgtatggacattaagactgtttccagagtcttgcacttaaaaacaatctttcaatgaataatcttgttcatacatatttcttgggttgctagaggtatttcttcagagtaaattccttgaaatggaattgttgggtcaaaggataagtgcatataacgttttgttagatgttgctaaattcctctccaaaataattagaaatgttttcattctcagcagtagtgtaggtgaatgcctgtttttaatggggttattttaatatttggttatcaattattaagcattgctatcaaatggaattcactagaagcatgtaaaattctagctttatttcaaatacttagttgaaccagccaattcattttagcacagtaaaagtaatccaagaactaaaaagtgatcattctttaaggtacagattttaaagactcttttatcttttttttttcttttttttgctattttatcagacacattagaggaatatgaattaatccccattatacactctttagtttcattttctggccctgtattttcatcttatacttctctcctacaagcacctcttcctttctcctgtactgcctaactattcatgttttcttatcatcaatactcatttcatatattccctacctcacattctccccttctttccctcccttctccactcccattcagttggttattttataaatgtgattctgtgatcttgtgtatataattacaatgcttacatgtttcttttacactagaatgtgttcctttacagcagtgactttcattcttcactacattctggccacttgattggtgatcactttctgaccggaagttccaattatttaatcacaaagttggactttctggtgaccacttcccatcctggggctgacagtgagtcgccccatcagcataacaaaggcacttttaacaatcaggaaattctgagggtttttgaagctctgtgctaggaatccagacaaggacttgatatattttttactataccagtttaagggttaatgataccatgtaacaactttattaatagattactatttatagaaacttgataaatgtggtgggaggtggtgcagaatcatgtgatataatcaattataaatgaaagcacagataaaatttgaaataataagagagaaataagaatgaaggttggccacggtggctcacacttgtaatcccagcattttggggggctgaggcgggcagatcacgaggtcaggagatcgagaccatcctggccaacatggtgaaaccccttctccactaaaaatacaaacattagctgggcgtggtgatgcatgctactcgggaggctgaggcaggagaatcacttgaacccgggaggtggaggttgcggtgagctgagatggtaccactgcactccagcctggggacagagtgagattctgtctcaaaaaataatgaaaaccgaggagttttttctttctttctttttttttttttgagacggaatcttgccatgtcgccaggttaaaataaactttcaattctcttctcttgaatatctctcacccaacaatgtttttttcatgttgatcactttactaaagcgaacaattggggttttaccaaaattgtgaaggattttattcttccatacttatgtctgtgttcagggtcatacagattctactttttccttttagtttaaggtattctcttggagatttaatgtacttaaatttgaccacaatttattgagagcatattctgtgtcagacattgcactctgcactagatattcaggaatttctaaaaagaatgttaacattgctgttacatagtcagttactgatcacattcttttcctctcaacttttttcaaaataggaatctgcggtatgttttcacgtatggagttcaggtcaggcttaggggtccctgacaatgtgaatagttttaagctgggcctcaattcgtggtacccttatactaatttaacaagccgtggactctaggttccaccaaaaatattttgttccatcctctctggtttcagtccatggtgtacagaaagaaaactaaggaacttcagccccaaattgtcaaattttgctacttaagaaacagaagatttaaatctatcattttgtcttatattccagagttgactggttcctcctgtctttaacttcttgtccttgaagggtattctaattttcattcagaaatatgacttctcatagggtttgtgttagatattttcagggccagatggatatgatgttcccatttctgttttattgttaaactactattccttttgagctgtaatgaacaattcattctgagaggcaatatatgttttcagtaattgacttgaataaaagtaaatgttaaacatggagttactaagttaatacagtgggtattagtactaatttgttcaaattaagatagaattcttaatttgataaatagaattcttatattacagcatcagtccaattggattgatagtttgtagaaaggtaatttcttacatgaggaaagacaggttttctttctcttagcaaggtattaatgcaaaaatgacctcttcatttcctaccagcttccagaagggaaatgctggttaggaggtaaattcaatttactctacaagcaaacttcacatctgttatgctgaagtcagagtttatctttcttgttatgtggaacctagaaatataccatgaggaatactgaaaaataaactagcagaaattttgcgtgatgctgaggatttttagatggctgcaaaatgggtgaaagtaatataaacttaacaaagaatgttgtcacaactctctggaacttagtactgtttttcaactaacaaatggaagatttgtgagactaggtcgacttaatgtgatttcaatgcagtaattactgtgtggcatgggcatggtaagagataggccttttctagaaatattctcatctctgttttttttagttgctcttacttagatttatattaactcagcttcacattttcatttctttttattttattttaaacaatgagaaaaatactccacgatgtcactgatttagttatcagatttgctttatttctgtatataataggtaatgtgagtacaggaaatatatctgaaaaggttacttgtacctaaattttaagttagatcatttaaaaattacttataagtctcttgagtgttttatatagtagggcagatggaaaaacttatttgatattcatttttggtacctcttaggaaaataattgggaatgtattcagttggaaaaaatgttgagaagagtgttttatataatgattatttagtaaaacattaaaaataatttcttattctggaggtttatagacatcaaaattgacaaagattcatggattatacatttcatcaaggtacctttaagcgattttttaaaaaaaattctgactctaacaatgcatgctcattgtagagcgttaaaaatacaaaaacatgcaaaagaaaaaattaaaattaacatgtgtcatatcacccagcattaactactctataatttttcctgtgtttccttgtagggtttttcccacacatttttatttgtttttatcatatttatttttattccacacactttttattttgaaatgatttacaatctaggaaagaattataagaagagtacagagttctctcctactacacttttgagcattcttgctttttctctctttctgtctctctaaatatatgtgcttaaccatagtacatattcagatttttctagctgtcccaagaatgttctttctagtgattttgttttccaggatcatggatcatgcattgccttaacttgtcatgtttctttggtttccttaatctggagttccttgatctttctccttcatgccattgcatttataaagagtgttgtcaactgttctgtgtatgtaaattcttaaccaattgaaatagattttacatcatttttcccactttatatatatatatatatttatttatttatttatttatttatttttattttattatttttttttttttttggagacagagccttgctctgtcaccaggctggagtgcagtggtgcaatctcggctcactgcaacctccacctcctggattgaagtgattctcctgcctcagcctcccaagtagctgggaatacaggcgcgcaccaccatgcccagctaattttttgttttgttttgttttgttttgagacagagttttgctcttgttacccaggctaagagtgcaatagcgccatcttggcccaccacaacctccacctcctggattgaagcaattctcctgcctcagcctcccgaatagctgggattacaggcatgtgccacaacatccggctaattttgtatttttggtagagacagggtttctccatgttagtcaggctggtcttgaactcccaacctcaggtgatctccctgcctcagcctcccaaagtgctgggattacaggcgtgagccaccgcgcccggcctaatttttgtatttttagcagagactgggtttcatcatgttggccatgacggtctcgatctcctgaccttgtgatccacctgccttggcctcccaaagtgctgggattacaggcgtgagtcaccacacctggccacttaatatattttcaacattttccaatgtctttaattatgtcaattataattttggattgctgtataatataatttattttcattagtcttctagtgttggaaatttttactgtttgttttcttttcagtattgcaaatacaattgggaaataaactttgtaaataaatctttgttgtaattttaatttctgaatctatcaagtatttgttaaaacataaagcaacaaaacaaaaatcctacagaagaggataattaaatgttaatctttttgattctgaatacaattagaatggaaatttggaaaaggggaaaattgccagataaagaggttgccagatttagcaaataaaaatacaggatgcccatttaaatttgaatttcagaagggacacacgatatctgggacatacttatactaaaaaattattcattgcatatctgaaacttaaatatgactgagcatcatgtattttatctggcaaccctaccagtggtttgagtattcgggaagacttcatggtagagataaagagagggaataaagaagatgttttacacaaaaggaatggttgagattacctccaaaacaagagtgaacatagtttatgtgaaatagtctccataaagataaagactttgtgtctcattcactgctgtatccccgatcccttaaacaatctgtacactgtagtcactcaataaatatttgttgaacgagtaaatgaatttgcactataaataaagccaggcaacttgggacaaagattacctgttgtaactaagtagataaagataaaatttccatgaaagtggaaaacctggcagaagaatttggacttcctgccttcccttatttattttataatgattcattaagtgactgttatgtgccacatgcacaggatactttggagaacaaaaacagacatggcttctaccctcatggattttatagtctgtattagaggcagacattcaatttataattcaattattcatttaatagtcaataaatttcaattcaattatagcgtacaacttataaaattgaatttttaatcattcaatttataaatatgagtactgtaagggaaaagtatataatacttacattctgaaatcacacacagtgagggggtattcttgaaagaacctgatcaagataaatgtacatggtgttgtgtcttagggatagatccaatcttttctttgaaatcttcattcattcactaattttccctcgaatttatagaacactctttggactattacacttatacatcttttaaaatctttttatatgtgcaatttagtttacttactagattgtaaattaattaatttatttatttatttagagacagggtctcactcacatcacccaggctggagtacagtggcacaatcaccactcagtggcagtctcaacttcccaggctcaggtgatcctcccaccttaacctcctgagtggcttggactacaggtgcacatcaccactcctgtcttatttttcatatcttgtgtagagatggggttttgccatgttgcccaggctggtttcaaactcctgggctcaagtgatccgcctacctcggcctcccaagatcctgggattacaggcataagccctgcacctggcctagatcgtaaattctttagtgagctgggggtatttcaatttgcttttatcccctattgtttcatgtatgtaaaatatacacaggcgttaattattgacatgttgattcattgaaattataatggggcttttaatagctatagatatgccatgagcacataaaagacgatttcctgattctttgaccctcttaaagaagtttatgatgcctacttgtcattcttgggtccttagaccttctgtggcaatattaggtcggggatagatgtctaatgatttgcagtcagggagctttgataaccattgtcacatgttagcataaatcagaacccaatcacttttttttttttttttgagatggagtctcattctgtcgcccaggctgcagtgcagtggcgtgatcttggctcactgcaacctctgcctcccgggttcaagtgattcttctgcctcagcctcccaagtagctgggatcacaggcatccaccaccatgcccagctaatttttgtattcttagtagagacagggtttcactgtgttggccaggctggtctcgaactcctgacctcaggcgatcctcccgcctcagcctcccaaagtactgggattacaggtacgagccaccacgtccagccgagaacccaatcacttttgactctgccttcaatatatattgcaaatctaactaccttttactacctctacttcttcccttctagttcatgatgccattatcacttgcccagattattacagtagtctcataattgctctccctgcctctggttttgcctctcccctccagcagtgataggaaataatggaagtttttaagtaagcatggtagtatcactggatctgttctttgacacagctggctagtagtgtttggtagattggaataggggcatagtaaatgtgggttgacatggtatagtaggtagtcaagacagtccaacaatcaatcttaaagacatttcattttcttggtagttaaagaatataggcctaccagtacttgtaattttaattttaattgatttatatcattttacttattaatattcatttgaatcttagtttataatatctataatcatatgctatgctcaaatgtaattgagttactttttagagacaaggtctcgctatgttgcaggtttcaccatgttgtccagggtggtcttgaactcctgcgttcaagcaatcctcctgcttcagcctcccaagtagttggatctacagggatggcatgcaccatcatacccagctctgaactattttttaagtaaaattttttttagatgaagacaagcttgtatacaagagtagttaagacagtgtggtactgactcaaggatgtactaatagacaaaggatagaaaacagacccacacacatacagtcatacagttacagcaaagatgccactgggatatagaggagaaaggatagtattgggatcagtggatattcatatggaaaaaattaactcctaccttataccacacaccaaaattaattctatatgattgtacataaatgtaaaatagaacaataacacctctagaagaaatcgtatgaaaatatcatggtcttggttaggcaaagctttcttacaaagaatttaaaaatgttaacaataaagaaaatatagtctggtccaaatgcagtggtatttacaactaattgatcacagccagttacagatttctttgttccttctccacttccactgctttacttgactagccttaggaaaaaacaatttttcaggaaaaataagttggatgtgtcaaaattgaggacctttccccagaagacattgtgaaagtgaaaaggcaaaatataaagtgggcttaagaattatgagaagttcagcacagaggactagtggaagaaaatatgtttgtacataatttctttccctataaccaatactaagaatagagaaccctatatttaactgaaggcagaaaatattttgaggccatatttgttctcattttatgccatttacttagtaaatgtacataccttatagattcatgcatataatatacagtcctcccttggtatcttcaggggattggtttcaggacccctctcacacatacacaggataccagtattcaagtcccttgcataaaatggtgaagtatttgcatataacctatgcatatactcccatgtactttaaatattaatctctagattctttataatacctgatacaatgtaaatgccatgtaaatagttgctataccatggttttttgtattattattattattttttattgttggatttttttcatattttcagttcatagttggttgaatgtggatgcagatacagtgggccaactgtatacatattttgggatcattttagtgggtagtaaaacttggttttccccaactgtttctgttaattcacagccagttatgaaatatgccacatttgtcctgattaaatagtgaaatgtcttagccctttccactgattatattgatagaaaagattaaaaagtggtggataaacctaaccaaaaaaaaaatgttttcataagccactgctgtcagcacttatttgagattttaaaacattttgtagttctttatttttaaatgaccttacattttcaaaagggtttgttaattcaaaaggtctcctatggttaaggcagttcaaatagtagactgagggtagaagagggattgactgtaaataggcatggaggtatcttttgggggtgatgtaaatgttctaaaactggattgtggtgatgtttgcacaaaatttgcacaaaagcattgaattatacactgaaagcatattttatagtgtgtaaatgaatgccttaataaagcttttttttttttttaaggataccattaagataatgaattgtccagccacagattaggagaaaacatttacaattcatgtatctgacaaatgattgtatccagaaatcaataataagacaaatcaatagacaaatagcataatttttaaaaattgggcaaaagacttggacacttcatagagggaaataatctaatggccaaataagcacactaaaagaggatgaacattattaatcattaggaaacacaaattaacatcacagtgagatactgacccatcactcatccacttgaatggttaaaatcaaaaggactactaattgttgacaaggatgcagaacaactggaactctcattctttgctggtgagaccatgcagtgggaccacacatttgaaaaactgtatggtagttttttattttttttttcctggtaaaaattaaccgtacatctaccctatgatccagcaagtcatttacctgagaagaacaaaaacatatatccacaaaaagagttgtgcaagaagattcatagcagcaaacaggcatgttcattaacaagacaatttttcagcacattgtgtttttttttttttttttttttttttttttgagacagagtctcactctgtcaccaggctggagtgcagtggtgcaatctctgctcactgcaacctccacctcccaggttcaagcgattctcctgcctcagcctcccaagtagctgggactagaggcacgcaccacgacacccagctaatttttgtatttgtagtagagatggggtttcaccatgttggccaggatggtctcgatctcttgacctcatgatctgccctcctcggcctcccaaagtgctgggattacaggcatgagccaccgcgcctggcctatgtattcatttaacagtacactactgggcaataaaaataaatgaactactactacccccaactacatggataaatctcaggaacattatgttgaacaagaagagtcagatgcaaaacagtatttgtgttctacattataccattcaaacaaacaaaaacagtctataatagaaatcagaaagtagtttcctttttgttagggggtatagggattgactggtaagagacagtagaaaactttctgggattatagaaatgttctatgtcttgttttggataaccatttaagatccgtacatcgtattttatgtgatcatacctcagtaataagaatgcaaaatgctacaaaagcaagtcaacccaacatctctactaataaatctcaccattttaaaaagaacagtaaatcctacatctctattttgagaaaaaataattataattttatttaatgctatttaacatatgcttatatatgacatataaattgtgaaaagattatttaaacaaattggctaaagaaacttcatgaagaaggtgaatcttttgccttattgcatatgcttttatattgagtaaaaccaaagtgatttcccatggtagcttcttatactctgttctcatactctttcttgtgataaaatggaaactgatgttcttcccatgaaagggtaattatacattaatgtactctttttccctcctgtcctttttttattatgaaatatttcatatatcaaagaatatgtctaacatatgtgtattacaaagtatatcctctgcctccctcctcatttgaagatcctgccaatcctctgcagagctaatgcttattctgactttggggttttcatttcctttcatatatcccttatatatgtagtcctagtaggtgtatacatatgtatatcatgaatagttatatatataataattgcaaatacatcctgtttatttaatgggttatgtttctttaagttccaatacaatattttctaaattagaaaggtattacaattttaaaaaatgtgccaggacaaaattaataccaaattacaagaatggtaaagcttagaacattgtcattgactataaataatagctgcaattctattgttggtttcttttttcactagtccattttgataatatttcttgttgtggccaggcacaatggctcatgcctgaaatcctagcactttgggaggccacggcagatggatcgcttgagctcaggagtttgagaccagcctggacaacatggcaagaccttgtctctatttaaaaaaaaaaaaaaaattgttgtagtgaagcagtgttttctttcccacagaatatcgttcttcatttatttataaaaatatgatttggtatatatgcaaatgtagcttattttatatataaccatactgtaatagtctttgtggtaagcaattcagttaatatgactacaggtttaagatataatgtgaaatttggaatagattttaacttttaaaaaataatttatgttaggctgggcacggtggctcacgcctgtaatcccatcactttgggaggccaaggcaggaagatcacttgagcccaggagttcaagaccagcctgggcaacatagggagaccccgtctctacaaaaaaaagaaaattagccctgcatggcccatgcctgtagtctcagatctccagaggttgaggctgcagtgagccatcaccatgccactgtgctcccacttgagcaacagagcaagaccttgtctcaataataataacaataataatataacttatgttaagggctggtctttctttttctatatttaactgattaaactgattaactgtttgttgtttttttttatgtcataggtgtcagatccagctagcagtgccataagccagaattatagatggaagtgggggagagagagaattgtcagaaaaacttactaagatttctatcctggccaggtatagtggcttatgcctataattccagcattttggaaggccaaggtggaaggatccctggaacccaggagttcgaagctgcagtgatctatgatcatcccattgcactctagcctgggatacagagcaagaccttgtctcgaaaaaaaaaaaaaaaatctaagtggcttcatacagaaagtttaaagttaaatgtatactgttatgaatatcttattaaaatgcaagacaatcagagactgatctaaaagtaatcaaggatgatcatgtcttgggagtatcctgtttctcagttgctctggacagaaagcacctagaaggttgagataattcaatgcaaaatcagagatttccccccatgtaatcaacctcagaacttgagttggtcctaacagtagactcaaccccttggaaaagactaggcagagcaattttcctattgactacatctgagacgccattcattcttgtgtcacatgagacatagcatatactttttaggtctctaataatagcagttctctaagaagcaaactgggatgaaagacactattcacttattttcttaaatggggaaggcattaaaaggagtgaaggtttattaatgccacttttaaagatataaatagtagatttttattctaataagtcatacatcaataaaatttgttattgcagctccggggcagcaattacttatatattgacaacttatacatgttttacatgcccatttgctctccttttcactactgaaatgtagttaccatagcaatgaacacatcacatggttcctgtgctagttctaaaatagagaacagcaatatgccatatgagctctgcttattttctacgtaaggactgcatatacaacttgaggctattccataaccttctcagtgcagatagcttatcattgatttagaaagctttcaaagtaaaaagcaattggcagtaatatatttcaagtctctagcttctcttgtactgttatttgccactgagctaaaagaacagtttcactagctttgaccaccagggactctgctgttgtatatttagccatagattgtctatggaatagcagtgccacttagaagattggtgggagaggcatatatagcattcatggacacattttctaagtcttactgagcaattcttaaccaatcttagcttttctcctactgtctcccttaatgtttcaagtttttaaaaatataggactctgttttagaatttgaggaaaggaagatgccaggcacaactggaggcatgctattagttccttttatgtccattattgttgtgtaaggttttaaaatgcattggttatatagcagtttatctatagaaaaggacttcagatttcagtgcctggtggtatcaggccgtatttatgccttactatcacatttagagtgtgttgtaggctgtcagacctccagaaataaagtaggaacatacccctcttactgtgactcttaccagatacttatttgaaacagtccaagcactggcatattagggaatggtgctaactctttctaaccattaataagcaaaataaatttcaatgtgagcttttggctatactatacctatggtcaagtggcactacaaattcaaaattttaaatattctttattgaaactactaggaacaactgttttatatatagtagaggaaaccagggctttattctcttgactgaaacgtgtaagaagtgattcataggtcttcaaacacaaattagtaaatttaggaagctaaaaaggcatatatatttgactactgatgggggcaatatgttgattgtgtaatatttttatctaccctttcatctcagttataatttaaaaaccatttatatactacataaactatgtaatattggatacttctgtgtctatataatttgcaacaaagtagaataaatggccagagatgttattgtaatcttatggttgaatgttatttcttttttctaggtcattgtttaaaatctggacatcatagaaacagataatgcagagagaaaattctttcataattccaccacatctcaatctttgttattagttttaaaatatgtccttctagacatattttattgtaaaaagtatttaaaatactcattttattttattgccgcaagagagagaagggcatttattgtagggcaccaagcaaggaagatgggcagctcatgcttaagacccaacctccctgctggcttacaagcatgggtttttaaaggcaggggtacatttcaggaaagtagaagttacaggcaaaattgttaatcaatacatagaggttatacatgggttggctcaaaaaggagtaaggttttgagtgggggcttacaggtcatcaatggattaggagattctttgatttgcagttggttaaggaagaaaggctttgtctaaaaacttggggtcagcagaaaggagtgttgaggtttggccttaacataggttagttaggataaggaaacctgttaatcattatggggtgctatgtcagggtcaaggtatgagagcaagccacgatgcactgggtcagagtgaccagtttaggaaattgatagcccacaggtgtgactctctccaggcccctcaggaagcaatttagaacaaagagcagcagtcagagttcagtcttcagtttccctttatcaaaggtctatgtgacagcagttgacattttcttttttctgttttcttaaatttatttattaaaagaagtgtctcattctgttgcccaggctggagtgcagtggcacgttcatagctcactgcagtctcgaactcctggcctcaggcaatcctcctgcctcaacctcctgagtagctaggactacaggcacatgccactgtgcccagctcatcattttctatctggtgggtatgctggcatgttggaggaaggacctggcgagaggtgcttggatcatgggggcagttttccccatgctgttctcatgacaggagtaaattctctcaagatctgatagtttaaaagtgtgtggcagtttcctgctcgtgctctctgtctctcctaccactgtgtaagatgcaccttgcttctccttcaccttcagccatgattataagtttcctgaggcctccccagtcatgtggaactatgagtcaactaaacctcttttctttttaagttacccagtctccggtagttatttatggcagtgtgaaaacaggctaatacacttggtttctgaaaagtaatttggctggctttgaagtggggatgggccatgagccaaaggatgcaggcacttctggaagctagaaaggcaagaaaagattatcccttggagcttcaaaagaaatcaaccctgcatgcaccttgattttaccctagtgaggccgggctggacttctgatgcttcagagacaagggttcctccctcatctgtctcaggaagacttaggactaactttaggctttgaagtaaacagaagctgaaacatttgaatgtttgattttcatgatccagaactcaagcctcataggtcccatgcattccctgaacccaataggatgtcacagtctgcataccttcacaccatggcagtctggcttcttccctctcaggcctgcagcctcatgctctgggcttccctggaagctggtgttgtgggggcctgcagttgccaccctgctgtgtgtcagcactgctccctgacgctgttcatccactgacctccattccttggcccagctgcccaggcatggcagactacacgcaacctgggttgtggggaccaggcggagccagcagcactaggacctgatggccaaaacactcattttaatgaaatcatactttaattctgttttgtatcttctcacataaaatagctagatctcttttcctagtagtacaaacttatctatctgccttattttgtataagagtggtattatatgaatacatcattgtttattcttctattgaaagcttttatgttgttttctgggtttttgttattatagttctgtagtaatatgtcttatgtacttttgtgtaaatagttctataggctcaatctccagaattgaactgccaattcttagtaaaggaaaatttaacttttgatacattttaccaaactgccccttcaggggattctaccaaatcatattctctgtttaaatgtctttttaagctttgccaaactgatatatttaaaatggtattttattgtttcaatttgcagttttagaggtaatgttgtaattctatatcttttcatattatagtgcatttatattttcctcttctcttaactccttgtttgcctagctttctttttcttttggttggttcaatttttccaactaagttttttcatgttgtttttttttttctttttcctttgtatttgggaaataaatccttacttgtaaatacttcttgcagtttgtccattgactttttttttgagacaggatcttgctttgtcgtgcaggctggagtgcaatggcatgatcacagctcactgtagcctcaaccttgcagccctctggccacaggctcctgagtagctgggactacaagtgcgcaccaccatgcccagataatttttttaaaaaatttttttgtagaaaaaggacctatgttgcccagactagtctcaatctcctgagctcaagtgatcctccctccttggcctcccaaagttctgggattgcaggcatgagccaccatacccagcctgtctgttgattttattttcggtgctttttttgtatatggaactttttctattagtatttagtcatatttgttagtcttgtcctttatcccttctagcctttaccttatttagtaatatcagatgatgtgtttcatatgggtctaatttatgcattcattcacttacagaagctaatcatttgagtcctagtgtaccaagtatcttagatgatgggtcattgctgactgtacaatctaagaagaatcttatttgcaacaatgatgctttagcgtagcagcagaccaaattctctaggatgattagcagctaattctgaatattgctgtaaagtcatagtagcatgtaacatgtacagcaatagtaaaaacatgtaacagtttgttccttcctaaaattttgttaatttagtcttttatgtgtccttatatttataaatattagttttgtggctaaaatgtgtacatttttccaagttatagtattgagaagcatagctagtagcatttcacccaacagaaaaaattcctttagataaaagccaaatcacagttggcctcattctacatactgttctacaaattacaaaatcagtaaatgtttattgggtacctgtttttattgctaagctcttgcaagagaaagagagaggtggtaggatttttttaaggtgcgagctattatcctatttttaaagagctcataatctagtttggaatgtttggcataagtacatccaaaggtaaataataaaacaaatgataattgctcaacaatatgtaaagacccccctctccaaaccaaaacaaaacagaacaacaaaattgtcagtctcttctgtgagcagtattatctgctgaggacatgttactggtcgaagagctttggctgcagtcattcctagaatgcaaaatgaaatcatccaaaaaactgagagtggccagttttactagtcaaatggagtaagtggtcatctgtgagtttgtgaatctgtctgccagaatatatttattttcttgcttattccaccagttactccttcttgttaaagctttcaccgttattaaagagaagtacctcctggaaattttagcctgctagatgttgtcaaacctgatagcacagtgtgataggctaagattctttgttcatttgttttggatagggaaggaaagacacaatgaaaagactaggagtctgaggtgagggaagatgatgaagaatatgaatcaagggatcaggcatcaagataaccgttcatttatttaaatgtagactttatctgtcttgatcaggcatcaatataacctacatttatttaaaagtaaactttatttgtctaatgtatgtgttcctaatccctgaatctattcatttcattgaaattgatgagtactttcaatacaaatagttacaatattttaagatgttcactgtttataacatcattatatgagtccatgttaaaccagagaagcagaaccagtagacaatatagatttagagatttgttacaaggaattggatgatggaagtatggaggctggctaagcgagtccaaagcccagtcaagaggaaagcaggctagaaacccatgggcataagctgtttagagtccctcagctcagggaaagcctaagctctctttcaaagggctcacctaactttgccttgtaattttctataatggattcctagagtttaccaactaatatgacggtctagagttacatttaagtgaaatttgattgtgagattgtattcttaactgtctatatctggtgctcttgagcacgtatacaaccttctcgccttctctaggtccctaaaagtcatttcttaattcaaaaaatatttaaatgcctgctatgtaccaagcacttctcttgatagagtggtgagcatgacaatctagtagaaaagtgagacagggaaacaccaacattactgtggaaaacatagttacaggggaagtagaaggacattagtcatgtttttttcttcatgacccactgcctaacacatagtagatgcttaataaatgccttttaaataaataagaccacatggcatttttaaaggagtaaggacctctttaaaaataagtatatatggggaaggaaagagatgatgagaagactaggagtctgagtcttgctacagaactagggtaactggagctagtagaaaagcaaagaagcttctgatttggggatggattcaagagtatattgggatgggtgcaaacactttcactgattagcagtttacatatttccttcaaggatagtcttactctccttgtcctaacttttaacctttgcttcaaattagtttagcagtttgtactaagaggaattgccagtgaccaagtgaatatgatatacatataaaagaacagagaaaatcaagtctttactatgttgctgtatcactaattcaggcttccagctaaatgccagaacataaattaggtcccttatcaaatctggcacaaaaatatttaggatcctttttaatatagtacatgtgctttcaataaatgcctgctttggcaaaaaataaaaccagtgttttttgtgtcaagtacaagctgttgtactctgtaacttttaaactgtccttgtgaaccaggttgagggtaaaattaaatttggattttgtattcagttttacaatcaacaaataccattttttttctttgtgttgtgttgtcttatgggtgtttgttttattttggtttggttttggtttggttttcacttagaacaaaattcaaaatctactaaatactccctagccacactggcctgttttcagtttgagatttttttatttttaattttttttaaagatgacatcccactgtgttgtccaggctggagtgcggtggctattctcaggcatgattatagcacaactacatccttgaattcctgggctaaagaggtcctcctgcctcagccactcaagtagctgggactataggcttgcacctccacacctgacttctttctgtttttaagacagttgagctctttcacctgtcccctcaaactgtttgtacatgctcttccctctgccttgacctatttttacatcatgttcagtgttactcacccatcttactctcactaatttattaagtctcaaatattttctcagagattctttcttcacccatgcctccatatctcagttagatctcccttaaaaatctcttctgtgttactagttcctagcatatagtggatgtgtgataagtgaaaggatggactgaaacatagagcacatacaataggtatattctagtcattataaaatgtcctcaaggaactttcttaaatctgagttccaaagggccatgttattttgtaaataatattcttacttttactttagggaacaaaatcagcatttttaaatgaaatagatttaaaaatataggcatgtacattgtataaatgcatgtatacatatgtctaaatatggcaagttgcaaagtaacatgaataccatgattgctgtcataaaccttgaaagccactgtgttagtggatactgttgtataataatctccaaataagcacgtctagaaaacaacctgttttacttatcaatttccccaaacatctctctggtgactgcgtctttggcttcttttttatttatttatttattttttattattatactttaagttttagggtacatgtgcacaatgtgcaggttagttacctatgtatacatgtgccatgctggtgcgctgcacccactaactcgtcatctagcattaggtatatctcccaatgctatccctcccccctcccccaaccccacaacagtccccagagtgtgatgttccccttcctgtgtccatgtgttctcattgttcaattcccacctatgagtgagaatatgcggtgtttggttttttgttcttgggatagtttactgagaatgatgcgtctttggcttctaagagttctttgctgagagtaaagagccagaatctcagaaatcccccagaaagacgatttaagttaaatgcacccatcaagctttgaaggaaggcggcttaaaaaaagaaaaacactatattacattctacttttaattttcaaaacctgaaaaccttctcaaatccaggaaaactaatggtatttccatctattctctttgatagcccacaattcctatgattttcttagcatcccataatacattttgcttttatccttttactgtttttcttcctagaattttctttcaaggtccaacacagaaatcctttttctcaacaaacctttcctgactaaccctgtttccttttttaaaattctttgcattttctcaacagtttttgatatttattttttaacgtttgtatacaatactataatacagtcagttatttataactttattttgtgttagaagtaggttttttgtgtgtttgcattcttcctaattttacatgtgcaaaaagttactttaatcttatttttcttaaatgaaataatccaattttaaatccctttcctggagaattaaatataagtcattttgggggtgctttccttcacctcccccagaatctcacacaaaataaaacattcagagaattaatcgcccctgccccaccccaccctaatcttctgtccatgttggctgtcctgagttgtccactgttaaaccacataatcccttatagttcagtggctctgttgcttcttaggacatgaacatcttggccaaggcttcaatagctttctgtgttggatattttctcctggcatctccagatagactttttactcttttctttccctattctgtgcccaaaggccctgagaaaattgctaagtattagtaacatggagaaaaaagggatatagtttctgggactgtaaattattcaaaggatagttttaaagctctgggaaagtttggtgaaagttaaaaacgtgttcagagaggaggagttggagcctagtcaagtcacaaatcttctaattcagccaagctctagtagcactcctgaaacattactactatatccttaacatgtgcttttttagttcatgaaacaatattggcataactgttcccctaacaacttaatgagaaagttaaagattttaacaactcaagattgctgcctatgatacttatgatttttaaacaagttgtcatatcaataataataataaaaaaaccataaacctagctgggcatggtggctgacgcctgtaatcccagcactttgggaggctgaggcgggcagatcacctgaggttgggagttcgacaccatcctgaccaacatggagaaactccatctctactaaaaatacaaaattagctgggcatggtggcgcatgcctgtaatcccagctactggggaggctgaggcaggagaatcgcttgaacccaggaggcagaggttgcagtgagccgagatcatgccattgcactccagcctgggcaacaagagcgaaactccgtctcaaaaaaaaaaaaaaaaaaaaaaccatgaaccttcctttaggaaatagagcaatgtagtataaccccacttgcaattttatttttcagattaatgaatatgattaaaattaagatggaataaaaattaaaacaattaaataaaatacaaattggttgtataataaagacaaaattgttatcttgagacacatgttgcatctttccatatgttctaaaattccttaggaacttggcacaagtgctgctgaaataatttctgactgataagtggcagatgccttatcttttattgtggtattaattctaaatcccatcaaataagacaatgcatgatacaaaggataaatttataagcatttgcctcccaatttagacacagaatcattatcatagtacattcactttcaacttgtttctatgttctttctctccttcacatctggcctcttcatgtttttattttctctctctctcttttttttttttttttttttttgtggagacagtctcactctgtcacccaggctagagtgcagtggcacgatcacagctcactgcagcctccaactcctgggctcaagtaatcctcccacctcagcctcctgagtagctgggaccacagacatgcaccaccacacccggctatgtttttgatgtcttgtagagacagggtctcactatgtgagaggctggtcttgcactcatgggctcaggcagtccttcctcagtctcccaacgtgctgggattacatgcgtgagccaccatacctgggcctgttttctctttcttttcattctaaccataatcacttatctatttatggtttttgtttctatttctgaatacatttaaatgccagttataaaatcagaaattcttatttgtgcttaaacatagtaagatttagcagtagtttgaacttcaacatgattattaaatgtggattttaatactagtgatgattcacattttccaacttttatactttacaatttgtttttcttgatgagagtttaggtatctatgaatgaggagaaaagttaattgaattttggcttctagaaacaagtaattaatcttttcctgttaccttttaaaaagatactttactttttatagaaagatagcagtagaaaagaacaggtatttaaatctactcactgacttagaccaattatttcataatggaatctctacttctgtgaatatgtgttttgcttaacgagacctcctaaaaactcatttttatggtcattgaattttagagttagaaaagactttagaaagtgttattagcctctcattttttaaaaacagtttgtatcttgcccaaagtcacactaggggtaaagtaagaggcaaaggaagaactggaattcaagtttctagattccaagtccaggactctttctttttatctcattattttatgaaacatggagagcaagctgattgttcatttaagttcattacactgtatcttggaatttgtcatttctatgcttcactatttaaattaaaatattttatgtttatcacctgttttttgatctgccatgtaagaattttcacttattgtcttccctttaacattgagtctgcatactgctgctaaataatctttctacagtatagtcctaattatgtccctcaaaaaccataatatatctcaccccttctatcagccacatagttaaataaattaaatccaatcatttaacccattgcagactaaatctgcctttcaaatcttagtactttccactcctctgctcatattttatgggccaggcaaatggactacttacttgctattctcaggacacacgtctcatttttcataccactctatcctttcttatacatataacaactttgcctaaaattgtgcccatttgttgagactttgatcaaatttcacatttcccatttcttttgttctctctctctctgttttttttgttttttttgtttttttttttttttttgagatggagtctcgctctgtcgcccaggctggagtgcagtggcgcgatctcagctcactgcaacctccgcctcccagattcacgccattctcctgcctcagcctcctgagtagttaggactacaggcgcctgccaccacgcccagctaatttttttgtatttttagtagaggcagagtttcaccgagttagccaggatggtctcaatctcctgacctcgtaatccgcccgcctcagcttcccaaagtgctgggattacaggcctgagccaccgcgccaggccctattctctctctttttaattccaattacagtgtagtacaagcttgtccaaactatgacccatgggccacatgcagccctggatggctttgaatgcagcctaacacaaattcataaactttgttaaaagattatgaggtgggtgttgctgggtgtgtgtgtgtgtttagctcatcagctgttgttagtgtttgtacattttatgtgtggcccaagacaattctttttcttttaattgtgaccaaaggaagccaaaagattggacatcctttatgtattatattctgactttaaatattgctttccccttaatttttttttcattgtcatctcctcactttattgcaagtacagtcagcatcaatgttgagaactttttctcctaggaggtacaggatttggctctgatacggtgttgcctccacagttgctcagaatctaggctccatctgttacaggaaaggggtcctaatccagaacccaagagaaagttcttggatcttgcacaagaaagaattcagggcaagtccacagtgcaaagcaaaagcaagtttattaagaaagtaagagaataaaagaatggctactccatagacagagcagccctgaggactgctggttgcccatttctatggttatttcttttttttttttttacatgttctattttttaataaaaatatttatttggtcttatgaatacagaattattttatttttatttcaaatgcctaggtattataattctgtataatagttatttgtactttttatatttttatcttttttttattatactttaagttttagggtacatgtgcacaacgtgcaggttagttacatatgtatacgtgtgccatgttggtgtgctgcacccagtgactcgtcatttaacattaggtatatctccaaatgctatccctcccccctcccccaaccccacaacaggccccggtgtgtgatgttccccttcctgtgtccatgtgttctcattgttcaattcccacctatgagtgagaacatgcattgtttggctttttgtccttgcagtagtttgctgagaatgatggtctccagcttcatccatgtccctacaaaagacatgaactcatcattttttatggctgcatagtattccatggtgtacatgtgccacgttttcttaatccagtctatcattgttggacatttgggttggttccaagtctttgctattgtgaatagtgccgcaataaacatacgtgtgcatgtgtctttatggcagcatgatttataatcccttgggtatatacccagtagtgggattgctgggtcaaatggtatttctagttctagatccctgaggaatcgccacactgacttccacaatggttgaactagtttacagtcccaccaacagtgtgaaagtgtttctatttctccacatcctctccagcacctgctgtttcctgactttttaatgatcgccattctaactggtgtgagatggtatctcattgtggttttgatttgcatttctctgatggccaatgatgatgagcattttttcatgtgtcttttggctgcaaaaatgtcttcttttgagaagtgtctgttcatatccttcgcccactttttgatgaggctgtttttttcttgtgaatttgttggagttcattgtagattctggatattagccctttgtcagatgagcagattgcaaaaattttctcctattctgtaggttgcctgttcactctgatggtagtttcttttgctgtgcagaagctctttagcttaatcagatcccatttgtcaattttgacttttgttgccattgcttttggtgtcttagatttgaagtccttgcccatgcctatgtcctgaatggtattgcctaggttttcttctagggtttttatggttttaggtctaacatttaagtctttaatccatcttgaattaatttttgtataaggtgtaaggaagggatccagtttcagctttctacttatggctagccagttttcccagcaccatttattaaatagggaatcctttccccattgcttgtttttgtcaggtttgtcaaagatcagatagttgtagatatgcggcgttatttctgagggctctgttctgttccattgatctatatctctgttttggtaccagtaccatgctgttttggttactatagccttgtagtatagtttgaagtcaggtagcgtgatgcctccagctttgttcttttggcttaggattgacttggcgatgcgggctcttttttgattccatatgaactttaaagtagttttttccaattctgtgaagaaagtcattggcagtttgatggggatggcattgaatctataaattaccttgggcaatatggccattttcacaatattgattcttcctacccatgagcatggaatgttcttccatttgtttgtatcctcttttatttcattgagcagtggtttgtagttctccttgaagaggtccctccttgaagaggtccttcacatcccttgtaagttggattcctaggtattttattctctttgaagcaattgtgaatgggatttcactcatgatttggctctgtttgtctgttattggtgtataagaatgcttgtgatttttgcatattgattttgtatcctgagactttgctgaagttgcttatcagcttaaggagattttgggctgagacgatggggttttctagatatacaatcatgtcatctcaaacagggacaatttgacttcctcttttcctaattgaataccctttatttccttctcctgcctgattgccctggccagaacttccaacactatgttgaataggagtggtgagagagggcatccctgtcttgtgcccattttcaaagggaatgcttccagtttttgcccattcagtatgatactggctatgggtttgtcatagatagctgttattattttgagatacgtcccatcaatacctaatttattgagagtttttagcatgaagagttgttgaattttatcaaaggccttttctgcatctattgagataatcatgtggtttttgtctttggttctgtttatatgctggattacatttattgatttgcgtatattgaaccagctttgcatcccagggatgaagcccacttgatcatggtggataagctttttgatgtgctgctggattcggtttgccagtattttattgaggatttttgcattgatgttcatcaaggatattggtctaaaattctctttttttgttgtgtctctgccaggctttggtatcaggatgatgctggcctcataaaatgagttagggaggattccctctttttctattgattggaatagtttcagaaggaatggtaccagctcctccttgtacctctggtagaattcagctgtgaatccatctggtcctggactctttttggttggtaagctattgattattgccacaatttcagagcctgttattcgtctattcagagagtcaacttcttcctggtttagtcttgggagggtgtatgtgtcgagggatttattcatttcttctagattttctagtttatttgcgtagaggtgtttatagtattctctgatggtagtttgtatttctgtgggatcggtggtgatatccccttattttttattgcgtctatttgattcttctctctttttttctttattagtcttgctagcggtctatcaattttgttgatcctttcaaaaaagcagctcctggattcattaattttttgaagggttttttgtgtctctatttccttcagttctgctctgattttagttatttcttgccttctgctagcttttgaatgtgtttgctcttgcttttctagttcttttaattgtgatgttagttttgagcctatgtgtgtctctgcacgtgagatgggtttcctgaatacagcacactgatgggtcttgactctttatccagtttgccagtcggtgtcttttaattggagcatttagcccatttacatttaaggttaatattgttatgtgtgaatttgatcctgtcattatgatgttagctggttattttgctcgttagttgatgcagtttcttcctagcctcgatggtctttacaatttggcatgattttgcagtggctggtaccggttgttcctttccatgtttagtgcttccttcaggagctcttttagggcaggcctgatggtgacaaaatctctcagcatttgcttgtctgtaaagtattttatttctccttcacttatgaagcttagtttggctggatatgaaattctgtgttgaaaattcttttctttaagaatgttgaatattggcccccactctcttctggcttttagagtttttgccgagagatctgctgttagtctgatgggcttccctttgtgggtaacccgacctttctctctggctgcccttaacattttttccttcatttcaactttggtgaatctgacagttatgtgtcttggagttgctcttctcgaggagtatctttgtggcattctctgtgtttgctgaatctgaatgttggctgccttgctagattggggaagttctcctggataatatcctgcagagtgttttccaacttggttccattctccccgtcactttcaggtacacaaatcagacgtagatttggtcttttcacttagtcccatatttcttggaggctttgtttgtttctttttattcttttttctctaaacttcccttctcgcttcatttcattcatttcatcttccatcactgataccctttcttccagttgatcgaatcggctcctgaggcttctgcattcttcacgtagttctcgagccttggctttcagctccatcagctcctttaagcacttctctatattggttattctagttatatattcatctaaatttttttcaaagttttcaacttctttgcctttggtttgaatttcctcctgtagctcggagtagtttgatcatctgaagccttcttctctcaactcgtcaaagtcattctccatccagctttgttccgttgctgctgaggagctgcgttcctttggaggaggagaggcgctctgctttttagagtttccagtttttctgctctgttttttccccatctttgtggttttatctacttttggtctttgatgatggtgatgtacagacgggtttttggtgtggatgtcctttctgtttgttagttttccttctaacagacaggaccctcagctgcaggtctgttggagtttgctagaggtccactccagaccctgtttgcctgggtatcagcagcggtggctgcagaacagcagattttcgtgaaccacaaatgctgctgtctgattgttcctctggaatttttgtctcagaggagtgcccggccgtgtgaggtgtcagtctgcccctactgggggatgcctcccagttaggctgctcaggggtcagcggtcagggacccacttgaggaggcagtctgcccgttctcagatctccatctgcgtgctgggagaaccactgctctcttcaaagctgtcagatagggacatttaagtctgcagaggttactgctgtctttttgtttgtctgtgccctgcccccagaggtggagcctacagaggcaggcaggcctccttgagctgtggtgagctccacccagttggagcttcctggctgctttgtttacccaagcaagcctcggcaatggcgggcgcccctcccccagcctcgctgctgccttgcagtttgatctcagactgctgtgctagcaatcagcgagactccatgggcgtaggaccctccgagccaggtgcgggatataatctcctggtgcgccattttttaagcctgttggaaaagcgcagtattgaggtgggaatgacccgatcttccaggtgccgtctgtcacccctttctttgactaggaaagggaactccctgaccccttgcgcttcccgagtgaggcaatgcctcgccctgctttggctcacgcacagtgcgctgcacccactgtcctgcgcccactgtctggcactccctagtgagatgaacccggtaccccaaatggaaatgcagaaatcacacgttttctgcgtcgctcacactgggagctgtagactggagctgttcccatttggccatcttggctccgctactttctttctttttttttttttttttttgagaaagattctcactcagccaccaggctggagtacagtggtgcgatctcagctcaccgcaacctccatccacctccgacattgaagcgattctcctgcctcagcctcccaagtagctgggactacaggcgcatgccaccacgccctgttaatttttgtatttttagtagagacggggtttcaccttgttggccaggatggtctcgctctcttgacctcgtgatctgcctgcctcagcctcccaaagtgctgggattacaggcatgagccactgtgcctggccattcttgctactttcatagcaaaacatttggctttggctttgctattctgctttattgtactctttgatatccagtatctaccagtaatgtctggactgcatacatcgttgaaaatacaactgtaattaaagatttaaatgcaatattctttcaggaaaatctctttccctgattttgtttgatattggaaatgaaacaataccataatccttcaggataacttcccacagcaggacaactgcaggaatggcacaaaatatgaattgcataaatactcttatagaacacatcagactagcactttcccaagtttttagtcagatctttgctaccatccctgaaactgttaatgcatatgagtagaaaaattttttacctttgtaagcaaagattctactactagaataatcaaattaactcattctaatgcacatttacttaattcatactatgtgtgaggcagttttaggatgtgatagaaaactttgttttgaagaagctgataaactaggtgggggggaaacagagtacaaataaattataatgcaacataagaaatagcataatagaagaatattcagaccactaaagtcagtcaactctgatccccaaaattaagtatgaaccacaaaaaaatcaagtcagtgtcaatctaatgcagatttatttgagggcttctcttttcttctttgcttaatgtaggtgagtgctttatccttgctatttggtaaatcagcaaggatttattatctattctttgcagagtagtatgttagatgctttgaggatactaaatgaaaaagagtttctgcaccaagaatgtataatctagtagaggagataagctatctatacaaataactgtgtctgcagtctgcacataattgttataaaagaagcctttacaacttgagccaaattcttttacaatgcagaaagccactcctggaggtagagaaaggagagaacatgaacaattcaagaagacttctgttatgcaaaagatggctgaactaaccctggagggatgggtaggattttgacaagagtggttgaaggtattctaattcacttagtacctacatgtgcgaggcagcatgaaggcaaaaaagcctggggcatgttcagagaatagcaagtattctagtttgagtggcacctggtacgtatataagggaatagtaaaagatctggctggaaaggaaaagtaggggcaggttacgaaggacctctgaaagtcagactgtggaactggaacttttatcaggaagcagtagttagttttttcaagcaaaagctaattagagttgatatttaggaggatgaatctaacagttgtgtgcaaggatgccttcaaactgagtgagactagtactggagactggttaagagactacaacaataacctgagtaagaattaatacaggcctgacctagttttgagtgagtaggattggaaacaagagttttaggtattataggatttatgcatataaaatggacttgacagaacttgaagaaagagaaagtgtcaaaaggacacagaaagtgaggcaggatatcttacaatgttaaaggaaaggaataatagaagttaccccccaccccagagaaaaaaaagtaaagagaaaagattggaaagttaaaaactgaacttttagagaaagactgcatttagggaatgtagcaaataagataagcaacagaaaagtgagagaatgggaataaagatatgcaacagaaaagaagggaagagagttcctaggaaagggtggggaaattcaaattctaaaatatcgatgaagtctcatttttcatgtattaaattatccagtggagttggaagatccaaaagagagcaattaaatatgctagagtgcatggggaaaattgacaaaagacctaaaagaaaaatatttaaccacaaaatgaaaagtaataggagatgctaagaaattttggatgggagttaaaattaaatctctgaaagaataaaagggaattaatactcaatttatatcttaaataaatatttctaaatgttacactatgcagaaatccttcttccctggaaaaaatgagatcaagtcctattcaaaaaggtcaagaagaaagactgaggttggtgacccgtgagaaaagtttctgagataagtgtaggtggaatttgtagtattatttatcataagtcagatggctgttaacaaaaagttaattttacatctcatctgttagcccagtcgctttataatgttcggtacaacagaaatgccactactttgtaaccacctaaatgctgtattaccttcaatttccattgtgttgttgatacccaagcagaactcattctttgtcatggagactacagaataccacaagcaggcactaaggttggataatgtgttatctcacattctgaaaggagggtctacatggtagatacatttcttgattctgttttgggataattggctcctaagataattggctatttcattattaaatgcagtatgaactttgcagaagtattcagtatctcttaaaacctgtttcttttccatatagcagtggtacctactttcaatttagtatttattcaccatctactacatgctccacttagtgttttgtattatttctctgtgtgtgtgtgtgtgtgtgtgtgtgtgtgtgtgtgtgtgtgtagtctaacttgtacatttggccaatttctttttcaagcatgttagatttttctctctgacttctttgtagatgtggggtagttttgttttttacttaagagacctgtattgattatttctatggctgtccttgctaattcccactggccattgtgaaaaatcttgtctatggtgtatttgtttctaagacagccacattacaatacactctgtacataattactatgaatcagctggcaagaaagaagaaaataatactggttattggtaatatttgttgattttatatgttagctttattaaagatttttttttcttatcttttttctttcaactattgctacctctgaagaggcttttggtagtatttagatgggttgtgctatccataggtaaaaattctgacctgggggatattacctttatttttcactagatgtaggaaagtagatgctgctctgtttttactccattttgttacattaaaaaaaaattacaatgtagtcctataagtttctttttttattttatccagtactattttagactgtgaatattactggaatttctagttctattccctcttctccctctaaaaatcaaaagtgccaaagagtagtagaccttttgtgatatgttctagtcaaaatagctaaaaactagcgctctctctttaaagttcatattcatctagaacatctcacaccttactcttaccactttactcacagtagtttaaaaaataaaactgtaccctgtatatttgttcatttttgtgttttatgtagagtttccattttgtttttactttttttcaagagtgaattttgtaaaacttccagagtagagtaagttacggccattagagtagccctggaggatgagacttatagtggcaatgattatcacaccttgacaacttgggaagggccatgggatgtggatgtggaaaatatataaaaggacattggttcacatttgaacaaagtggaaggaattattagaaaagcacttaacaagggtgctgatctctccccatctgaggtcttctttcttcttttcatctaattttaagcactgatcagtgaattctttctcattattttacataagcaggtatctaaacttataaaaaattgattatttatcttgtcttttagtgcctttttattaatataagttatttggtttttaaattgtgttgccaatgaatgaaggaagtcctgtcaaaagatatacattttacttatcttaaggctaacagccaccatgtccagcctagcaaacattttttttaatgaaagtccaagtagtatggtctctgttaagctactctacttcaactctgtctgtggtagcataaaagcaaccatagataatatggaaacaaatagtcatttgctgtattccaataagactttataaaaacaggtggcaggatgaatttgtcctataggctgtaggttgctgatcctagcataatgtattgattatacattatggtagagccctctgttggttggaagagaggaccagggaaaaaaaagtgaagatgtattagctatacagaactttctagttggtaagacaaaaagcaagaaaattacagtaatatagaatatgtaaaataaaggaggattcagaactgagtaggtaattcttcagagcatgtcaaatgtagattatggtaaagtagaatgtttatggtttaatacatcaagaactatatccttcataaaataaaatgtagctggacatggtggctacatcttagccaccatatttttacatgtacatgtttggtacaggcttatggtggcatgtaattccaacattttgggaggccgaggcaggtggatcacctgagatcaggagttcaagaccagcctggccaacatggcaaaaccccatctctactgaaaatacagaaattagccgggtgtggtggcgtgtgtctgtagtcccagcttctagggagactgaggcatgagaatcgcttgaaccggggaggcagaggttgcagtgagctgagatcatgccactgcactccagcctgggcaacagagtgagaccctgtcttaaaaaaaaaaaaaaagtgaagaacaaggtaagacacatttaatatatctgatcaagtggtcttgtccaaaaaatgtcctgatacatttttttaaactaataaatggaggattgcagacttactgaatatggcaggatcctttagcatgtaatactttaaaatggatccacactgaacttctgctggatgtactggagtaagagtggccagatttatcctccctcctcaaacaatgcaaaaaccagacaaggtatataacataagagtttttagacactagacaatactgggcagtgatccctgagagaaaatgaatgaggcatccctacaatttccatagcattctgcctagatagcttccagtctgtagtctgcaggaaggagatccaaaacagaaagaacccagtggcccaactgaatggagacaaagccaaggtggctagaatttgcatgagacagtgcgagagaagacagagctccacagagatagagcacacacactggatatctgcagagggctccccttgatttttaagccaagtactgaaccacataagtatgctaggaaactacttagggacagggataaagccactggaaaggaataagtggaacatttcctgaactcagataagattaataatagtttatagccccaataatcacagtggaaaagcctctaataaattggacatcttttttagtactcaaaagaatattacatcagttggggacaatattagctctagattaagagctgctctcatctcacctagtaaagcttctaaataagcttgtaaagaatcaagttgtttttgagtaaccaactgaatttcagagtaaagttagggccattagagtagccctgaaaatatataatgagaaacaaaatatttgatatggtttggctgtgtccccatccaaatctcaccttgaattcccacgtgttgtgggacccagtgggaggtaattgaatcatgggagcaagtctttcccatcctattctcatggtagtgtataagtctcatgagatctgatggttttaaaaagaggagttcctggccaggcacggtggctcacacctgtaatcccagcattttgggagtccaaggcaggtggatcacttgaggtcaggaattcaaaaccagcttgaccaacatggtgaaaccccatctctattaaaaatacaaaattagccaggcatggtggcacacgcctgtaatcccagctacttgagaggctgaggcaggagaattgcttgaacccagaaggcagaggttacagtgagctgagatcatgccattgcacttcagcctgggcaacaagagcaaaactccatctaaaaaaaaaaaaaaaaggagttaccctgcacaagctctctctctttgcctgctgtcatccatgtaagatgtgacgtgctcctccttgccttctgccatgattgtgaggcttccccagccacatggaactctaagtccaaataaacctctttcttttgtaaactgcccagtcttgggtatgtctttatcagcagcatgaaaatggactaatacaatattctacacctaaaacataaaattcataatgtctgttatccaatcaaaaattacctttcattacctgagaaaggcattgttaaaaaataaataagtaagccaggcacagtgacaaatgcctgtagtttctagctacttgagaggtggaaacaagaagatagcttgagcccaggattttgaggccagcctgtgcaacacagcaagaccctatctcagtcaatcaataataaatacacacacacacacacacacacacacacacacacgtatatataaccattcatgcgaagaagcaggaaaatacaacccataatgaggagaaatattaatagaaatggatttagaaatgatacagatgttaggattcgttgacaaagatgttaaaacagcatttctaaatatattatgtatttcaagaaggtaaataaaaacataatcctattaaagagtaatgtgggaaatgtaaaaaaagacctaatttctagaaataaaaaataccatgtctgaggtgaaaagttcactgggtaagatgtggcactacagaagaaaagattaaggatcttgaagacatagcaatagcaattgttcaaaatgaaacacctagagggaaaaaaagactggaaaaacaagcagtgtcactgtgagctgtgagacaactttagatgatcaaatatataaagactacggatggggcagggagacagaaaaaatatttgaagacataagggctgaaatttttccaaatttgataataactgtaaacccacaaatccaaaaagctcaacaaaccaaaagcagaagaaacactgaaaagctacaccaaggaacataatcaaattgcataagatcagtaataaagaaaaaaaacttaaagtagctaggtttctaaaaacaacaacaacaacaacaaaaatgcattacatacagagaaacaaagataagaatagcagcagtctcctcaacagaaacaatgcaagctagaccttggaacacagaaggaaagagaatattaacccagaattctagacccagtgaaaatacctttcaaaaacaaaagcagaatactttttcagacgtataaaacctgaaagagttcatcagcaggagaccattcagaaagcctcagatctaaatgctgcctgtaacaattacctgctgtatggccttggacatacttgaatctctctgaaccttcaaattttcatctgtaagataaaaataatgctaatttttaggggtttcgtgagaatccaatgatagaaaggaaaagaactgacattcattgaatgtcttctttataccaaccacgtattatctcattaaaaatggaaataacctgcctgggcaacatggcaaaaccctgtctctacaaaaaaatacaaaaattagctgagcatggtggtgcatacctgtagtgccaactgtttgggaggctgaggtgagcctgggaggttgaggctaaagtaagctgtgatcctgccactgtattccatcctgggcaacagagtgagacccaatctcaaaaaaaaaataaaaaataaaaatggaaataaaattcccaataatagggctactatcctaacatttttcttatgctagcctctttcttcttgttctttaatactaaaaacttgggttgttctgaaagaaattagtctaagtagcttgtctgtcttacgttttgatgaagcactttttcctaacttaatttgttctttagttaccagattaaatatgcttaaaagtgggaatgaacaactctccttgctagaatagacaagtcagttaatcactttgtgaaacagttaagtttcttgtaaactgcactttatttttttgcctgtgttttggctgcttaatttttttcagttatgtttattgaggtataatttatatactgtttatctaatttttattataaacctattggatagaggcatgagtgtctttatagctgtgcattgccccatagagtttttggcactcaataaaatgttaaataatatttttattcagcattctgtagacgggaagcatatggtaacaaatgtcagagcacaggttgaaaatctccaaaaagttatatgatatattctttggaaaagctagtagagatacttttgtgaatgaaatttctcttaaaaggggttcccagactcacattttatgcaacaaatttctccagccttcagttactttatttacaaattaaagtttttccttatcagaaataatgcataagttaaaatagtataatactaacgtggtatcataagaaagtatataaatggtttgatagataacataaagtaaaggtaactcatagtttgaaggacagcatgagaaaatatttagaagctttagcagtataagtctttatgttgtgatatattgtatgaaaagaaatacacagtggatagttctttattgttaaatttcagcatgacttagttatgtcactgctacagctgttgcagacattctagtggtaggagactttgactcaatattgtttttctcacctgaggattctagcactatttaatactcttattttagtgtcagaaacaatcattgcttcagaataacagaagacattgtgaattaaaacttcaaataaatttcatgcaaaggataatatctcccggttaatctgtgttgaagaaatggttgaccataatcaggtatacaaagccatttagatagcatatatctaaattttctttccagaatttgcttaccctctgatttgctgaccacacttgctttgaagttttggtttttgttgtcttgctatgttgcccaggcatgtctcaaattcctggacacaagcaatcctcccacctcagcctcccaaaatgttgggattacaggcatgagccactgcacctggccactttgaagtttttattaacataatttgaatgtgaaattacctgagtttttcttgttaacctcatgtataaaatgtgggatagggaatccaggcactgcttacttagcttggtgcctctggctctcataagacttttaataaaggtgtcaaccaggtttgtagtcatcttgctgctcagctaggggaggatcttcttccaagcccactcatgtccggtcacagccctcagatcctcactggttattgatcatgcaccactccatagtcctcacaacattgcaacttatttctcctagagcgagggctcagagagagaaggcttgtgatcaagaagatgaacaaaacataccatcacttttgtcatatatttgttaaagcaagtcactaggtctagagcacattcaaggggaggagaatgtacaaggatttgaataccaggttcaaggatcattgaaaaccattttgaagactgcctcctacacatataatccacagatgggacagatcattaaagtactctaggtgctctgacactcatttgtttatcctgagatcttaacaagaacttgaattcaataggcaaaatgatttcagtttcacataaagtatttcatttattcctagcaacaatgcaacgaaataggtatggttaaccccaatgttattgatgaagaaattgatgtactgagtgactggctcaagattacatagcaaataatttgtaaaactgggaccttagtgtaggccttttgattctagaccctgtactctttccattggctataattgcttcctaccagtactatgttgcacttaaagccattcaaggagaatattatacctctaaatttatatacaattatatgaatttttattatacagagatttttatacatatatgtagagaaagacagacacccccctgtcttaatctctaacctataccactccgtttaggagttatagtattattgagtcaaagtctaatatcattataaggcctgtaacagctgtagcaatgacacacatgtacacagatgctagcagcctaaaactacacttaggaggtaaatgtttgttgcatggagagatgaagaagcaaagtaagaaaacagacctggtctggtggctccattcccccttggcttgtcagtatacagaaatcattgtgtttctatataactagtaacaaataattggaattgcagtgagtatgggcaagttatggttttagtttaatattgattatagataattctactttataagtaagaacttgtgttatcagatgaaatatagagaaagttttctcctccatagttgtctttcatatacgcaaacatgcacttgagtttctttcctttcctgcataatctgaggattgtgctttttaatagtggcttgctgatccctttaaatagctcttaatgtaagtattccatagttttcattaatctgattaacatagtttttccctaacctccattcaaaaactatatttggttgttgttttaccctggttgctgaagcagcaagcctactgcaaaacctaagtggtgtggtatagatgagagtctaagactttaattatatgtcattttattcacaacactcaattccaggaaggaaaaaatgggtctgtttttgtaaaggacatattatgtgagtatcattcattgtaaaccaaaaatgatactgtattatagcatagacaacaatgagaactgattctgaaaatgtgacctgactgagaaactgagtaatagtgaaagttatcaaaatggaaaaaaagcgttaatgtgaaatccagccttctcagaaatactctttcctggcctgtttagttttgcttttgttgcttgtcatgcatgaatgaaagtgctgtactctcaggggagcaggaaagcctctgtgtcggttgtttatttccttaatccctcctcctttgtgatttttgatgtcagatctaaaatggaaagcctgtaaatataatgattatcacacggataatcacctgcattaggaaccgccctgcttttctattctaacccgagctgttctccacatgtcacatccactctgtggttggattttaacctgactgcttcattagatttgtgaaactcagtacgaggcgccctggggcagcacagatggggacttgcttgttttcttttctcacttttactgcaaaggcacactaaaaagtccttttcaatttagtgcgatcagttcacttggaattatctctgatatttggaacctgtcttgctcttctgcccaccaactatgcctattctttcttccttactttctgacctaatgtcttttctttctgcctctgcatgtcatgaatctgacaactaaaattctgcttacaattcttactgggtcaaactgttcccccgtgttgttttgtttgttttgctgacagggaaaaataaatgttgttccatcattgtacctacaaacaccttcagatcagaggttagctgtgggaaagtctgcagtgatatgagccagctgccttctctaatggagtgacttggggcaccagtccaagatcagaggaaggtgggaggaagtcagaagataagatcattttaagccacagaacaacaagcttagcttttctagtgatagggcacagctcagcaaacctgtgtgagggggcactaagacaaaaaattgagttgactttttttaagtacatctttcctcagtcagaaatatgttgatgcttgaaatagtttacagacatggaagtgtcctagggcctggtttccttaaaagataatgatttgacatttatatatgtgtcttcttgcagttagtcagctccataccataacagatcacagttaatttttaaaaataatttttttgggctgggcatagtaactcatacctgtaatcccagaactttggaaggccaaggcaggtggatcacctgaggtcaggagttcgagaccagcctgatcaatatggtgaaacccccatctctgctaaaaatacaaaattagctgggcatggtggcacacacctgtagttccagctactcgggaggctgaggcaggagaatacctttaacccaggaggcggaggttgcaatgagctgagatcgcaccactgcactccagccagggctacaagagcaaagctctgtctcaaaaaaaaaaaaaaatatatatgtatatatatacacacacacatatttatatacacatatatatacatatacacacacataaattttttacagttaatttcttatatttgagcaaaactggacattaaaaaaattttactgtatgtgaattttgagcatttatggcttagtgcaattttagtcctacacattcttcctttgaactttgtcttacagtcccctggggttctctcatgtctctgatgaagttccatataaataagtggttctagtatagcttttttgttgtctttttcatataagaatttgcttggttcagagtgacagcttgggaagcactacatcaatagcttttgaaccttttcctattccttgatatcaccgccagcaaatgttactgactatgtgatgtacaaagttctaaccttgcttgcacaaattgaccagttgtcaagatcaatatttatttgcttatttttgtctacatgaactaagggtaacttggtcaggcttatgtttctctagtaaatagcgtaaggagttgtactttcaacttaacacttcctgttgacttcagtgtttagctgtaatcatacattttgacctttctaaatcctcaaaatggttctctaacctatatgttattagtacattggaccataggtgcatacatgtatttttttcccaatgttttcccaaatttctgctgaagacactgactgtactttctgccttacatggcttgatgctacagtcgttttagttgagttggatctgctcactactcaggctcaaatcccatccttctattaatatctcttggcaaagataattttggaagaatgtgagttaagatgtagagactcttgacagttgtctgcagttttttttttttttcattttcaagagggaagtagagttgaaaagtaatattgcctcccttttctatctgtcctaaaattaaagtataagcacaaagagtgaagaaagggaaaggatttgattacacatatgtatttttgtcatttagtaacctgttataagagccttagggtatataataatcattagattgtgtccttaagatatttaaaatctagaagaactttgcatattaaaattttttaaccatacatatttttaatgctcaactgtttttaccctgtcatcttatattaaagaggatttttggactgtttattataaaaaatttcaaacaaaaaaggagacattggacccctacatagcacatacatctagatttaacacttgttaacattttgccacttttgcttcattttaatttttttctgcagtattctaaaataaattacatatatcatgacatttcatttctaaatacctcaggattcatcttaagaattaaggacttttaaaatcaaactgataattcctaatattacctaattttcatttcagattcaaatttctccccttgtcccaaaaatgtcttttatagctggtttgtataaaccaattaaggtttatacattgttcttggtcattttcccttttctactttacattacattgacttgttaaaaacattaagctagttgtcctacagaatgtcctaccctatgaatgttttcagttgctttctctgtgtatactttaacttgttcccctatcctctgtatttcttatagactgcaagttactggactaaagttttgattaattcatattaaagtatttaggttagaatactttataggtgatggtgtgaacttcacactgcatcacaacagaaggcaaagaatatttggtgatcccactattagtgatgataagtgatagcatcgatcactgggttaaagtgatgacagcttgatccttccattataaagttatgctttgctcccgtgaccagcatataatctgagatactttgattccatggaaatacccagttccctatcatcctttttacccaatgagtttaacatctactgaggatccttgcctgcataaatttcgttatgaggattgcaaaaagatgatttttctgaatttatacatttattagcaggcattcttctctacataagagctttttgagaggtattgttttaattaaaaacacaaccaccagcatattccttggattgtctttctttgctgaggtcagaacacctgaactcactgtggcagctacagtaaaaacatgtactacatcttctttattccaacttgtgaagtgtgttgacattaggctgcctttttttattattattattccaagggaaaaaagaaatctttattgctgtaagaataaaaattgaactatgtgggtatattgagataattgtgtaaagaagaagactgaatgagtttcaaaaaatggattatttcttcattaccgagcactttataattaactgttcttttttttttttatttcaggaagctgccacttttgctagagagcaaggctttgaggtgagttaacccacaattgcacactaaacagatcctaaaggttttttctagctgataatgaagttcttttggacagtgattgatgtgctattatactctcagagcctcgcagcagttgccatggaaacttggcagtcgtcatggtttctttgttctgccagcacagtgttatgacgcactctgctaggtctgcacccaacatcgcctacagatgttatttattgaattttgaaaagcctcttgggaagccaagaggttgggcacggtttcaagctgcctctgcagatatggggcctgtcagtttgttcagttaaaaagctacctcattagctgcattacatttcataaggattcactgctaaagcagtggtggaacaagactaaataatgaaatataatgtcgtttaaataatttcagccctatcacatgtagattatcattatgcaaattaatttctaaaaggttgtacttaacagttgttaggaactgattaatttaaatcctgcttttataaacttactctttgaacctatcttttcttctctctccctctttttttctggggagacggaggtagcataaaatatacatacattttctgaaataaaatatcaataattggatttaatttctaggtcctaattctgtttttctgatataagtgttatcctgtcaagattcaaaactccatgtggttgttgttggcaaaactgagataaccgtgttttttatctgtataatacccctcttccaactgattgttagaaaacactgactaatatgaacccaggttaactgacagagaattaactaagttggagttgtttatgactatgatatttattgagtgaactatgtagaatgctgtgttcttacagcaacttaaagtgttacagggtagtaatttttaaaaatttaatctaaccacagccgaaatgtaggaactttctttttatttgcatattcagtattgtctatcaaacagggaagaggtgagtggtgattgaatagtatcagtaaggactagtaagctcactttgaactctagagaaagatattatatgagtttgtgaaactctttttaaatgtagtaaaggcagattatcaagcagcaaagtaatacatgttcatgttattcatgtcatcagacttgacaaacgagacatagagcttcctcttcatagaggaaagacaaggaacatgtgatacagatattctgttctgaagatcctataaaagaactactccagagtagggaaacttgcttctttgtactcaattattaggagctgtgatagtttcttacaagtttgcttttttatgctttaccatattatagtaaatctaggtttaagtcacatttagaaaaaggatttccaagtggtgggtttttttctaatttaagtttcacattttaatttcccaaactggcaattatatgtaggacaaaatgtaatcatgggaatattcaattaaaaagtcaaatgttttgatcatgagaatataaataaaaattttcaggaattttttaaagttttactgattttaagttttaatattacaaaaattatattatctgttgatacatcagaattctccatagaagaaaactttcagaacatacatttgtatcctgtcagtttactgtgttaccataaaaaatgtatttttggttctataaaataaccaattttgcagatacttagaaatataatttgttatataacatgatcatgatcctgtagtatctacatagcagtttttaaaaaatagtttattaagcctgattaatacttttatttcccccttgagctacttgcttttcatgtgcctggtttacattcagtcatagcaacaaactactttttctattttccattaactagcactatattcacctttccattagttcttacttactgattcttgaattgtttttgccataaatctgccataattgattacagcatataagcaaaatgataatgattataatcacataccttattacctcctgacatagcaaaactgctctgtcagtgatattgacagtgatatgttagactaaataaagcacatagtgtcttgatgtgtctcttcgtagattcccaaaaccatcacaagcattgcagaatatatttgaaccatgagtagggtaccctcaaatagatatttttaatcaaatgtaatccatgtatggaacactatctagagaaattcaatgattttataatgtcactaaagtttcctaggtcattagacagaaatggcagagcataggtttgaaacttggtattcttaaggaataaaacaaaaataaatcactttatcttaatagttttctgtgtgaaaatgcattaatactcttggctagtgtgacaaactagacaaaaatctgcattttatcccttctaactttaattttgactctaaatttggagcatgaatgagaagaaagaagtgaaaagattaaaagaaaggaaaggtgagtattttttccttccatcagtgccgctgtcctaccctcattttctcctataaatcccaatcagttccaaaagccactgagtattgccactagtgatctggctgctgacagaccaatccaagcgcctctaaaaataaccagtgtttattcgtcaggaaatattctcagtggcattttttttttaattgattattattctggttagcttctctgcaaattttacttttgtaaaaaaaaaaatctttaaactgaattcggcagttttcagtgagaagcagcagcttaggagagcactggagaatgagataaaaactggagctgggcagaacacaaagcataagagaggatttttttatatatataggtgatggaaaattgcatagtgcctgatttaaatgacagacctgctaagaatttaaaatgacaattcttggggtaaaaagttttataaggccttttattattctagaaaatcagttcagactggagtgtgtttttaaatctagcttttcttgagccgaactgattaaatgttcgtatttttagaacataaataaaaataaggtgctcaaaagcatgtttcattataaagccttttttaaactattgaaaattgatttaaataaagtgaagaaaatacctcaaaacctaaatatatatattctctatcttttcattgtctctgcaactgagtaaatgacaaatgatgaagagaattcataccttctctattggatcatttatttccttttactccaagtaataaattttagattttttttaaattttagatctctaagaataatacttctgctcataggggaaacaaagcaatccttttcgcctttttcacttcctccatagcccctgactacccagaagatcctagacttgtagtctttctctgaccaatgaggattctttcatcttacaccactgaaagagaaaagtatggaattgtgctatccaatacagcatctactagccacatgtggctatttaaattaggattaattaaaattaaataaaatttaaaattcatcacttcttggccttttggctaagatcaaatgtaaaattttaaattcagtccttcagtcatactaggcacatattgagtactctatagactatgtagctaatgactactttattggataatgcaggatagaacatatgcatcatcacagaaagtttcattgatcagcatggatagaaagtctacagagaatgtattcaggcagtgttgattaccaaagaattaccttaggtgacttttaggttcctgtgttcttcacaaatataaatagtgcaatgaatgatcactcagagtttcagagtttctgaaaataagaccctaaatcaggccctgctggctaagagagtgcagtgttgtttttgtaggtgcctgaaccccaaaagaggacaattttagaacagttcagttaagggaaagcaataagctagtcttctaattctcttcatttaatcatttatttattcaacaaatatttactgagttcttactatgtacataccactttgatagaccccaagacaaggtggaagtgaccagagagtgtaccatgaaagagcatgtgggaagggttcccattttagctatgatggctatggaatgaccctaaaaatatgaatatctagcaatgacaaaaaaaaagcgacacaaacagcaaaacaaatttcaaacagagagaacaggactataaaagtctctgaacgagagagaacttaatgtactatgtactccaggaactgacagaaggccagtgtgactggaatggagttagtggggacagcatatgagatcaatctggcactgacacatcatataaacagcataactattaaaggagtttctatttggaaaacaaaacaaaatggtatggctagatgactcaatgtgtggaaacactacagttggttttctacagaactaggtagactgtgacaggattgcttaacctttgtataaccagctggttaaaaatagaataaagattttctttatccagtctatcattgatgggcatttgggttggttccaagcctttgctattgtgaatagtgctgcagcaaacatatatgggcatgtgtctttatatcagaatgatttataatcctatgggtatatatccagtaatggtattgctgggtcaaatggtatttcttgttctagatcctttaggaatccagttcatgttctttgcatggacatggatgaagctagaaactatcattctcagcaaactaacacaggaacagaaagccaaacactgcatgttctcactcgtaagtgggaattgaacaatgagaacacatggacacagggagggcaacatcatacaccggggcctgttgtggggtggggggttggggagggatatcatcaggagaaataactaatgtagatgacaggttgatggctgcagcaaaccaccatggcacgcgtatacctctgtaacaaagctgcatgttctgcacaggtatcccagaaattaaagtatgattaaaaaaaatttctagtaatagtaacactactagtaattcaaatgaagtgtgtgtaacagaagaaataaaaaaaaaattaaaatgctacatctgaaaatacctatttcatacaaagcaaggaggtaaagaagggatagaacatatttttttaaaatatgacatatggaaaacaaatagcaaatggcagatattaattcaactgcattaataataatgttaatctggagtaaataatatgataaaaaggcagaaattctcagactagataaaaaaactgaggtctaactatatgctgtctgaaagagatgtatcttcaattcaaagatacaaataggtaaaaaaaaaaaaaaagaatgaagagagtatgttctttgatttggaagacaatgtgatcaccaatgacaataaaaccatatttctacatttataaaatgctcacagtttataaaacctttcccaacatatcagtaatacattcatacttgcacaaaccttgagagataggtagggcatgtattgccatatcagttcaacagattaaaaaaataggctatatggccgggtgtggtggctcccacgcctgtaatcccagcactttgggaggccaaggtgggtggatcacctgacatcaggagttcgagaccagcctggccaacatggtgaaaccccatctccccttaaaatacaaaaaaatagccaggtatggtggcagatgcctataatcccagctacttgggaggctgaggcaggagaattgcttgaaccaggatgtggaggttgcagtgagctgaaattgcaccattgcacaccagcctgggcaacaagagccaaactccatctcaaaaaaaaaaaaaaaaaaaaaggctctatgactttttcaaagtcatatagctaatacattatgtagccagaaccagagctcagctctctatgtctggtgctctttactataaagcacacagctttctctcacacattctaacatgttggaagaggagattagatttcaaaatgactttgagaaatgaaaaatacctttttttttttttttttttttggggagggggtttggctttgtcacgccaggctggagtgcagtggcgtgatctttgctcactgcaagctccgcctcccgggttcactccattctcctgcctcagcctcccgagtagctgggactacaggcccccgccaccacatccggctaattttttgtatttttagtagagacggggtttcactgtgttaaccaggatggtctcgatttcctgacctcatgatccgcccgcctccgtctcccaaagtggtgggattacaagcgtgagctaccgcgcccatcgccatatcagttcaacagattaaaaaaataggctatatggccgggtgtggtggctcccacgcctgtaatcccagcactttgggaggccaaggtgggtggatcacctgaggtcaggagttcgagaccagcctggccaacatggtgaaaccccgtctctactaaaaatacaaaaattagttgggtgtggtggcgggcacctgtaatcccagctactcagaagcctgaggcaggagaatcacttgaacccaggaggcagaggttgcagtgagccaagatcgcaccattgcactccagcctgggcaacaagagcgaaattccatctcaaaaaaaaaaaaaaaaaaaccactgaaattcgctggagtaaaaatatgagccaaattaattaagaaaaaatagcaaacttaaacacaagatcaggaatgacttgtgaatgtggtaggaaaatggtttaggatgaacatgctatagttttgtgataaaaaaaaacaacaaaaagcacattgctagcatttatagaagcactataataatggttaagtgtattatccttggagtcagactgtgggtgctagtctgttctccactacttgtatttatgaccttaggcacattacttaacgtctctgactcagtttcttcatctataaaatggcatattgtattagtacctactgcctagagtagttcagatttaatgagtactttattttattgattggttgattgattgttttgagacagcctcactctgttgccctgactgaaatgcaatgatacggtctcagctcactgcaacctctgcctgctgggctcaagcaatctgtagattcaatgcaatccctatcaaaattccaatgtcattctctctctctctctcttttttttttttgagacagggtctggctctgttgcccacgctggagtgcagtggcgtgatctcagctccctgaaacctctgtctcccaggctcaagccatcctcccacctcagcctcctaagtagctgggactataggcgcatgccaccacacctagcaaatttttgtatttttttgtagagatgaagttttactacgttgcccaggctagtctcaaactcctaggctcaagcgattcacccgcctccgcctcccagtgtgctgggattacaggcatgagccaccacgccttaccttaatgaatactttagagctttatacatggcttttagtttcttcatctataaaatagggataataatagtacctactgactagagaagttaagatttaatgagcactttagagctatgtacatggctcacagctcaattttatgagctttcaactcatacttcttactcctccctgtcttcatcttcttcgttatagatactataattgaatgttccatattcaaaactcttgaagccctttctagcgattttggggcaacctaagtatgtaaccattttagagagtattaaaatgagagtaattagaggaaataaattaatatttaagttcttagcatgtgctaaaattgcattaagctatttcacttacctcatcttctttcatcctcacaatttttaactttttattttaaaataactttagtcttagaaaaattacaaaaatagtacagaattcccacatacccttcacccagtttaccctaatattaacatcttacataaccaaagtataatgaataacagaaaattaacattaaactacaataactgaactatatacaggctttattctggtttcaaccgttttttctctagtttcctttttctgttccagaatcgaatcccacattgcatatttgtcatgtctccttagtctcttctaatctgtgacagttcctcactcttgttgttcatgaactttatacttttgaaaattattggtcagtcattttgtagaatgtccttccatttgagtttgtctgatgttttctcatgtacattgagattaggcatttttggcaggaaaaccacagaagtgatgttcctttcttggtgcatcatatcagggaggtacacagtgtcacagattcttattgctggtgatgctaaacctttatcactaggtttaggtggtgtttgctagtttatcctctgtaattcccattgtatttaataaatatcttggaggagatactactttggggctatggaaacattctattttatccactaattttagcatcactaaactaatctatctggcttaaggtgatgtctgtcaattttctctactataacattatgatttttccttttgtaatgaatatcttagggggacatactttgagactgtaaatatcctgttttctttaatttttgcccactaatcttagcatacttatccctcaaaatcttttaatgtgaacattttcttagttttgtagatgaggaaatggatcttagagaggtttattaacttgccccaaatcatacaaatagtaaatccaagcctgtcatattctaaaagtccttgtaatttcattgtttgttaagatgtgtgagcttaagtgtaagggagaagaacctattggggacagaggagaggaattactgtagaaggagaaataaagttttacatacatctgggaagaattatgttttgtacttggaaagtttattttgtcctttaattgccattttatgaggtttaatttgagacataagaaacatttctttgattaaattaccaaagctctcaacaaaatatgtcttctcacagggttggtagaaagcaaccatggaatcttattcctttttttttttttttttttttttttttgagatggcgtcttgctctgtcaccaggctgcagtgcagtggcatgatctctgcacactgcaacctctgcctcctgggttcaagcgattctcctgcctcagccctcccaagtagctaggactacagacacgtgccaccatgcccaactaatttttgtatttttagtaaagacgggatttcaccatgttagccaggatggtcttcatctctcgacctcgtgatctgccctcctcggcctcccaaagtgctgggattacaggcgtgagccactataaccagccagaatcttattcttaatttattccttatatcaccttgaagaaagactttcttttaaagaacatctagtacattcataagattctgctttcaagatgatgaagtgaatgtgtttttctcttatctttattaaatatgagctgtacttaatcacaagcaaaaatcctatagtagtaaaatatatttgtgctaaggaaattgccaaaatatacatgagtcattttaattatatgtgtacacttatttaggtgagtgaagacattgcatggcattttttggtcctttcagctgttactagtcatttctaaaagtctgtctcctgaaactgagggaatttcttctcatcttatcagagttcagacttagttctgttctaaaataagcaaccgaaagcgaaatagtcagcatgtttgaagtcagcagcactgtcctactacaaatggctattcttttcagaaacaactgtcctctagaagtcatcctgttaggtatattagaagcttagcttcatatattatctggaatttattaaatattgagtgaacaaacaatataaaaatatttcaccactaattgtcatccctttaaaaatgccagtttctggtgacgtttgtaacgattgcaaaccattgtgacttgtctgctttgcttgcctaaatgttctctctcatatattctatttgttctcttatatatactttatttatgccactcagctatatttccgctctgataggtgtttctttctctataactatttgaaactttgcatagtgatagaataaactagttttgttagcaaagcccaaaactatggacagttttaaaagcccactgaatacagacatggattttcaaattatccaaaatggttgaaaagatgattctaaaacctctgcctttagctcaaggttaggtttcaagatttcagaaaacttcaataaagatttcagtaaaactttatggcctatgtggtgtgaaaaacagcatcagagtttgacaattagtttgtcattttttaaactttatcttttttaaagaaaattaagtctttgtaggaaaggattagcatttctttctctcaaatcagtcctttgaaaaattgacattataagaactgtattttttccaaagtcagcataattatgttctgtaaacctctaaaataattaaattttcctctttataaaaacctctctttaattgggaatttgaaaactgcctggatatttgctgatacttagtcattgttaataatttttgaagtatgataatagttttgtggttatgtttatcattacctttcaaagatatatactaaaacatttatagatgaaattatgtatagttcttggagtttactttagaataatttgaaaagcaagtggatgaggatataggtgaaataagattcatcatacattttaaatttgtgtagatcattgatgggttccttggaagtcactgtgctattctatttacttttgtatatggttaaagaaatttttaatgtctcttaatagatatgcaggtctcttattttgatcaatagaagctaaattgttaatctactaataaagttttgttttattttattggtcatgagaattttttccttccttctattaatagactaaagacattaaagagatagccaaaaagacacaagccctgccaaagatgaactcaaagaggcagcgaatcgtgatcttcacccaagggagagatgacactataatggctacaggtacatgtgggaaatgtgtgatgaatctagtattatggagattaatcaattacaaaaaaaaattctgtattctttctattataatatatacaatatacatatacaatatatataaaatgaaatattttattttaataaatatttctaccctgtatctcagtagaaaagatttcatgttcaagaagatagtttattaacatttagttaaataaaccactttgatataatttatttacttagttatcttggggattttgtcaatcaagaaatatctttcctgaaaaaaagaatacatttcatttataaaatacctgcactagagtaaaataaatttactcaattatgaacaaataaaatccagaactaagttacattttccatttttccttcaagaagaaaatctcattttttgttttatttcaccatctattttatagcactcataaaacaggaatttcatctagtaagcaaacatgttattgattaaaatgattaatagtgttaatatggagctacccactattaaaaatataaatgttttaattctgtctgtaccattcagattaaaaccaatcagttgattagttattgtaaactggagcaatttagtattacctatgtgtttgttcagtactctgctgaacactgaaatataaaataggaaccttaaagatctaactgggaattaatattcataaaatataagtacaaagtaaaatataattatagttcttatctattggtgctaactatatggattgtattgactcaggagatcagtaaatcttgaaaaaagatgttatagtgaatatgaagtacatttgtgttgaattaaatataaagcctgaaataggccaaagatgaaattactgtcaagatattttctttcttttttaaaataaattttattctttatatttgaggtttataacatgatgttataggatacatagatatatatagatcaactttcttatttcagaatggtcaaaagcaagattcagagatttgtttcaaaaaatatttgcttcaaagtagttcagtgagtggtagataaagtgagggtataaatgaaatgagactggtaatgaattaattgttgaagctagacagtggatatatgggggcatcattatgctattatctccacttgtggatatgttttaaattatccataattaaaactttaaaaaaagaaagaaaagtttttttttttaaatttcaaacaagattcagagatgttgagtggctttcccaagatacattgatatccttgctaatccttaaattctaggaaggattaaaagaaaggaggacaagtgggcacagtggctcacacctgtaaccctagcaccttgggaagtcaaggtgggaggattgcttgatcccaggagttggagaccagccttggtaacagcaagacttcatctctacaaaaaaaaatggaaaaaaaaaaaaaattagctgagagagtagtggcacatgcccatagtcctggctacttgggaggctgatgcaagaagatcacttgagcccagaagttcgaggctgtgttgagctatgatctctccactgcaccccagcatggatgacagaccaagaccctgtctccaaaaaaaaaaaaaaaaaaaaaaaagaacggagggcaatggagtcaaagaggatcaagtaagcaaaggcacaagtactagcaatcttttattgtgatggcaagaagaaccaccttgttaatttgtacaagagagaaaagaaaccatgaaaagatatccctgcactgatacaaactatctgaattgctttcttcctatagtataaggattattcctgtcttagcagtggacagtttagaaaagtgaaaaacatacaggcttcttataggaattgtagtactaccttcagatttacaaaatattctttggttgctctttgtggagacattcattttaagtctttgtatattctagatatacatactgtacaagtgtcttccttattgtgaatttgcagttttcccaaaattgaaaattaacctccccattctgtgactgtatttccttgtgaactcattttattctttattaaatctattaagccattcttaggaatgcttacaagctggaatttatttgaggaaagacactggctaatctttgctgttcctaccatatgaaaatgaacttaaatcaaaggatgcactatatctgcaatgcatgataaatacaagatggatagagaatctgttcagtggtgtcagctacaaaagcaaacatgataaatgttaatgcagttttgagccctgggataagctattcagtgcacaagtgtagctgaatctctttgctatgttgttattcattgcagccaaataaatgtcaataataaaagagaattaaagattttcatttcccagaggcagtcctctaatacggcttgatctttcatttcatttgtaattcgttctcatgtcaggatgcaatcattcgccaggctctgggtgtcatgttaagccatttaataatgattaagaacataaaaatgcttggcctgtggggcaattcacaaaagagatgccaatttgttattgttttccctcctttcctcttgaatatggatcagctttttcccacctcctagcattaaaatactaatggaagatagggagggaaagtgtcccttaatttaccataagtgacattccagaatggcacaaggcagtgctaacacacatattaaaagactaattaggaatcattgtgccttaaacctatttttttttaatgatactttaagttctgggatacatgtccagaatgtgcatgtttgttacatagttatacacatgccatggtggtttcctgcacctatcaacccatcatctacattaggcatttctcctaatgctatccctccctgagctcccccaccccccgacaggccctggtgtgtgatgttgccctccttgtgtccgtgtgttctcattgttcaattcccacttatgagtgagaacatgcagtgtttggttttctgttcctgtgttagtttgctgagaatgatggtttccagcttcatccatgtccctgcaaaggacgtgaattcatccttgttatggctgcatagtattccatggtgtatatgtgccacattttctttagccagtctatcattgatgggcatttgggttgactttgctattgtgaatagtgctgcaataaacatatgtgtgtatgtgtctttatagtagaatgatttataatcctttgggtatatacccagtaatgagattgctggatcaaatggtatttcctgttctagatccttgaggaatcgccacactgttttccacaatggttgaactaatttacacttccaccaacagtgtaaaagcattcctgttcctccacatcctcaccagcatttgttgttttatgactttttaatgatcaccattctaactgacatgagatggtatctcattgtggttttgatttgcatttctctaatgaccagggatgatgagctttttttcatgtgtttgttggccgcataaatatctccttttgagaagtgtctgttcatatcctttgcccactttttgatgtggttgtttgttcgttttttgtaaatttgtttaagttctttgtagattctggatattagccctttgtcagatggacagattgcaaaaattttctcccattctgtaggttgcccgttcactctgatgatagtttcatttgctgtgcagaagctctttagtttaattggatcccatttgtcagttttgacttttgttcccattacttttggtgttttagtcatgaagtctttgcccatgcctatgtcctgaatggtattacctaggttttcttctagggtttttatggttttatgttttatgttttaagtctttaatccatcttgagttaatttttgtataaggtgtaaggaaggggtccagtttcagttttctctatatggctagtcagttttcccagcaccatttattaaatagggattcttttcccccattgcttgttttttgtcagatttgtcaaagatcagatcgttgtagatgtgtggcattatttctgaggcctctgttctgttccattgatctatatatctgttttcataccagtaccatgctgttttggttactgtaggcttatagtatagtttgaagtcaggttagcatgatgcctccagctttgttctttttgcttaggattgtcttggctatacgggctcttttttggttccatatgaaatttaattttctctaattctgtgaagaaagtcaatggtagcttgatggggaaagcattgaatctgtaaattactttgggtagtatgaccattttcacgatattcttcctatccgtgagcatggaatggttttccatttgtttgtgtcctctcttatttccttgagcaatggtttgtagttcttgaagaggtccttcacatcccttgtaagttgtattcctaggtattttattctctttgtagcaattgtgaatgagagttcactcatgatttggctctctgtttgtctattattggtgtataggaatgcttgtgatttttgcacattgattttgtatcctgagactttgctgaagttgcttatcagcttaaggagattttgggctgagatgctggggttttctaaatatacagtcatgtcatctgcagacagagacaatttgacttcctctcttcctatttgaataccctttatttctttctcttgcctgattgccctggtcagaacttccaataccatgttgaataggagtggcgagagagtgcatccttgtcttgtgccggttttcaaaggcaatccttccagcttttgcccattcagcgtgatattggctgtgggtttgtcataaatagttcgtattattttaagatatgttccatcaatacctagttttttgagagtttttagcatgacggagtgttgaattttatcgaaggccttttctgcatctattgaggtaatcatgtggcttttgttattggttctgtttatgtgatggattacgtttcttaatttgcgtatgttgaaccagccttgcatcccagggatgaagccgacttgatcatgatagataagctttttgatgtgcttctggattcagtttgccagaattttattgaggacttttgcatcaatgttcatcagggatattggcctgaaattttctttttttgttgtctctgccaggttttgctgtcaggatgatgctggcctcataaaataaattagagaggagtccctctttttctattgtttggaatagtttcagaaggaatagtaccagctcctctttgtacctctgatagaattcagttgtgaatccgtctgctcctgggctttttttggttgataggctattaattactgcctcaatttcagaacttgttattggtctatttagggattcaacttcttcctggtttagtcttgggagggtgtatgtgtccagtaatgtatccatttcttctagattttctagtttatttgtgtagagatgtttataatatccactgatggtagtttatatttctgtgggatcagtggtgatctcccctttatcattttttattgtgtctatttgattcttctctcttttcttctttattagtctagctagcagtctatctattttgttaatctttgcaaaaaaccagctcctggattcattgatttttggaagggttttttgtgtctaactccttcacctctgctctgatcttagttatttcttgccttctgctagcttttgaatgtgtttgctcttgcttctctagttcttttaattgtgatgttaggatgtcgattttagatctttcccgctttctcctgtgggcatttagtgctataaatgtccttcttaacactgctttagctgtgtcccagagattcgttgggtctctgttctcattggttttaaagaacttatttatttctgccttaatttcattatttacccagtagtcattcaggagcagattgttcagtttccatgcagttgtgtggttctgagtgagtttcttagtcctgagttctaatgtgattgcactgtggtctgagagactgtttgttatgatttccattattttgcatgtgctgaggagtgttttacttccaattatgtggtcaattttagaataagcgtgatgtggtgctgagaagaatgtatattctgttgatttggggtggagagttctgtagatgtctattaggtctgcttggccagagctgagttcaagtcctgaatatcgttgttaatttttggtctcgttgatctaatattgacagtggggtgttaaaatctcccactattattgtgtgggagtctaggtctctttgtaggtctctaagaacttgctttatgaatctgggtgctcctgtattgggtgcatatatatttaggatagttagctcttcttgttgaattgatccctttaccattatgtaatgcccttgtttgtcttttttgatctttgttggtttaaagtctgttttatcggagactaggattacaacccctgctttttttttgctttccacttgctttgtaaatattcctccatccctttattttgaacctacgtgtgtctttgcacatgagatgagtctcctgaatatagcacaccaatgggccttgactctttatccaattccccagtctgtgtttttcaattggggcatttagcccatttacatttaaggttaatatattatgcatgaatttgatcctgtcattatgatgctagctggttattttgcccgttagttgatgtggtttcttcatagtcttgatggtctttacaatttggtatgtttttgcagtggctggtaccagtttttcctttccatatttagtgcttccttcaggagctcttgtaaggcaggcctggtggtgacaaaatctctcagcatttgcttgtctttaaaggattttatttctcctttgcttatgaagcttagtgtggctggatatgaaattctgggttcaaaattcttttctttaagaatgttgaatgttggtcctcactctcttctggcttatagggtttctgcagagagatcagctgttagtctgatgggcttccctttgtgggtaacccaacctttctctctggctgcccttaatactttttccttcatttcaaccttggtgaatctgacaattatgtgttttggggttgctcttctcaaggagtatctttgtggtgttctctgtatttcctgaatttgaatgttggcctgtcttgctagattggggaagctttcttggataatattctgaagagtgttttccaacttggttccattctccccatcactttcaggtacaccaatcaaatgtaggtttggtcttttcatatagtcccatatttcttggaggtttgttagttcctttccattcttttttctctaatcttgtcatgatgctttatttcattaagttgatcttcaatctctgatatcctttcttctgcttgatcaatttggttattatatttgtgtatgcttcacgaagtgttcgttctgtgtttttcagctctatcaggtcatttatgttcttctctaaactggttattctagttagcaattcctctaaccttttttcaaggttcttagcttccttgcattgggttagaacatggtcctttagctcggcggaatttgttattacccaccttctgaagcctacttctgtcaatttgtcaaactagttctctgtgcagttttgttcccttgctggtgaggagttgtgatcctttggaggagaagaggcattctggtttctggaattttcagcctttttgcactggtttttccttatcttcgtggatttatctacctttggtctttgatgctggtgaccttcggatggggtttttgtgtggacatcctttttgttgatgttggtgctattcctttctgtttgttagttttccttctaacagatgcctctgctgcaggtctgctggagttttctggaggtccactccagaccctgtttgcctgggtatcaccagcagaggctgcagaacagcaaagattactgcctgttccttcctctggaagctttgtcccagaggggcacccgccagatgccagctggagctctcctgtatgaggggtctgtcgacccttgctgggaggcatctcccagtcaggaggcatgggggtcagggacccagaggcaatctgtctgttaggagagctcgagcactgtgctgggagatttgctgctctcttcagagctggtaggcaggaaagtttaagtgccgaagctgtgcccacagctgttccttcccccaggtgctctgtcccagagagatgggagttttatctataagcccctgactggggctgctgcctttctttcatagatgccctgcccagagaggaggaatctagagaggcggtctggctacagtggcttttccaagctgcagtgggctccacccagttcaaactttttttgcgaactttgtttgcatctttgtttacactgttaggggaaaaccgcctactcaagcctcggtaatggcagtcgccccttcccccaccaagcttgagcatcccaggtcgacttcagactgctgtgctggcagcgagaatttcaagccagtggatcttagcttgctgggctccgtcggggcaggatccgctgagctagaccacttggctccctggctttatccccctttccaggggagtgaacagttctgtctcgctggcgttccacacgccactgtggtatgaacaaaaactcctgcagctagcttggtgtctgcccaaacagcagcccagttttgtgcttgaaacccagggccctggtggtgtaggtacccgaagaaatctcctggtctgcgagttgtgaagaccatgggaaaagtgtagttatctgggctggagtgcaccatttctcatggcacagtccctcatggcttcccttgactaggggagggagttctcgaccccttgcacttccccggtaaggtgacgccccaccctgcttccgctcgccctttgtgggctgcacccactgtctaatcagtcccaatgagatgagccaggactctcagttggaaatgtagaaattacccgccttctgcgttgatctcgctgggaggtgcagaccggagctgttcctattcagccatcttgccagccacccaaacctatttttaaatgatcacactgttaagtttgcagtacttagcaataatgtatcaaaatgtttccttggagttttattctacagacctatctccttttgagatatgatatacataaactactttgtcttattttataaatttaattctttaaattgcctgtaaatctaaagtattttccgctcaccctgttttatgggtcatacctctttcagattgagtttccatctaccctagaggttctgtcacataccaatcattgtttcagtccttgcaggttaattgagtttcaaaaaaattttcaagggagtgctgggcactgaagaatattaagagtaacaggctgggcaattccacagcagagtatatgtccaaaataattgaagcaggaacctaaacagatatatgcccacccatcttcatagcagcattattcacaataaccaaaaggtagaagcaatcaaagtgtccatcagcagatgaacagataaataaaatgtgatatatacatacaaaggaatattattcagctttaaaaaagaaggaaatcctaacatgcactacaacatggatgaaccttgaagacattatgctaagtgaaataagccagtcacaatgggataattactgtgtgattccatttatgtgacatacctagagtagttagctttatagacaaagtagaatgatgttagccaggggctgggggagggctgaatggaaagttattgtttaattggtaaaaagtttcagttttgcaggatgaaaaagttgtaaagatgggtagtgataattgcacaataatatgaatgtacaatggcactgagctgtatattcaacaatgcttaaaatgttacattttatgtatatttttattttttaagcatatttttcaatttaaaaaaaattaaacataacctaaagagtaagatgctgggggtgaaggcagaaaagatgactgtccattttgatcctctttataaatgttgaatgaatctgttgaataacatggcagtaaggtgaaggaaatcatttctgtgtttataaactggaaaaactaacagtgttctttacctgttggagagcaactactaatgagatcttcatacaataaaaccttattatattaagcatggtagtaaaaaagtaaatatatatatgtatgtaaatacatatatagtgctttatagaaagtttaaacttccccaagtttctatactaaataaatcaccaaaaattggagaaagcaatacaacttttgttctgaattggaaataatgtgtttccaattaaataggtccactgaaaaataaactgtagatttttctgtttcgtttgttttaagaccaggcctcgctctgtcacccaagctggagtacaatgacacaatcatggctcactgcaacctcaaccgggctcaagcgatcctcccttcccagcctcctaagtagccgggactacaggtgcctaccaccctgcccagctaatttttttgtattttttctttggtggagactggattttgccatattgcccatgctagtctcaaactcctgagctcaagtaatctgccttcctaggcctccctcctaaaatgctaggattacgggtgtgagccaccacacctggcctaaattgtagacttttctgaacactcagaattcttatttgaattgtaatttttcacaaagggagaaaatatattaagtcagatgttttcaactggaagactggtgctatcacatcaaaatcacctagtgagtttttggtaaatacagtcctaccttttttttttttttttaattttagaattgggggagggtgtgatactttttcagggttgttacatggatatattacataaggctggggtttgggcttctattgaacccatcacccaaacagtgaatataatacccaataggtagtttttcaactcacccccacccacttcctgcctccccctttatgtccatgtatacccattgtttacctcccacttataagtgagattgtggagcatatggttttctgtttctgggttaattcactttggataatgtcctctggctgcatctatgctgctgcaaaggacattatttccttctttgttatggctgcatagtattacatggtgtatatgtaccacactttctttatccaatccgctgttgatggacacttaggttgattccatgactttgccattatgaatagtgctgtaataaacataagaatgcaggtatctttttgatagaacaatttcttttactttgggtagatacccagtagtggggttgttggattgaatggtaatcctgtttttagttctttgagaaagttccaaactgctttccacaggggccaaactaacttacattcccaccaacagtatgtgtttccttttctctgtatcctcgccaatgtgtaatttttttactttttaataatagctgtgctaactagtattatgatatctcattgtggttttaatttgcatttctctgattattagtgatgtggaacatttttcatatgtttgttggctgcttgtatgttcccatttttaaaaattgtattgatttatttgtattttatagagaaagtgtcttgctatgttgctcaggctggtctcatacttcctgaggctcaagcagttctcctgcctcagccttccaaagtgctgagattacagacatgagtcaccatgcctagctgtatgtcttattttgagaagcatttgttcatgtcccttgcctactttttaatggagtaatttgggtttttcttgttaatttgtttaggttccttatagattctggatattagtcctttattggttgcatagttagcaaatattttctcctaatctgtaggctgtctgtttattttgttgatagttacttttgttgtgcagaaactctttagttaagttacaatggtcaatttttatttttgttgcatttgcttttgaggtcttagtcataaattctttgcctaggcctatgtgcagaatagtttctcctaggttttttctaggatttttatagtttgaggttttatgtgtaagtctttaatctatcttgagttaatttttgtatatggtgagaggtaggggtccaatttcattattctgcatatggctagccagttttcccaatatcatttattgaattgagtgtcctttcatcactatttatttttgttgactttgtttaagatcagttggttgtaggtttgtgggtttacttctgggttctctattttgttccattgatctatgtgtctatttttgtgccaataccattgctattttggttactataccctagtagtatagtttgaagtcaggtaatgtgatgcttctggcttcgttttttgcttaggattgctttggctattcagctaccctgccttcttaaaagcacctttctttcaatctgatacaaccctgtgaggagtattagaaaatacaacttcaaggagatgtttgagaatgcgggcagtacagtctggggcaaggggagtgtaggattatgtatggttgaaaatgttccctttggtgatatagcaatgctgtctatcctccacctgtcactttgagaatcactggattaggtgatttaataatgctgcaagttccgtaatctgctggaaaaacgaaaacagaactttttaacagctaagggtctagttcttcaataactcaggccttgggaaatgcttcttttttcgatccttcaaaatccatccacacttacaggcaatctacagtttactttaaatagtctcctacttttgaggtgcttataatttaacatagttacatcccaatgccctttgtcattttattttaagtaaatggggttattgacgttacttgtcttcatgttcctgagtccttaaagaaacgtgttacctcatctgctagttaagttttcatgttctatgaaaacactcaatgctgcccattactctgtaagaaaaggtcagtgtgatttgcaattctggtagacgtaaagttcagaaaatgtgcgttagaaaatgcaaactctaaaggaaaacaatctcagcattggaagaataatgtcagcacatgatcccaactcaaaatattaatataaatcattttgaaaatgtctctactacagccaaatcaattttaaatgataaccttgttggcttagattggtgatggtaaagatagaataaactaagtggcattcttttaaaatgtcttgtatggcattcatagaaaaaagttcttaccaggtaagatcttagagaaaatatatttctcacctatgaatgtaagttactaagttattagctcatggtccatttttagattattgtaatcacaaaagataaactcctttaattaattggtcaaaaataatttagaataacatgtggacctgtcacatttttgacaaagtagtatctttgggatgtggttcatttagttcagtgatctcaagcctgaagaaatgagacttctttcaactcccacctttttattgaaaaggatcctgctagaaggcaaaataagaggcaacctatcctaagcagatataagccctattatagcactgatttctggagggatgtttaagtcagatttgttgagatatagattacatatagtaaaatccacaaatatgttactaaataacatgtaacaaccaccacagactatagaccaccttgtacagtttgtattgaagtataatgtgcatacaaaattgatacaacttttcattaagtggatggacctgtgtagctataaccagatcaggaaatacaatacttatagcacttaagaagcttctccttgtgccccctcctaatctttatccccactgaaggtaaccattgtcttagcttctactactgacagttagctttgcctgtttttgaaatggaaccactcagtatgtagacttttgtctgctctatctccatccatttttgtgcactttcttactttttgacaacataagatcccccgggctcacgttgtattttctccacttcagtcctataatcaactatttctccaaggaaccctggttccctttattgaagaatggtttttagaaacctgtaactgtgctctagatatgctctttgttccttgagtgtctttgcttctaggccctcttagcaaacagaacttggcaatatatgtatgtataataacctatgtatactcactcatctatatttatttctgtatctatatgtttatatatttttaaaacatgaagtcatactgataaattttatttcagtccagcagcacaaggctcattctagccttcattcttccttttgtacaacttcttcctttgacattgaaaattctggctctcattatctaaaatgtatttacttatttgttttatcctaaagtagttttgaattgcttgcccatacccttgtatgagaaagagatttaccctttagagtataatatttgcttacagttctttttttctgtagcccaatagtgtccagtcaatatatagttatccaaagtaaattagctcttttatttcatccactcattatggttacattattcatttgtaatacaggtagggtcacttgttaagagtattccattttggtttcttttcacatcctgattggggttttattttctcaataaaattcactttttgtagtgtcaagttctgtgggttttgacaaacacataagatcatgtaaccaccaccatagttatgataccaaagagttacatttttcagctccggatttgcaaggatggtaccaatataaactcccccaattttatgagacggcactaattgttccacatctctaccaatatttgctactatccatctttttaattttagccattctggtgagtatgtaatagacctcataatgattttgattggaatttttctgatgtgtagtgagatggagctccttttcatctgcttactggtatttgtttttttgtgtgtagttttgttttgttttgtttttttgagatggagcctcactctgtcgcccaggctggagtgcagtggcgggatctcggctcactgcaatctccacctcctgggttcaagcgattcccttgcctcagcctccctagtagttgggactacaggtgcccaccatcacgcctggctcatttttttatttttagtagtgacggggtttcaccatgttggccaggctggtcttgaactcctgacctcaagtgatccacctgcctcggcctcccaaagtgctggggttacaggcgtgagccatcgtgcctggccttgcttactggcatttggatatcatctttgattgtattgttgttgggttcttttgcccatattgagttgtcttattgatttagaaatctttttacagcctgtatgccagtcttttgttagataaatgtattgtagatatctcctgctactctgtggcttgccttttcactctcttcatggtatcttttgataaacaaaagttcttgattttaatatagggcaattcataatgttttccccttatgattaatgcttcttatattccattaaagaaaatcatggcagatctcaaacttgtgaagatactcttctgttgtttttttctaaaacttctattcttttacttttttcaactagcacaattcatctaagattaatttatatatatatataaggtgtaggatagggagaatgattcatttattttgcccatatgaataaccaattgacctggcatcattcattgacaggaatatcctttccctaactgcattacattgacacctttgtcatgtttcagatgaccttatatgggtgagtctttttttaggctatttcattgtcctcattctctatcctttaccaattgcacactctcatgataacttaggtttataatcagtctttttatctggcaatgtcagtcttctgagtttgttcttcaagattatcctggcttttcttggctctttgcatttctacttaaattctagaactggcctgttaattgtcaccaaaggaattttttaaaaattccttactagagttttttcagattatattgaatctgcaagtcaatttggagaaaacttatttctttacagtattttgtcttccaatccatattttcctctatttatgcagtctttaatttttctcaggatgtttttttcttttcagtgtaaaggtcttgtatatgtatcttttgtaagattcttaggttttcgatgctatctatttttaaatggcatccttttaggtttctgtttctatttgttttttactggtatatagatttctaaataatgatctttttcacatattaactgcaataacatatcagataattattttggattttctatgcatataattataccatctgtgaataaaaataatttgcatttctgcttttccaattctcatacagtactttttttcttactacactagttagcacggtaagacatgtagaatacaagtaaattgaaatggttatagtgagcacctttgtcttattcccgatatcagttgaaaaaccatcaatattttatcaaaaaggataatgtttgctatagtctctttgtagatactctatcagataaaggaaatttctttccattaatagtttgctaagagtttttgttttgttcttaagagattttttaaaaatcatgaatagttgttgtatttcatcagataatgtttttgcatgtaaaattactatatgattttttcccttttttcttttaatgtgtgaattacagattgattatggaaagatatttcacctttgcattcttggaataatgccaacattgacatatctttttaatgtcttattggatttgatgtgatgttattttgttttctgtttgtttttttgagagagggtctcgtcttgtcacccaggctggagtgcagtggtgctctccaggctcactgcagcctccacctcctgggctcaagcagtcctcccacttcagcctcccaagtagctaggattacaggcacgtaccaccacgctaattttttaaattttttgaagagacgaggtctcactgtcttgcccagactgatcttgaactcctgggctcaagcaattcacccaccttgggctcccatagtgcggggattacaggtgtgagccaccatgccagccttgctttatgtattttaaagctatcttaactaagtgtatataaatttataattctcacgtcttcctgatgcattgaaccttttaccttatgaaatgtccttcttaatctctaatgatgcatcttgccttaatatctatgccagctttctattggttagtgtttacatgatatcttttttcattcctttattttcaacctttctgtgttcttatatgacttttgttgttttttaattaattctgacaatcttcatattttaatcagcctgtttatatttaatataagttactaatgtatttgtgttcatatcttacatcttactctttttgttctgtcttacatgtgtatcttcttttttctctcctttcctgctgtttttggattgatcaagtatttttttctttttcttctcatttagcttctcggtcttgccctgttgcccagactggagtgcagtggtgtgatctcagctcactgcagcctccaccttccagtttcaagtaattctcatgcctcagcctcctgagtagctgggattacaggcatgcgccatcatacccagctagtttttgtgtttttattagagacagttttgccatgttggccaggctggtcactaactcctgacttcaagtgatccgcccgcctcggcctcccaaagtgctgggattacaggagtgagccatcgtgcccagcctgaattctcagtttttgtttgtctgaaagtttccttttgcctttcaatgtgtatagttctctatgttgggagttatactttttgagttctttataaatggctttccattatcttttggattctcttatttttgttgagaagtcagctgttactcttattctgctcttttatatataatatttttattttctctagctgctttttagaatttgtcaaactttaactttatccttagttctggttttccttttatttatcctgctgggatttttagtgcttcttgaatctgtgattgatgactttcatcagatttggaaaattctcagccattatctctttagatactagaactgtttatacttgggaatctagttatacatatactaggtcttttcattgtatcccatatgccttttatgctctttgtgtgtgtgtgtgtgtgtgtgtgtgtgtgtgtgtgtgtgtgtgtgttttaccccttttcctccccgagcttcaggctgtatattttgcactgacctggcatttagttccctgattctctcttctgctttgtcccatctgcatttcaaaacatccagtgaggctgggtccagtggctcatgcctgtaatcccagcactttgggaggccaaggcaggcagatcacttgaggccaggagttcaagaccagcctggccaacatggtgaaaccctgactctaccaaaaatagaaaaattacctgggcatggtggcaggtgcctgtactcccagctacttgggagactgaggcaggagaattgcttgaacccaggaggcagaggttgcagtgagccaagatcgcaccactgcacacgagcctgggagacagagcaagtctctgtctcaaaaaaaaaaaaaatctagtggatgctttatttcaatagtcccttttttattttctaaagtatctgattatttcttattcatcctagttctgtagtataatcctctaccttgtcatctatttttttctaacatattaatcatagtagtaataaattctgtgtctgaaaactacaatatctcagtcatttgtaggtctggtttttaaagattttttttaatttccacataataattgcaaatatttatggggtacatagtgatgggtttggtgttttaagagagggtcttgctctgtcaccgaggccagaaggccagagtgcagtggcgtgatcacagctcactgcaacccgtatcttgcaggctcaagagattttcccaactcggcctcctgagtagctgggactacaggcacatgccaccacacctggctaattttttttatttttattagagatgaggtctcgctgtgttgcccaggctggtctcaaactcctgagcttaaacgatcctctcaccttggcctctcaaattgctgggattatgggcgtgagccacaacaccctgcccatcgtgatgttttgatacatataatgtatggtgatcagagcagagcaattagcatatccatcatctcaaacatttatcatttctttgtattgtgaacattcaatatcctccttctcactatttgaaactatgtaatatattattgttaactgtagttatcctacattgctgtagaacactagaatttattcctcctatctagctctaattttgtatacttttaaaaatctctccctattgcctcctccttcttacccttcccagcctctaatatcctctgttctactttttacttctgtgagatcaactttttttagcttccacgtacgagtgagaatacatagtgtttaactttgtgttcctggcttatttcatgtaacataatgtcttacagttccatccatgttatggtgaatgacaggatttcattcttctttatagataagtagtattcgatcatgtatatataccacactttctttatccatttatctgttgttggacatttgggttgatttcatgtcttggctatagtgaataatgctgtagtaaacatgggggtgcaaatgtctctttaacgtactaatttcctttcctttggagaaatacccaatagtgggattgctggatcatatggtagttctgtttgtttcttttctctgcatcctcaccagcatctgctttttttttctctttttaatgatagccattcttactggagtgagatgatacctcactggttttgatttgcattttcctgatgattagtgataatgagcttttttcccatttttttggccatttatatatcttcttttgagaaatgcctgttcaggtcatttgcccttttttaaaacagagtagagttttttgtttttatttgtttgtttgtttttttactgttgagatgtttaagttccttgtatattctggatattaattccctatctgattagatgagtaagttgtatgtatttttttctattccataggttatcttttcactctgttgattgtttcctttgctatacagaagcttttcagtttgacataatcccatttgtttatttttgcttttgttgcctgtgcttataaaaggttgtactcataaaacattttcccagaccaatgtcttgaagtgtttcccttatgtttccttctagtagttttattgttttgggtcttacatttaatccattttgagttgatttttacagagggtgagagctaggagtctagttccattcttatgcatatgactagatgcatatttagttttcccagcatcatttattgaagaaactgtgctttctccagtgactattcttggtgcttttgtcaaaaatcagttgactgtagatacgtggattaatttctgagttctctattctgttccattggtctttgtgtctgtttttatgccaataacatgctgttttggttactatagctttgtcatatattttgaagtctgatagtatgatacctccagctttgttcttcttgctcaggatgttttttaccatttagggtcttttctgattccacagaaattttagaatattttttctatttctgtgaagaatgtcattcgtattttgataagggttgtattgaattggcggatcactttgggtagtatataggtctgtttttttgtttttgttcggtttggtttctatttccttttggggcttgtttcttggtttgcctgataattttttatcaaatgttaaacattgtccataataaattatagagcttctgttagtgtagagtccaattagatctaggactaagccacctcaaggttgggttatagtttttgtaagacccagtctacctctcatttgcttccacttctataccatggccctcctggaatctcagctgaaatcctggtgtttttatgagatccctactcattaatgggttctgaactccaaattttatctgttttgtgtaccatacaactagcacaatcaccactctgccttatggatgccttatacttggtgtcttggcctcttgtcctgcttcctgacaagtgtggcaaataccttgagtagagtatttcctctcctgagtttcaggcctactttattgttttcccctcctcttcaggatcatgaccctcagttctgtctgtcttgacagtcccaaactcgaatttttgtcttaccacccactagagattgcaaaaagttatgttggcttctctgcctcttagtagtagtccattgcccagattctcagcctcttacccgacacaggaatttgcaaataccctagggagaaaacgactttttgaatgtcagtttagctctttaagatcctcttctctctgagaccttctcttgtcaaattttgactaccttgtcagctctctcatcccttctttatttaaaaaaaaaaattaagcttttctgcctttttatggtctgggaattggtttactacaagctatggcattagagcctaaccaataggtcccttattgaatacatttttttattattaaatagaaaaatacatagcccgagaaagttaagtgggcttatctgtgtattaaggaatactgtttttaggaatgtgacttaggaatactgttcttcataccgcactttgggaactgctggattaggtcactttcccaaggtctcagaattagaaacaaaagcagctagattagaacccagcctcggcctggtgcggtggctcatgcctgtaatcctagcactttgggaggccaaggcgggagggtcacctaaggtcgggaattcaagaccagcctgaccaacctggagaaaccctgtctctactaaaaatacaaaataagccaggtgtggtggtgcatgcctgtaatcccagctactcgggaggctgaggcaggagaatcgttagaacccgggaggcggaggttgcggtgagccgagatcacactattgcactctagcctggacaacaagagtgaaactccgtctcaaaaacaaaaaacaaaaaacaaaaaaagaacccggcttcttgaatcccagactagtccaatctgttccataccatgttaactcattggcttacatctgtggttttcaaccagaaacaactttcccccttcctttcagttatgacaactggctggtatggaagagttgggtcttccactggcattttgtgggtaaaagccagggatgctgctatatatactataatgcacaagacagccaatccacaataaagaattatctggcccaaattattaattgcctcaagattagaaaagccctgtcttacagtatccctcaaaatttatatatttaaaggatcactggctgattcctctttacacttaatcataaggtcaacaccaataggctttagtaggataaagcatctttatcctactaaactacatccagaggccctttgacccaagaaaatgtccatatatgatctagtccgtacttgcttaactgtgtttctcaaagcttttgccaaatatgctccaattctaagacttctctttagttagaatttgttagagctggaaaactttctggtgtagaattgtgcgtgcatatcttgtaaatgcattttgtatgcatgaatggatatctagatgatagtgacatttacctacacatttatagattttatttatatatatacacatatatacataatatatatgtattctaggcatatatatatatatacacacacattagtctaaatggttcttagaaaatttattcattttggtttataactctaatcaatttctataatcaaaagctcttgaaaatgtaatacaaatagatatttaattaaagaggtatattaccaaatgtttttcagaataattattgtttgtaccagtgagtatttctttcagaaattcaattagactctaaaattcatttttcagagcattacaacttggcggcaaaattttcttttggctgaaacactgcatgcaagcttttggctcagaaaaaaatctttggaagtatagctgaaaagtctgattcagataactgaatggctaaaattttccttgtttaaaaggaataaactggttacacgtgaaatattaaaaactgtatttaaatggatagttaactattgccttatttcttttaagtcttaaccaagctggcttatcctatttcaactgctctagaactcacatcatttttgattcattgattttttttttttttttagtatcccaatagaagccatcatttctaaggttccaccccaactttgctgagccttggcccagaaaatttgtttagcttttctctgctgttgttaagctattttaaattttaaatttttgtgtttttaaacctttctgtgtttttaaagcctttctggtttaataaacaattctaaaatctcaagaaaatatccaaattcttttgttaataatttggcacttagccatctattcaatttatttatcatggtaaattttgcttatacttaattatttcctctagtcctagaactccaccccttaccataataaaggggcagtttataaaacaggtgtttttgtaagtaatttacatggtttagtatgcaaaaagtacaataatagagctgtttagctgtcagtacttgtgaggaagtaagcagttttttcgttattaggatgaccatataacttattagaaaaactcagatgcttttgagagtgaaagagtggggtgctattaataatactaggacagttctgggcaaaccagcccatatggtcacactaatcattatagatatttaaacaaaaatatttggtaaaatgaatttgtgtattggttgaggtttttggctgtgtttatttctaacatttcttccagtgaaaagattcttgatcatgtgctaagtatatgccaggtaatatagaacttaaaaaaaacatgagaacctctaatctcaagcaggacaagttggagaggcaagatacttatagataatgcagtaatgtaacagcacaaataaattcaattcattatggttttattgagtgcctactgtatgtcaagaattgtggttataaagatgaacaaaacaaaaactccttttcttgaaatctagaagagacatacttaaataatatgatgtgaaaaatgatattattttcatgaactaatttttatagaacaaatggaacaagaagttggggaaagcttttcaaagcaagtgatgtatgaactaggccttgaggaatccttacaattttggcaagttgagattacaaaggtattcaaagttaatgaggtaataaaagcaaaaggcagagtccttcatatgatttgttacaagaaatggcagaagggagatatggggcaaccatctctgaaatggtaattgtgatgggatttaaatgctatgctgggcaatacattattaagtgcttaaagtatatatatatatagagaagacatcctttggactgagaaacattttgtgatcagtttaccgtaattccataaaagaaaggaatcacacttccatttgtttataaagccctgtttcagagggatcaacaaatactaaagatgaaaatcctttttttaattaaatgctaaagaataaaagctgcaataatccctctaaaaagtattagtgatgaacaatcccatggggttatagtgagacaaatgtgatagggttagaaaaattgtagagaaaaattatggtaaaagcactagggaaatgccttagaaaattaataaagattggcttggtttaaagacggtaaataaagactaatgcaaaaggctaatgaattcagtcatggagaaagtttatactatagtgtttgctaaaagaattaccactagatgggattttattaagcatttttttattcaaagaaaaagggtaactcattaataaaatgtgtagttgatactaaataaataaatcaactagtgtagttgatactaaattaggagatagtgtagttgatactaaataaataaatcaactagtgtagttgataataaattaggaagatactgtagctgatactaaattctagaaattctggtaatagactctagaaatagatgtttgaaataggtgtttaaaataatattttaaagaaaatcatattcaccccattttaaatccacatagaagcagcagttaacattaaaaacttgtgtccacttccaggagatagtcatggtttaagggtccagaaatcaatggtagaatcacctgaaatttagaacagtagaaatatgtcttcactaaagagtctaaattttttttttttttttttggaggagtcttgctctgtccccaggctggagtgcaatggcacgatctcagcccactgcaacctccacctcctgagttcaagcgattctcctgcctcagcctcttccaagtagctggaactacaggtgtgtgtcaccatgcctggctaattttttgtatttttagtagagatggggttttaccatgtttactaagctggtcttcaactcttgacctcaagtgatccacctgcctcagcctcccaaagtgctgggattacaggcatgagccactgcgcctggcccaagagtctaaatttataggatgtatatgattaaaagtgacttttgtgaacatttaaataaatatttgtgactgaattttctatggaacatttttccttcagtggcttgcattttaatgaaggaattattttaaaattaccttattccctcccaatgttgtttaaatatctagagggtatctagggcttaaggaagattggatgtggaacaatgagtggaggcctagagaacaagggtagtttcctgcaacagttatatggatccctagcaaggttcatatttctgtctatactgctggttaatctgaatattcccataaattgtggaacataatccatggccttggttttctgtttcttgtagtaagatttatcattttatttctaccataaattagagatcattacatgattactatgaaggatctacattgctatttgttatgatcaaataaacagtatttttgcagttgactattcagggatctgttaaagcatttagaccttaggccctcatagcatatatatataagctttttggagacttggctctcactactttgagaatttggcacacagggtaatcaaaaaaaaaagctttcttggctcttgcctgtaatcccagcattttgggaggctaaggcagaaggatcccttgagctcaggagttcaagaccagcctgagaaacatagcgagacctcatctctactaaaaaataaatagtaaaaaattatcccagcacagtgatgcgcacctgtagtcccagctaatcaggaggctgaggtgggaggatcacttgatccagggagtttgaggctgcagtgagctatgattgtgcacactccagcctgggtgacagagtgagaccctgtctaaagaaaaaaagctttctttcgaaatggcctcaggtttatcgatttttaatttaacattgctctacagatttattttgttgagtttttttttttttaagtactaagagtgttttgggcaggggaaagaaattcacagtgtttttttgttgttgtattttgttttgttttctgagacggagtctcgctctgtcacccaggctggagtgtgcagtggcacgatctcggctcactgcaacctccgccccctgggttaaagcaatcctcccacctcaacctccccagaagctaggattacaggtatacatcacctcacctggctaattttttttggtattgttagcagagatggggtttcaccgtgttggccaggctgatcccaaactcctgacctcaagtgatccacctgccttggcctaccaaagtgctcggattataggtgtgagccaccacacctggcctaccacaatgttttttaactgaacagttggctgcagtaagcttttagaagcctacacgttggtatttgagcatacgaggtggatcataatggggatcattaggtttctttgacaggtgatattaagaacccaacccagcatgccacttgtaaaccatctatacatagagacatttgtcaccattgacagttgtgacatttaatctgggatctatttgcaactcagcttcctatgtattactatgtatttaacagtctcaattcaggctcaaagcatcagcttttttcttctagtttttctaggttttacttaacaaaggaaaatagaaatatctgtttactattgaggtgatcatttctcctcagatgagtcatgccagtcacgattcttggatgttgacctcttgtgctgtttttgtagttcacaagccaaagctgcactaaataggattatggaaattagattaatggtccaggaatgaggcatagtgctttggttgaataggaaagtctgtaaagtggagccagtagtacctgaaaaaaacttaatccaggtgaggcagatgttctgaagaatctcactcgtctcacctggattaagtttttttcaggtcctgctggctccactttactgactgctattcaaccaaaccactatgcatcctttttggagcactaatctaactccaaaggggtacaacaacctcatcacttctaatatgaatacaaccaagatattgtgtgagctgagagtggcagaagaaaactggaaaaagctctctcttagatagccagtgtcacttggagaagtctattcttatgtaaaaggagttatattggtcttctaagaagaaaggttgtcaggaactggcaagcactaaaatgcctaaccaacaccttggagttagagcagtctagttttagaaggcagagactaggagggataatcagtcatagctaaagatagggaatctagaccaaagctcattccagttcctaggattagtgcagaatacaatttattaagctagaacagaagctttgcagtcacaattagatcatcacaacgtacatctggatgtcagaaataattctgcaccctactcttttttttttaagttaaagagactgtctcccaggctggagtagagtggagtgatcttagctcacttcatcctggaacacttgggctcaaacaatcctcctgcctcagcctcccatatagctgggactacaggcacacgccaccatgctggctaatttttttctattcttttagagacagggtcttgctgtgttgtccaggctgatttcaaattcctggcctcaagtgattctcctgctttggcctcctgagtcactgggattgcagggcaccctattcttgatttttattcttcccttgtcaggactagcttagaactgttaccccaactgtataagtaagtgcatccttaactatcaagacccaagaaagatatgagcagagcaaaatgaggagctcacgcaagcaaaattaagacttgaaatgtcagcagataaggtatctgaacatgtctatgacaggaagccagttgcaacttaactactgcagtgctaaattaaaccactgctatgtataccatatttgaagtaataattggatacaaaggtatatggcccttacttcaaagagcttatacttgtgaagtgtacactagaagacagtatgtagaaattttaccaaatttttatcaatttacagtatgaattttaccaaaaaattcactatagaaataatgcatgacttcacatcacactggtgatcagagaaacaatgtattttaaaagtgacatatgaactggtttgtgaaatacaaatgaaattttgatgcaaaatataactagaaatgaccttagatatcagctggtacatcttagaaattcgagaaaaattaagacccactactagtgggataaatgttggtgtacagtttttcttggtgacagcttgagaatacatatcaaaagccttaaaatatgcatatcctttgactcagtaactttacttacaaattaatcctatggaataatttaacatatgcacagatttacatgcaagaatgttcttcatagcattggtcttaaattttttaatttttttaacttctcattttgcagcaaaaaaaaagttgtaaaaatagtagatattttccatatatccttcatccagctttcccaaacattagcattttatataaccagagtacatatatcaaaaccaaggagttaataaataggtagaatttttgtcaaataaataaataaaattttaaaaccagcaaactactatagatgtgatactattattgaagctacagacctttttcagatgttcccaattatcccacttttttttttttttggtccaggatacaatctaggattctactctgtgcttaataggtaatcatattcttttattctgttactatctggcataattcttcagtctttttttctcctccttaacattaacacttttgaagagtactggccagttattttatagaatgtctctcaatttttgtttgactgatgtttccctgtgataaaattcagattatgcatttttggcaagaataccacagaaataatattatgctcttctcagtgaatcatattcaaagacgtgatactaattagcctcgatagtagtgatgttgactctgattcactttacttggttaaagtggtgcctgccagttctctccattgtaaagttagtattttttctttcttattgaataaatatctcatggggaggtacttcaagatacgtcttccatacatacatggattaatcttgcctgaaataattattactgtggtattagccaaagaattatattttatttttattattccttataaacttctcaattcaaaattatacacttattaatagagaagagctttcccctttttttgtttattaatttacttatgtcatatggactcatgaatattttattctattatttaaaatatattactatcactatttattgtgtttctcaaattgtcgtagatttgaccattggaagtgccctcaagttggttcttatgaacttccaatgtactacagttattttctgacttccttacattctgcgaccacaagatctccaggttcagcttgtgttttccttgccccagccatgaaataggaatttctccaagaagccctggtttcttttattgtacactaagaatttatacacacatctatatctgtgtctatatttaacctgtgtgcgtgtgtgtgtgtgtgtatgtgtgtgatatatatatgatttatttatttttttttttttgagaaggagtttcactcttgttgcccaggctggagtgcaatggcgcaacctcagctcactgcaacctctgcctgctgggtccaagcaattctcctgcctcagcctcccatgcccagctaattttttgttttgtttttttttttttagtagagatggggtttctccatgttggtcaggaatggtctcaaactcctgacctcaggtgatccacccgcctcagcctcctaaagtgctgggattacagacgtgagccactgtgcctggccctgtgtatatatttttaaaacatgagtacacagtagtatcacctattgcaatccaataccacagagttcaggactggcttagagctgttaccccagctctgtaagtgcagcctgaaccatcaagaccagggaaacatataagcagagcaaaatgaggagctcacacaaccacacatcctggttaattttaattaagttttttaaatatatagaaaattaccatggttctaaaagtcaagaactattcacaaagatagagtaaaagaagtgtcacttccctgacattactttttcgccattcttgttttagcgttcttcccaccctgttcccacctacctcttgtaggtaaccaatctcagttttttacttatcttttctgtatttcttctttttttttctaacagcttcactcagatataattcacacaccatacaatttccttatttaaagtatacaattctttttttttgtatattcataggttgtgcaaccgtgaccacgatcaattttagaacattttcatcatcccagaaactgtctctctccagcttcacccatcttctcccaaccttaagcaacgattaatctactttctgcctctatgcatttgccttttctggaaattgcatataaatggactcttacaatatgtggttttctgtgttaggcttctttcacttaacataatgttttcaaggttcatccacattatagcatgtgtcagttttttacttctttttattgccatgtaacattctattgcatggtttattcatttcctagggctgccataacaaattaccacaaagtgagtggcttaaaagaacaaaaatttattatttcacagttctgaaggctagaagtccaaaataaaaggtatcagcagggccttgtaccctctgaaaactctaggaaattgttccttgtctcttcctagctactgggctcctggaaatcaattcttggcattccttggcttgtagctatatcacttcagtatttgcctctgtcttcgcatggccttcttccctgtgtatatctttctgtgcccactccttttattttaaagacaccaataattggatataaggcctaatctaatctagtgtgacctcatcttaactaattaatctgcaaagactttatttccaaacaaggtcacattctaaggttccagatggacatgaattcaggggcaacactatttagctttctacatatagagatacaacattttatttacctattcttcagttaatggaatttcattcctgtatttatttatgcccagatgagcagatacatgagcattttcttatttctccttcctttttatttgaaaagtggcatactgttgatatgtttgttttttccttttttcagtttataatatattctggaagttttttcatatcacttcacagagctctagctcattctaatctaaatattcagccatagagaatttattaatatatacataagatggaaattgatttagtattttaatttttatgaacatggaatgatgtatacaatatattggggatgttttcttctataggttttttaatctgtgttttcaaggtattatattcacacagtatgaaattcctccttctagatgttacccatctaatcagccctttcccagagtgaaccaatgcttccactgaatgtcagctatacacattgttccacaccttgcctttttgcttaatatatcttagagattgttccatttttttatagctgtataatatttcattttcttgtcacatcatactttattttactaatcctcttttggtacacatcttggtatttctagtcttttgctacaacaaatataacagcactatttgcaatgaccaaaataattggaaacaaccccaaaggtccataaagagtaaactgaatatattatatatttatgtgatagcatacataatgaagagagaatgaatggattaccactcaactcaacaatatcaatgaatataacaaacataatgtggaacaaagtcagacccaaaagagtgtatacagaattccaaactaaatagggtaggaatagctcatgtcagaacagcccttcttcaggtagcaattataactcttaacaaaatattacaaaaccaactacctggagacactggagaagaatgaaaatcaggcagaaactgaaggagagtctatacttggaggaggagaatggccttgagtacatttcctatttttatgactctttctctagggccagcccaagttggcaccaagtagcatgcctaaaagttggtagaaaacacgcagtcttactggcttgaagatccagaggaagagtttaggtaaaaagtgagtgaggaaatttcagaaaggagaaaaaccatacagaggtagccctaaattctacatacagaccttatccaaatctctggatgacccctcaattacgcatatgcagagtggattcctagcagcccagctaaggctaaaagaacttaataaagatgtctcattgtccattgctggggtgcagagtttggaatttcattctagccaagtttacttgtctccttaaaaaaacaataataatcccctccttagaaacatttgagtagactgtacaacagaggtcagcatttttatttattttttttttttgagacgagtctcgccctgccttccaggctggagtgcagtggagtgcagtggcgcgatctcggctcactacaagctccgcctccccagttcacgccattctcccgcctcagcctcccaagtagctgggactacaggctcccgccaccatgcccagctaattttgtttttctatttttagtggagacggggtttcaccgtgttagccaggatggtctcgatctcctgacctcgggatccgcccggcctcccaaagtgctgggattacaggcgtgagccaccatgcccggctggcatttttttcttaaaggaccagagagtaaatattttaggttcacagggtactctttcagtaatttaaatatgacaaggagcaaacttgaatataggtatgtagaaattatcaagtgtggaaaatgaagagaaaaaaaacaatgaacatggccgggtgcagtggctcacacctgtaatcccagcacttttggaagccagggtgggtggatttcctgaagtcaggagttcgagaccagtctggccaacatggtgaaaccccgtctctactaaaaatacaaaaattagctgggtgcagtggcacacgcctatagtcccagctacttggtagggtgaggcaggagaatcactagaacctgggaggtagaggttgcaatgagccgagataatgccactgcactccagcccaagtggacagagcaagactccatctcagaaaaaaaacccacaaaaacagagaacagagcttccttgacctttaggacaacagcaaaaggcctaaaatgttcataattggagtctcaaaaggaaaggagctagagaatgaggcaagataaatatttgatgaataatggctgtaaggtttcccacttctggtgaaagacatgaacttacagatttgggaagccctgtgaaccacaggcagaataaatacaaagaaaaccacacctaaacatttaattagactactactgaaaccaaaagatgaagagaagatattgaagagcaaagtagcacattgcatagaatgggaaattatatgaacaactacagattccttacagtggagatcaaaagaaagtggaacatctttgaagtgctgaaacaaaactgtcaacccagaattctatctccagcaatattttccttcagtgatgaaggtgatattaaaacattgttatataaacataagagtatatactatgtgattccatttgtataaagtcaatggaaacaggcctcaagttacttttgatggggattagtaattgcaaggaggggagggaatttttcaccataatgaaccactccataaattagtaacataaaaaacagcagttttattttctcatgattctccagtcaaggctaggctcagccgagtagttctacttgtcttgacagtggtcacttgttggctacattaaggtagtacgttggctgcaggctagactcattagggatgttcagaactctctatttagtctaaaggccaacatttccagagtcagacttccaatttgtactcttctctgtatgtgtcatacctcaattaaaagcccactttcagactaggtgcagtggctcacacctgtaatcccaatactttgggtggccaaggtagaagaattgtatgaggccagggattggagaccaacctgggcaacacagcaagaccccatctctaccaaaaaaaaaaaaaaaaattagctgggcgcagtggcacatgcctgtagtcctagctactcagaaggctgaggcaaggaggttcgtggagcccaggagttcaaggcagcaacagtcagccgtgatcacaccattacactccagccttggcaacagagtgagaccctatctcaaaaaaaaaaagtctactttcaaagggcaatagataattatttttttaattacaatctaacaaaaatagaataatctaatataaatagaaactacaaaatgttccagaaaatgtaagtattcctgtgtgactagtgtagaattaatataagaaacattaataggtgataaagtaaaaaagataacttagggttagattacactgagatttgagtgcttggctacagagctgggtcttatttgaagggaagtgggaaactattgaagggttttgagcagaggaatgatatgttcaaaacagtggtttaggaatataatcccatgctagtgtacaaattagactagaggagggagagactattatcaaacggatcaatttggaaacaatttagataagcaccaataggaattgaattaaaataatagcaagctaatgaaaaaaagggaataaaatgtattaattctacatctacacagattgagagcctactatgttctatgtacttggtaaaggactgtatatatttttgtctttatagtcaaggaattcacaacatatgaaatgtagaagtatgaaaaaataacaatttgttgtaataagaactataatagatgaatatttaaggtgttaaggacacaagaagaggaagcagccaataatacagaggagtctaagacatgctttagataagatttaaccttacatgagtagttacagtttaccaaacaaagaaggcaaagaacaacattctagccagaagaaacagcacataaaaagtcacaggcaaagaagagtagagcatggtgaattgggggacatagttcactatatctacatgtgcaagctaagcataggtacagaagctagaaagataaggatcacatcactaagggcaaaagacatgaaaaatttggtgactatatgagatgaaacaagatttagtgactttataagaagacaaggatgaccttaatattttgaatttaagtgactagaaggataatgataaacccaatagtaagaattgtataacttatagacacttttcatctgagtggacattaaatacctaggagttctttttatatgtgtgtgaagaatagcactagatgtgtttcatcaatgaaattctgaatataaaataatcatcataggttcttaaagccagtcaacaaccaagaattgatactgaccactggcacagtttttttcaaaaatgacaaactttaaaagaaaaaaaaatgccttgaatgaatgtttttcttaactcagaagaaaagaaaaatctttaactacatatagcttacctgaagaaaaaacagaattgcagaattgctgtgaatgttctaaagacctggttctatataatcaagttaattcctctttcatgtgttttaaaatattgttgatccaagaaccaaccatcagctatgctggaagtctataattatgcattgatatatgagaaggctatcattctctacagacgactggtaccatccttagcagaatacttgaggctgcttttggtttagggaatctgtagctcagagattttcctagaaagtaacctctgttgttcaaattagatagccatttgtggagacaaaacccactgggtataggtagtattacctgaatcactaaaagataattgattagaaatccaaatcaaaccttgagactgctgagtctagatgagtggctgcctagggatagagggcaggaaggggtgggaccttacaaagacacatgaagaaacttttagaattgatatgtttgttgttttgattgtggtgatggcttcatgagtaatacctattcaaacttttccagttgtacacttaaatagtgcagtttattgtatgtcaatcatgcttcgataaagatgttagcaaaggaaatgactttcatcttagaatggtcagataaactgttttaagtgctacaccattatccatataaagaagagatggccatttaaaaatatttatacaagacttgaagcaatgtaggtaacctgaggtataataaattgagtgtcttgatatttagagtcctgatgtaatacactttattaagatatagatttgtaaatttatgctaattctggatgattatttttcttgagttggtttctatggactgaatgttaaagtgggttttaagcaggttttatataatatatcaataccacattagcttgattttttttattgcgagagatgcagaaagatcaatatcttacatgctctatatcaccataaatactttcaataaagcttttttggcctggtagggtgactcacacctgtaacctcaacactttgagaggctaaggctggagaatcacttgaggccaggagttcaagaccagcctgggaacatagtgagaccctgcaaaaaaaatatggaaattagccaggcatggtggcacacgcctgtagtcttggctacccaggaggctgaggcaggtgatcacatgagctgaggagctcgaggttacagtgagctatgatcataccacttgcaatgtagcctgggcaatagagtgaaaccatgtctcattcaatcaaacttatttgaaccttcgtacatttttgcttttattaatgagcttttcttttaaaatcagacttttaatggctttctggcagtgtcatcctggttgtggttgagactaatatgagctctagtttgtgttttttgttattgtttttgtttgtttttttgagacagggtctctctctgttgccaaggctggagtacagtggcacaattacagctcactgcaaccccttcttcctcccagactcaagtgatcctcccacctcagccttccgagtagctgggactataggtgcacaccaccacacctggccaatttttaaatttttttgtagagacagggtttcatcatattgcccaggctggtcttgaactactggactcaggtgatccacccacctcaacttcccaaagtgctgggattataagcatgaaccaccatgctcagctgagctctaattactgaagattaattctataggttgaacctggatatgttagaagacataggggactttcataaagaagttcaaattagaatatgtgagataggagaattttttaaaagaattgttatttgatacttagggtgtagtcatatactcttaatattgctagagtgtaaattggtaaaagttttcatatccttttatacagcaatttcagctcttggaatttaaataatcaaaagtctgggagcatctacatgtgaagacattcatgtcacttttatgtataatagtgtagcaacttgaaactatatatattatgttacatgaaaaataaactaacacagtgggttcattcactttgtgaaacttcatcacttatttgaggactttgagtataaacaaatcagaatataaaattacctgctattacgaagtagcaagagaggctgggcacagtggttcacacctgtaatcccaacactttgggaggccgaggggggcagatcacttgaggtcaggagttccagaccagcctggccaacacaataaaacccatctccactaaaattacaaaaattagccgggcgtggtggcatgtacctgtaatcccagctacatggcagactgaggcaggagaatcgcttgatcccaggaggcagaggttgcggtgagccgagatctcgctactgcactccagcctgggtgacagagcgagcaagagcaggcgagcaagcgagactccatctcaaaacaaaaaacaaaacaaaaacaaagtagcaagagtgagtatgccagtgtgctgggggtaagatgatttagatactctgtattttccatgtcttattttcatactttaaaaaacatatcagttgtttctaaaagaacatattccttttagttacaaacatatacattcagcaaccctaaagtagcatagactactactggctgaagctctggggttttattagtacagtgatgacttaattaacaaatcctctttgaacaaagcctcttcactcaagactggccttggtgcagtaggcatgagagaaggaccagttttctctgagctagatcggtagcagcagggactaatgaggcagggccttgaaagtggctctctctcagatctaactcctcagggactggctaaagctgaagctgagggtactggtgcactcctgggacctacacagcctggttacccaggtgttgaaaaaacagtttctgtgccaacaccatatgtggcttttaagagactcggcaggactcttgctttaggcagagcattccttgtgtggaatgagtaagctggaaaataacaaagagggaatcccatgtgctaggaagcttcctcttgtcttctgtgtgctccgtgtactgctttttcaattctctgggccttattttgttcaactataaagtaaaaggagtagctaaaaaatctctaatatatctttcagttctaatagactacatgtttaaatcaggaatcggcaaactttttataaagggtcaaatagtaattattttctgctttgcagggcatactacctccattgcaagtgctcaactctccctctgtagcgtgaaaacagctgtatataaacaaatgggtgtggctgtattccaataaaactctatttataaaaataggcagctagccagatttggcccacaggccatattttaacaagcccaggtctagatgttaatgtaatgggaatgtcatattaagagaattatttgatgaataggatataattcttatttcatagagaccattctctcagactttttatttttaaagcgtaggcaaatataaaatattatttcactgtcaggatgtaataccatgggaaaaagattaaaaatactctggcaccaaactgttgtagtaaattatctgaaatagagcctttgacttcccaattaaggaagaaaatggtgtctgcaacacctgtgactgggttattttaagtcttcaaaagttaggggcctagtagaagagagtctcaagggcttgttcattttctttctcatcaaatgggccaaatcatgcttttcatagtagaaggtaggctgtggaccctttactattttatttttaaatatttctcttggctaggcataatggcccatgcctaaaatcccaggctgaggcagaaggatcccttgagcccaggagtttgagaccaccctgggcaacatagcaagaccccgtctctactaaaaaaaataactttttaaaaattaaaaataaataaataattttttggtggtccagaaaggggcagctgccatgctttgcaggtttcagatccccatctatcttgggttgggtttctatcttggtcttaagttatcagtattctaatatggagataagtctgccttcactttggagacctttgttagttcttccatgtcaggcttcagctagtatagtttgtctaatgcatttatataaaacttgtttccaacaatgaaaaagcaattacaggttgggatatgtaattcaggcccattactacataaaaggatcagcacagtggtactttatctgactagggaagtctaaaatattcttgttggccagcttgctttcacataagcactgttcgggatcttttctaagttgcagaacatgaattccttattggcctatcccactagccacagctgtgagcacaacagaactgacacatacctggtaattataccttatctaaagtgaacagggccaccttcccagcatagtgacagctatagcccttaatctaatgcagtggttctcaaagtatagactcactgggggtgccctttctgaggctctttcaaggaatctcttctatgaaatcaaaactacttcacagtaattcaaatatattatttgcctttttgactctcaatgacagtagagttttccagagactacataatgtatgatatcacaacagattgaatactgaagcaaatgttaagaatccagctgacttctgttaaccagatattaaagagattagcaaaaacttaaatgtcatactctctactaatatttttgtttggaatatatagttattcttatgaaaatatgttaaaatgtaggtttattcagaaattttctgagatcattttattttctaatacagtaaatattaataaatatgactcacacaaaatctatttggagtcctcaatttttttttcttttttttcctggcttacattttttgatgcactcaatttttttttttttttttttaatttaaaaagagacagggtctcactatgttgcccaggctggtttcaaacttctgggctcaagcaatcctcctgccttggcttcccaaagtactggtattacaggtatgagccagtgcacctgacctcaataattttttaagagaaaaagtttgagaacccctcctctaatgtaatacccttagttgcaatactctgatctcatggttactgatatcatctttaccatattccctcttataaaatatttactaaaattatccccagagataacccttgttaacaatttagtgattacttctagacatctttctactgagtgcttgcattcacacataatatatatacttttacatttattggatcatactgtggtctttcaaaacttattctcctgagtttaatttttctacctgatcactctctgaattcttataaaatcttaagttcttttttttttttttttttttttttaagacagggtctcactcagtcactatcacccaggctggagtgcagtagcatgatcatagctcactgtagcctcaaactcctgggttcaaaggatcctcttacctcagcctcctaagtagctaggactacaggtgtgtgccaccatatctggctaactttttttatttttagtggagacaggcatctcactatgttgctcaggctggtctcaaattcctggcctcaagcaatccacccacctcagcctcctaaagtgctgggattacaggcatgactcaccatgcttagcctaaatcctaaggtcttaaaattgaaagggacagaggggtcatcttatctcattcccaactcaagtcagaaaccctctctaaaacattcacaacctgagaggtccatttaatttggttttataaaccctaaattgttagaaactttttccttctcttggacataaatttgccttcttgatcacttttacccataggttctagttctactttgggaaactatatagaatgcatcttatctgtcttcactgggcttcattgtgggtattttcttctgttctatcttccagttcactaattcttttttaagttgtgtctaagcttctattaaaactatccactaaatttttactttcaatttccatttaaacctgttgtattctagtcctctgttaaaattctcgattttatctttaactcttgctatttcaaagtttctgtttgttaagttcaatatctggaactgctttattaagctgtaatttctgctggttttaatttcctgcttgcctctttgtattactgtttattttttattgtgggtgatatgttgtatttgcaaaattgcttatagaaataatttgaagtataggatgattcatgtttgcttttggcaggcatggggacattggcacactatatttatcttcatctaagtttaaagatttagatgattagaggctaagctacaatcccttgtctaggtctttctactgcctgttcacacacccttaatccttttgattcccaccctgagataaggagattttaactaggcccattactcttgacagactgggttccagactttgtcctcctagcatcaaacaccagactcacttctctgggtttctatcatcctctgtattatagcctggtaattcttcattcttttgttaggacttcaatgccttcaaacagattttttaaaaatatgtccagatgttctaattcttgataagacagttggtctgaattacctaggctgccattagtacctgcaacctactttaatccgtattaatatttttctgtccttctggattgcttgggaaactgttaaagagcaggaataaccctgaccaggcatctgtaccacattcaaccagatgctctgtaagagctcctcttgaaggtttaatctgatattaatcagataggaagtacagttcttatgaacagattcagtcttcccacagggatgagttcagttaagaggggcaatggatacggtgtacagtggccccattttcctttatgtttatattctagtcttgtaataaaactaatgctcagaatgaaaggtctcaatttaggatttaaaccaagtataaacaaaaagttaaaacaagctattgttcaaactttgacttaagtgaaagaattggtttttttatttgtttgtttatttttgaggcagggtcttgctctgccacccaggctggagttcagggatgcaatcatagatcactgtaacctcgaactcctgggctggagcagtgctcccgcctcaggctcctgagtagctaggagaacaagtgacaccacacccagctaattttttaatttttttgtagagatggggctttgtatgttgcccaagctggtcttaccttctggcctcaagtgatcctcttgccttggcctcccaaaagtgctggaattgcagacatgagccaccatacccggcctggttttattttaaaaaacacttttgctgcccttctgtaaaatgttaattatatgtatgcacattttcttttatctggtgcttctctaaattcctttagcccacgtcttatccaactagtcatgtgggaatttcctctttggggaattaaatatttaatattaacttctaggtagtacagagcagcccactgtgtttcacttttgtattattcctttgttagcactaagttttctgtatcagcttgtctagaatttttgtttcaaaattgtattcttctaatttatttgcagtttttctcttctaattgtttaattgtccatcccctaccccctgccccaaggcaaatgtactgtcttttatccatatgtgcccataaattctaaactcaaagatttctggttctcccttatatttatggtatttttctacttctctgttcagtatatttttgcaagtgtttcagttttcttcagtgtttgaggttctctagtgtgtcatttcattttcatgcatcagagtaattcctaccattcttatatggagtctcttacctgatgattttttaattagtaaagtgcaatattgaacaacattgaagattttatttcttaatctaaaacataatatttatttaataatgaaatggaaatataggttttgtgaaagggagaaaggtgtttctctaaatattatacctgtgtcaaaaagctgcaagtgctactaccactgttttgtgacccctgaatgatttctgctttctttatattaatacttactctaatagtaattgaactcccaaaaagatcacaaagtccccaattgctagctttataaatacattgatgtgtaccttgtttgatgagataaaagcttcagtaagtgatatccccacctgtgtggttaatttcaaaatattgtttgtctaatacattgttgtcagtgacaactgaacaagaacttttagaagcagttggctgtccattaatggcagatttcaaggctatgcaaattgtgccagttcagccctgcattttttcgatattatcatatcaattgagtcagttcagagtagacaaagcaaggttatgggaaccacctagagcatcatgcaccatttaacatcaatgcagcatacatgaacatctgcaacttcgatcttattaacagaggatagaatggaaggcagtaaacagctttcttcatcacttaattgcaaaatagtatttcctaatgtttgcattgtttatcaacacgaacttcatcaataattgtataattatggttgcctagatcacagtgccctcatgcatcttgtcacttattatagagtggtctgagtttaatttgaatttgaacacatgatacaaggataataatacaagttccttgaaatgtgagttgcataatacaaaaattttgtgtagtaggagaatggcaagttatgattcttcagtcactttggggattaacacaaggaaaaacaggactgaaaggcagtgaaagatgaggggaagccactagttagattcaaacatagacccattggacatgagagtaggttatgttccttagaattaatcatgagtaattcgatgtttgctttaggcccaaattgagctgaattaaaacaggattattatgcttaggtcttcccttcagtctctgtagttaaagagagaaaatggcagaaaactacaaatatagtgaggaaaaagctatggtggccaaagttaaaaataccacatgctgaggaaagccttgacatagctgctcagccttcattgctgttgcttttgaagcctgataatgccacactactcctaattagcaaatgttagtattacagtaagcaatcaagtgcagtcttcaggctttgtggcagcagtttcgcagtgcaaaatattgaagaaaaaatgaaggaaaacaatataagctcagccacagttattggtgtggtcagtgggagttgtctcacaagagagcaggaaaaggaaaatgtgaaaaacagtgggtgcatttaaagcatgtaagacaagagctggctagtctgaaaagtttgtctattttaatcatgaaaatctcacatttttacttaaatccattttatatttaaggaaaaatctaaggcttgttcatgaaattacacttgaaatattttaatttgtggttagagtctcctccccatctcaaattaaaaggtattaaattgtatattgagtgagctccgtttgtactcagctcttcccaattaataaacatagtcatttccttaaaaaaaaaaaactctagagttagaatgttttctctcactaattagtctgtatttatgcctttaataattatctgttcattttctagcagcaaatgtttgttctcagattaaattggagaaggaaggaaaaaaaagatagctacccacagtatagtatccacagacgatatagagttatgtccctctttgtgtggttcttgagtataatagacataacagaagctttcttaatatgatagttaatctattattttctgtatttgggggatgctaagaactggtttactagaggtaatagtttgatctgtagttatttatgttaaaatacttttttaaaaggtaattacagcttctactataaacttgaaaaagttggtctaactctgtgccgaatgagcggggagatattactatatacatacatataagtgtatatgcctcttacctgaatacctcagggagcacacttttctgaaccagggttttgtaataaatgtgtgtactactaattctgacacatgtatagttctcctttaaataacttgtatgcaaacgttattcagaaacgtcttctaggagctatttatcaaaactgctataataataactttgtcctaatgagtttcagtctctgtttagggagtaatcgataaactacaaattaatgttccataattcacattataatgcacatataattattttgagatgaggcaaaccctatgcatttaatttacagctataattaagtaagctcatttgatactaattaagtaagtctaaaaggatcataggtttgtgtatttaattatcaaggtacaatcagcaactaattccttgaaaagctttcctatcttcagttcaacactgatctcagcccacactacaatttatcttcttgcatcttcaatagattaaaatgcattgtgaattgtggagaatctacttggtaagttagcttctttatttaaaaagtatatatatgtatatatatatacacatacataggcttaagaatacagaaattctataatctggcaaaactgtccttaagaagtgaaggagaaattaagacatttccagataaaagataaagaggtttattgccaatagacctgtcctacaagaaatgctaaaagggaatgcttcaggattaaatgaaagaatgctagacagtaactgaaagccatatgaagaaataaagaactcctgtaaaggtatctatataagtaaatataaaaaccagtattgctggtttgtaactcttctttcattcatgaaaggaaaatgcctaggccgggcgccgtggctcacacctgtaatcccagcactttgggaggccaaggcaggcagatcatgaggtcaggagatcaagaccatcctggccaaaatggtgaaaccccatctctactaaaaatacaaaaattcgctgggcgtggtggcacacgcctgtagtccctgctactcgggaggctgaggcaggagaatcgcttgaacctgggaggcggaggttgcagtgagccgagatcacaccaccgcacttcagcctggtgacaaagcgagactccatctcaaaaaaaaagaagaaaagtgcctaaaacaataattatatgttaatggaaagacatgtaaaatatgtaatttataacaacaacataaagagggaaacagagctgtataagagcaaggttttttatactgtccaggctaagttggtaacaattcaaactagattgttatgaatttaggattttaattgtaattgccatagtaaccactaagaaaataagaaataggtcagggcgcagtggctcacacctataatcccagtgctttgggaggccaaggcaggcggattacgacgtcaggagatcaagaccatcctggccaacatggtgaaaccctgtctctactaaaaatacaaaaattagctgggcgtggtggcacgcagcctgtagtcccagctacttgggaggctgaggcaggagaatcacttgaaccccggaggtaggggcaggagaatcacttgaacctgggaggcggagtttgcagtgagtcaagatcgcactactgcactccagcctggatgacagaccgagactccatctcaaaaaacaaaaaaagaaataaaataagaaataatgaagttttctctagttttgttaaagtagtatataaaaattagattattagaaaatacacttaattgctagcttagaagtcttttaaattctactgtcagccgggcacagtgtctcacccctgtatttccaacactttaggaggccaaggtgggaggatcacttgggcccaggagttcaagaccagcctctgtaacatagggagaccctgtctacaaaaaattaaaacaattagccaggtatgatggcaagcacctgtcatcctaggtactcaggaggctgaggtgggaggaccacttgagactgaaagattgaggctgcagtgagtcttgattgcaccactgtactccaacctgggcgacagagtgagactctatatcaaaaaaaaaaaaacaaattctgtcagtcaatcaactaatattcaagtatttaatatagtaggcttcctgctaagtttcaacaattgtctccatttcttcccactaaattttttaatgtatagtcaagaaggaagagctatctgatgtctagagtgacattctagtgttgggaaatgctagataagatgttcacattttcagatttcccagccacatttaagctcaaaaaatatgaatacttgtccccatgactttcctgaaggtctaaaagatatttctgtctccatcccttcaaaaccaagatacctgattgtgaggagtagaagacccctatatggtccagtgtatgttctcttcaatctcaaagcgtgtttagagtattgccattgctatcagaaatgtgaactttcccctcagatcctagattttcagattaagctaatcttagaacatgggctttcctccttccttatcagaggccactgtggtaaaatattatagaaagtaattgttggccagtcgcagtggcttatgcctgtagtcccaacactctgggaggctgaggcgggcagatcatttgaggtctggagtttgagaccaccctggccaacatggtgaaaccctgtctctactaaaaatacaaaaattagccgggtgtcatggccggcgtttgtggtcccagctactcgggaagctgaggcaggagaatcacttgaacccaggaggtggaggctgccaagatctcgccactgcactccagcttgcgtgacagagtgagactctgtctcaaaaaaagtaataataataattgctaatacctaatgttgcgctttacagctcacatagaacatttacttatattatctaaaatgaggtattaaaatagatgaacaaactgatatctgggctgggagggagttgttgcttcttttatttctttggggtactactagcacagcctgtcagtacattaaaaatagagactttttggcattactttgttttttccaagattaactagcacaacacaaatttcttgtgcctaggtgtaaccagtgttgagacttcacataccacacacaattaatgacatcaaccttgcagtactgacagcgatatcatgcccagtttgtatatggtgtctgggtcatctgaggaagttaaaatagtattgtgatctgtgaacaggccaagtctagcaggtgccatttgcatagactagaatataaatagtatcctctaaagctatatgatgtaatgtccctaaaatgaattatctcccatcttctttcattctcagaaacaaaaatactgattcttgtattgtttgatggaaaactattagttgttcaacataaccagcaaagtataaagacttgacacctaatggcttctgttttctctgagagttagaattagtatgtagcttaagaagagctgtaggcatttagaatgatatttggggtggtggtggggaaatggaggcatcagctagggatagtttagaaccagttctaaattgagtggaattgccaaaattcggtatggtattggataacaaatatggcctattttgacacagggtcttaattttttttttaataggcttgtgccattcttcttaatctaataggcattggcaatccctaattacggagaactggtttgtctagtgacatcccaaacataggaagaatgtttccttctttaaaattttttgatagacacttgagtcaaatgaagaaatcccagatgaaaaattttagaaaggacattctactctcctgtagaatgggaaaattgtcccattcagctagttgtaagccaaaggagaaaacttaaggggttgtattatgcagctacatttttgaactgataacagttacccttccctgtcctttcctgcctaaacagatcctgatgctgcaaaccaacatttctttctttttttttatcactgttgatgaaggttatttaaaacagaatcagtgatatgttagcaaatattttatgactggctttcaggaaaaaagaacatagattcatagcaattgtgtcatggtttaaatactcccaccatcaatgtgaggtcactgaatgtagatttgagaagagctttgtatatgcagaattaattctcattagccaatctgagcaggctccagcacaccactgacagttaaaagaggtggatgactgatgtgagtaaccacatgaatgaatgtcaaaaacattatgctaaaaaaaatgtgctgaggtaagaagccagatataaaagaacatatactgtatgattacatttatttgaatttagaacaggcactattaatttacagtgatagaaatcagatcagtagctttttggtttttgttttattgagaaggaatttggctatgaagggatatgaaggaactttctttctttctttttttttttttttgagacagagtatagatcttgtcactatgctagtagcgccatcttggctcaactgcaacctctgcctcctcagttcaagcaattctcctgcctcagcctcccgagtacctgggattacaggtgcccaccaccacgcccaactaatatttttgtatttttagtggagacagggttccaccatgttggccaggctggtctcgaactcttgacctcaggtgatccacccaccttggcctcccaaagtgctgagataacaggtatgagccagcacacctggccaagaactttcttagatgaaaatattcatagcagcattacccaatagaactttctacagaactatcaacataacaattgtattttcaatctctgcttaggaaaaataaccaaacagcaatttaaagatagcctgtaggccaggtgtggtggctcatacctgtaatcccagcattttgggaggccaaggtgggcagatcacttgaggtctggagttcaagaccagcctggccaacatggtgaaactccgtctctgctcaaaatcaaaaattagccggctgtagtggtgggcgcctataatccaagctacttgggaggctgaggcaggagaatcacttgaacctgggaggcagaggttgcagtgaactgagatcgcaccactgcactccagcctgggcgatacggcgagacttagtatcaaaaagaaaaaaaaaaagcctaatagtaagatggaacccagtatgctagtatatatttaacagtcagctcatagcaaaccaagccctagtttgttgtgttttctaatttctatggtgtaaatactctcaccatgactcaccattcaaactaccaagatgaaggcattgaatggtgagttggaaagagaaatgtacgatcaattcataagctggtgtgaactcagtttctgaactgcttctacccgtcactattattgacggactgaattttcttggttttagtttagttctttagattattcaatctttcccagagctgtgtctttgcccagagactttattgaacctcagagatgtctggctaggctgtagctcaactttagatcctttaacagaaggaagaacacgagggctgagtgcggtggctcaggcctgtaatcctagcactttgggaggctgaggtgggcagatcacttgaggtcaggagttcaagaccagcctggccaacatgatgaaaccctatatctactaaaaatacaaaaactagttgggcttggtggtgggcacttttaatcccagctacacgggagggtaaggcaggagaattgcttgaacccaggaggcagaggttgcagtgagccgagatcatgccattgctgtccagcctgggtgacagagcaagactccatctcaaaaataataataataaggaataacatgcgtatgatccttaaaatatttctgcaactttttttttcccctggtgctgcagcttctattcgtaaagaatggtgaggaacacaaccaagctttaaaatcagtgtacttgagaggttttgttgttgttgtttttacaggtaattaaccatatgttacacattttaatctgcttttaagtgcaagagagattggcaaatgacttaataaagaaatgacttctgcttaaattggataaaatggttgtttactggtgtttattgctgtattccaagtagacaagtaatctgtgaatccagtttagtttattggacaataaatggtactcagaacttttatcagtgtttgattgtcaggatgcccattgaaattgacttcatacttagggaactttaattttattgtacagtatgcactgttaaaaaaaatatccttgtctttcagtataaacctatgacattgccttgtggcattatcatccctgagatgctttcttgctctaagatttcttctatgtcataaagaaaaaaggaacttttggttccttcatatctaatgcagttttttcttttgtaaactctaaatattttccattgccaccatcaacaattcaaataacaatcttactgatggaaagtccatgattagaaatagctgcttcttcaaaaataaagaactttgtatgtacctatccattttgaaaatcttaaccattgtgctcagaaggagagatatgattttaagaagggtcacatttagaataccaataatgtcctactcctgaaataattgggaccaggccgctaaaaagaaagcacctgatgtttggcctttcagtattttctataactatgacgccttggtccaaattatctaataaatgcttcttcctattctcccgccctaagagtccatggtctctttataaagaagaatcatatacatacagatattacttgaatttatatggcatcctcatgaggtgaatcccacctatgtcacttaggattcatttgattgccctggtttgatccaattcaagtattaattcaggccaggtgcaatggcacatgcctataatcccagcactttgggaggccgaggtgggcagatcacttcagttcaggagttcgaggctagcctggccaacatggggaaacccccgtctctactaaagatacaaaaattagccgggtgtggtggcaggcacctgtagttccagcaacttgggaggctgaggcaggaggattgcttgaacccgggaggcagaggttgcagtgagtaagccaagattgtgccactgcactccagcctgggtgacaagagtgagaccctgtctcaatagaaaaaaaaaaaaaaggccaatatgggcccagggcctgccattcagacttccgcttgtggcagagaccaagggatggcagcaggttagtcgcaggtgaagtcataacaagcggtgtggagccgcacctgggcaacatgtcggaaggaaatgcagtgagcgaacccagcactctgcaagggccccgacccctcctgactggggcccaggagctcagcaggcagcgactggcaccccttcaccccgggccgccttcccttcatccgctctgggaaccttaccctgggggttgaggttgggggtcaagaagaaaaccttcaccccaaatatcatcagtcagaagaacccaaggaagaagtaaccgtcaagaaggagaaacatgaaagggacagagatggacagagacaggtgcatggacagggatgaggccacccagaagtgatccagtctcactccatctttgagaagggcccagctgaaatgatgaagaaaaaaggaactggaataagaaagtgaatgtgtcagacatgggaccttctcatatcgtccacatcaaaaaagagaagaaagagttggacgaagacacgaaacatctcaccatgctgtagaaggacgatttcattgatgaccctgggctgaggaatgacactcgcaacatgcctgtgcagctgccactggctcactcagggtggctttttaaggaagaaaacaatgaaccagatgttaaaccttggctggctggccccaagaaagaggtgggggtacctactgtgaaactgaaagaggagctacaagatgaggaggaggccaagataaaggctccttccagagcagccaggaagacccccgggcctcccgaaggacatatccgtggcagagctgcccagggagctgagcctcaccaaggaggaggaattgctgttcctccagttgccagacaccctccctggccacccacctatccaggacatcaagcccatcaaggcagaggtacagggcaaggacagagaggtggtactcatcaagcaggagaacgaccaggaagccaggctggcaaagaatgcttctaccctagctgacctgacagagggtcaggttggcaagctgcccatctgcaagtccgaaagggtgcaactcctcctgggcaaggtgactctggacgtgaccatgggaaccgcctgctctttcctgcaggagctggtgtctgtgggccttggagagagtaggactggggagatgatagacctgggacatgtgaagcacaaacttctgtgttcccccgattttgaatccctcttggatcacaaacactggtaaaatgatcagatggaggaggatggcggctgctgtctgctccagacattttgttctcgaatctctgcaacccaggagaggccagttgagcccacccactccagcctttggcagccattgtcccagtttcccccagggcccacagggcttcctcccacagcagctgtgaatggcacagttaccttcccacagtgtgaagatggtacatccttgctgctggggacttgtccatgctatttgtttttgtatttatattttgtattttgtcttaatctcttcaactgactgcatcctcccaagggaggagggaggatctgtgggaaggtgcaggcttttggtggctgttgggccgtcaggcagcaagtgtgaggactgcagcttttgctggtgctcccttcttcctcccagaggcagtataggagagagagcaaggattgagtctgagacttaagcatggggtcccaactcatcagttcctggttctgtatccttgcgcaaactacctaacctttctgagcctcctgttcctcatctgacaaaaatggggatgatacctacttcacagggttgacgtgaggattacatgggatattatagatgaaaactccttgcacaaggccagaaccagtagccactcaataaatgttaatttccttttaagtaaataaataaataatcaaatgttaattcaaagtcccacatgagagcgttctgtgttttgtggtgtttgttttgttttgttttagagacagggtctcattctttcacctaggctggggtgcggtggcacaatcacagctcactgcatcctcgaattcctggactcaaaggatcctcctgcctcagcctcctgagtagctggaactatagacatgtgctaccatacctagctagtttttttttttttttaatctgtagactgcctctgtggacagtttttcaaattttttgtagaaacagggccatgctttgttgcccagactggtcttgagctcctggcctcgagtgttcctcccaccttggctgagacgacaggtgtgagccactgcacgtggtcagccttctatctttaaacaggatctgaatctagattcatcaactcataaatatgttctcatttttaaatgatggaatgatggaaagtgaaagcaccaatcaaatcatattttcattatttccagaatgtgttcagcacagttaggtctggaaaggtttttgggaaaggttgtgcaaggttgaatttattcactgttgaaatagcacctctaaatttcaagcaattgtatgatttacttttatacaagtgtcagaaatgctaaattattaaatcccaatggcaggatcactgacaactagaaacttgagtttatttgcttccgtggtttactaaactaagctagagaaatatagtacagttatttactacttaagatcagccagaaaatgtatagtgagttcatactgtactagattctgggagataatcaaatgtaaaacatataccagtctcaaggaagttaaaatctagtaggaataatcactatattcagcaataattgttaattgagcacctactctgtactagatacagtactaagagctgggaataagattaagtcataattcctacctataaggagttcaaagtttagttgagaagacatttgtaaagaagtaattgtaactatgatagataccttcctggaagtatgtgaaggttataagtgatggcataaaagagaataatcagttctgcttggaggccaaggactatagccaagaagacatgccttatttggaactaagagtgaaagacaatttgaaatgtagacttgatacatacacaagaataaaagatcatggcacatttgggacatcatgagtatgaccaaagagtaactgactaaagttactcttttggtcagggaaagataaagtttgaacaataggctggattcatatcctagagttaagagttcattcaatagagaaccattgaagagtttttaacaggggaataacatcagatttgtattcatgaaaaagtactctgtttattcatcatatatttattgagcccctataatataccaggcatagttctggatgctagcaatcatcagaaaaaaatattgccttttctatagctcctcttacctaggcagccaagttttgtgccctgagccctagctcctttcctgtgctcagctgagtgaatcagggttaggaacataaccaaaggtagacagtccatagatggtcagtgagctatgagctaaaacagcagaggaaatcagttttttgtctgtctgtttttgatgtaggatctccctctgtcacccaggctggagtgcagtggtgctatcatggctcactacagccccaacctcctgggctcaagcaatccacccaccttagttagcctcccaagtaactgggactacaggcacgcacccccatgcccggctggcttttaattttttttgtagagacagcttgttgtgcaggctggtctcaaactcctgggctcaagcgattctcctgtctcagcctcccaaggctctgggattacaggcataaatcaccatgcctggctggaaaccagttcttcagataagagagtgcagcatgtaacatttaaagaagtagagaccaggttgacatgaacagctttatagtaagattaaagtgatatgcttcatttagtgaacctattaaagataacagaaacctcgttaattcattatacacacacacacacacacatatatacacgtgcatatatatatgtgtatatatatagtcaggtgcagtggcccacacttgtaatcccagtacttcgggaagccaaggtgggaggatcacttgagcctagaagtttgaaaccagcctaggcaacatagggaggcccatctctataaaaaaaataaaaataaattagctgggcatggtggcgcatgcctgtggtcccagctacttggaaggctgaggcaggaagatcacttcagcccagagctcaaggctgcagtgagctgtgatggcaccactgcaccccagcctgggtgacagagagagatcctgtctctaaaaaatttcttaaatgcagtcacacacactaaacaaaggggaaataaggttttagagcagtaattccatctatcattgttttcttggtcatttttccatggaaaactatttttgtattcaaagtcaacactcattctcttatatgtttacattcagaactgaagaccttaactggaattaacttaaaacatttgtagaaaatcagatgcaaacatgaacaaactaagagattttaccacaaacaatgatgtagaggcaggtagtctgcaaggtcagaaccatgccttcagaagcagcaattttaagtgagacctgaatctcctatactcaaaggtcttgcattagtcaggattctctagagggatagaactaataggatagatatgtatctatataaatgggagtttattaagtagtattaactcacacaatcacaaggtcccacaatagaccacctacaagctaggagcaaggaagacagtccgagtctcaaagctgaagaaagtctgacgttccagggcaggaagcatccagcgcaggagaaagttgtaggctgggagggtaagccagtctggccttctcatgtttttctgcctgctttatattctctggcagctgattagatggtgcccaccaagattaagggtgggtctgccttccccagcccactgactttggcaacaccctcacagacacacccaggatcaatactttgcatccttcaatccaatcaagttgaccctcagtattaaccatcacaagtttcatttcaagattaataatatccttgtccatttaatcataaaaaggaatgcttattatgtgccaacttttccaagtgctttatatgtattaactaatttactcctcagaaaaatcctgtaagtacctgcaaatgctattattgttccttttttctttctttctgagacaacatctggctctatcacccaggctggagtgcagcagcactatctcggctcactgcaatttccgcctcctggactcaaaccatcctcccacctcagcctcccgaatagctggggctacaggaatgcaccaccacacctggctagtttttttgtatttttttgtagagatggagtttcgccatgctacccaggctggtctcgaacttattagctgaaacaatctgcccatctcagcctcccaaaatgctggggttacagacacgagccaccgtgtctagcctcctattttaaatatgagaaaattggcctggcacagtggctcatgcctgtaatcccaacactttgggaggccaagttgggaggattacttgagcctaggagtttgagaccagcctgggcaacatgacgaaaactcttctctacaaagaatcagctgggcatggtggcatgcgcctgtaatcccagctacctgggagtctgagataggaggatcacttgagccagggaagttgaggttgcagtgagccgagattgcaccactgcactccagccagggtgacaaagtgagaccctgtctcaaaaaaaaaaaaaaaaaaaagaggccaggcgcagtggctcatgcctgtaatcccagcactttgggaggccaaggcaggtggatcatgaggtcaggggttcgagaccagcctggccaatatggtgaaaccccatccctactaaaaatacaaaaattagctgggcgtggtggcacgcacctgctgtcccagctactcaggaggctgaggcagaagaatcgcttgaactcaggaggcggaggttgcagtgagctgagattgtgtaactgcactccagcctgggtgacagagcaagactctgtctcaaagaaaaaaaaaaggaaaaaggagaatttaatctgattaccagattgtaaatggcaaatctggaatgtgaacccaagcagtctgacttatgcacttaaccacagttatactccctctactctctatggagaatttatcaacttaatttagtcaaatttggttatcagtaccaggcttaagggaatttaaatgtcagttaactgctgtgtaacaatgaatcaaaatctatttattccatcatcacctttttttcaggaaaatagtagcaacattacttgaatgacaactttgggatcatattttactacttctctttcattcatttgtcccaaattcctgcctttgccatgggactctaggcagttgacaaactctgtgagcctcagagtcatcatttataaaataaggttagtgataccttactcatgtgagaattagatgagataaagtatacaaagcatttgatgcagtgctttttcactcagataactaccgttgcattccattgcctgatgtatcaaatccaaacttttgcgtggctttcaaagtctccctagaaatggctagatcccacccatcttgatttatttcttgccttacttgatatataaactttcttctgtctctattcctcttgggacatacacacctttcttttcctctctttttcattatccacatgtttaagacctagtttaagttcagtcttctccgtgaaagcatctccagttaaactatattgttctttcccttttttgaactcctgttgcagttataatagatgttacattgtgtgatatttcacaaattctttgatatatgctaggtttctctttccatctagattctaagctccttgagaagatagatcatgtcttaatatttttcctgtatctcccccagaggatctaacagagtatcataactattgttctatgagatctaatgagctcacagctattgttcaacaaatacttattacctgattgaagaaaataagctcctaaaaatacctgataatattatataggtctttatattgtcagggtgtttttataacactgttaatacttaatccatataatagtcacagaaaataggtagaacagatattatcttcattttttaggtaataacactgagtttaaattacattgtggcttgcccaaggattcttggtaagtagcgttattgaccccaccctcaacccctgccattccagtccattgtccgttctctatcaggctgccaaaataattttcttttgagacagggtgttgctctgtcatgcaggctggagagcagtggcacaatcatagctcactgcatcctcaaccacctgggctcaagcgatcctcccacctcagcctactgagtagctgggaatatagatgtgcaccaccacatccagctaatttttccattttgggtagagatgaagttttgccatgtctcccagtctggtctcaaactcctgggctcaaccagtcctcccgcctcagcctcccaaagtgctgggattatagacatgagccactgtgcccagcaatattttcatatcaaagatgagattgcatcactcccttatttaaaactttccaacagtttcccattttacatagaatgaaatcctgcaaaacccccacattcagtatactccaggtacagtggccttctttagcttcagcagtcttagtttgccaagcttgttgctagtctggggcctctgcacttgaatgttctacccctggaacttcacatggcttgttccttcttacccttgaaatctcaactcaaatatcacctcctcagtgaggaagtaatacctatgtaaattaactcccctcccttgtcacacttcatcatatcatcctgttttattttctgtatggcacctattaatatctcaaattaggccgggcatggtagcgcatgcctgtaatcccagcactttgggaggccaaggtgggtggatcatggatcacttgagctcacgatttcaaggcaagcctggccgacatgatgaaaccctatctctactaaaagtacaaaaagttagctgggcatagtggtgcacgcctgtaatcccagctaagagtagctgaggcacaagaatagcctgaacccaggaggtggaggttgaagtgagccaagaccacaccactgtaccccagcctatgcaacagagcaagatgctatctcaaaaaaaaaaaataatatatatatatatatatatgtatctcaaattagcttgtttatatatttgttacttgtgtattgtctatccccactagaatgttggcctcataaaagcagagtttttatcctattcacatctgtattcccagtccctaataaagtacctgacacatggtagagtcttaataaatatttattaaataaaatagctaagcccgaactagactaaaactatggcttttttgctcctaatcaagtgtacttcccatgaacatttaatttttcctactttttgtggaagcacttatacctttggaactacagtaagaattgatgttcagaataatgacattaagatgtgctgtaggattctctattatcaaagaaaaattttattcagttcaataaactaaactaattaaagcagggatgtcatggcatattattatattaacacatttagaaagatttccaaataaaaagactttctgctttttctttagttaactagaaaattaaattaactcagagctctttatgcctcaaaagtccttgttaattaggattgttctataaatctctattattagcagagttcatcatcttttttattgccctgtttattagggcagtctaagcagggtgtctttgctcatatcctgatatgtgtgtcctagtgaaaagaaaagcatttccggattctcattttttccctattccttgatataggcatatttcatgctgttagtataacaatttagtttccttctatcagttctctccataaagctggaatgatattattgacctatgaagcaaaataattaaatttaaggtctgtttaaaagcattaatgctttgtgacgttgtttatgataatagaagattgaaaatagcctaaaagtccatcagtaaaggattggttaaataaattatactatatccatgtagtggactattatgcagcaataaaaaataatgaggacattctctgtttaccaatatagaaagatatccaagattttaaaatatgatccagagtagcctagatagtatgatacctttttttgtgtgggtgaggggaggaaaaaattaagaatgtagtttattgtatatgcatagaaaaattctagaaggatatataagaaagcaataacagtgataaccagattgggaagtagaaggagcagaaaccagctgaagggcagagatgaggagagggagattttatagcatagcttttcatatgttttatatttttgaatcatacgaatacattacctactcaaaaagttaaattaaaaacaagcacaactaaaagtaatatgtggccaggcatggtgcctcacgcctgtaatcccagcactttgggaggccaaggtggatggatcacttgaggtcaggagttcaagaccagtctggccaacatgatgaaactccgtctctactaaaaatacaaaaattagccgggcatggtggtacacacctgtagtcccagctactcaggaggctgaggaaggatatcgcttgaacctgggaggtgaaggttgcagtgagccaggatcgcaccactgcactccagcctgggcgacgcagcgaaactccatctcaaagaaaaaaaagtaatatgtgattctggactgaattctataccagatgaaaaatattgctataaaatacattaggacaattaagaaaattgaactgtggactatagattagattaaaatgttgttttctgtgtttatcaactataacctggctaacagaatatcatcactcttaggaaatacacactgaagtattaaggggtaaaaggcataatatataccacaaatgctaaataaaactttgaaagaataaataatgttatatatatgggaggaatgatcaactaaatgtggcaaaatgttaaaaaatggtaaatctggataaatgttgcatagaaattgtctgtatttttctgggaacttttctgttaatttaaaattatttctaaatagttttttaaaagaaacaaacaaaaacattttaatactatggatattaccttattataagcaatggcataagaatgtgaagggttctggtttttacgtagtcatacttttcactttctggagaagtttttaccatcacttttctgtttcttccatgcctattgatgctgggtcagaggcagtggcaggggtagtgactgaattttaccttgaggttgaaaaacaccaggccaagtgtggtgactcatgcctggtgtttaggaggctgaggcaggaggatcacttgaagccaagggctcaagaccagtctggagaacacagcaagaccctgtctctacaaaaaaaatttaaaaattagccaggcatgttggcttgcacctgtagtcctagctgctcaggaggctgaggcaggaggatccttttagcccaggagtttgaggctacagtgaaccatgatcacaccactgcactccagcctgggaggcagagtgagaccttagctcttgagagagagagagagagagagagagagagagagagagagagagagacagacagacagaaggaaaatgaagaaaggaaggaaaaggaagagagagagaaaagaaagaaagaaaaacacctgcctacctgcctttcaacctgctggatcaccttcacttgtatcttctcaacagtttaggacatcaacaaaacagtaacaatgtggcattttaaaaattctttgaacaaaattttctaaggatatcgtgaggttgtgtgtatctagtgctaaaatatatagttaatttagtggaggtaaacctgcagaaacatttaattgtttggcattgagtaactggatttgtattattgttcaattagatattgtggcaattgtagaaacttaaccatctctaatataattgactttcattattgatgcatgaagatgtttttattctaattagattggcctcttaagtgattaggtagtgaagcttgtctcatatttaagtgaagagtaaattatttgtatgaagtgtctagaggatgcctaaaattgattattttgtattctaggtaagctaaattttattgttttgaatgaaggcactctgcaagtcttatctaataaatgacacaaaacaaatctgttatcaactgaattgttagtgtttgtttcctgtctgcttggggaagcttatgatttagtggttttttagaaatccagaaagtaggaataataattattcccaacccttttccttctcactttacaaaaagtttgtgaagaattgagaaataaatgctacgaataatcttaagctcttaggtagaagtacttgatcaaaactaaccaggtcatttttctacaattagtgcagaaagctagtttttactaattgttcccacagctactccaggcccatttcatgcctaagaaaactaggtcccagtgagagtcatgtgagtgttgtaggcttcattggttgaataacgtccttacctgtaagtgtatattcagatttagtgaatgtacttcatgtgttcatataataaatttcctagaatagctatggagtaggtcatgccggtaaaaactgttagttttgtgacttttttttttttttttttttgagactgagtctcactgttgcccaggctgaagtgcagtgacatgatctctgctcactgcaacctccgcctcccagattcaagtgattctcgtgcctcagcctcccaggtagctaggattacaggcacatgccaccatgcccaactaattcttgtatttttaatagagacagggttttaccatgttggcgagtctggtctcaaactcctgacctcaagtgatccacccgcctcagcctcccaaagtgctgggattacaggcatgagccactgtgcccggccatgactttttataatagatctgtaaaccagcttaagtcatttgaaaatcagagcatactgaaaatgtaataaaacataaatattattgaagatttttcagagtcatcattttgaaaggagttcttgtagttctttagataatagaaaataatgaaaactgagtttatgacgcatcttttgcatatatgatattcttatatacttatctgtactgataagtataaaaaggtagaaaataattctactttgtatttcaggaaattgagcttcatatgaaaactaaggataaagtatctcaatgatgtgtgtgtgtgtatatatatatatatatctccagaaaaaatcattataaagctgcatttatgtagaattttcagcaatttagataaataagtcatgatttttttttttttttcctccgagagggagtctcactctgtcgcccaggctggagtgtagtggtgcgatcttggctcgctgcaacctccacttcctgggtttaagcaattctcctgcctcagcctccagagtagctgggatttcaggcatgtgccaccatgcctgacaaatttttttttgtatttttagtggagccgggattttaccatgttgcccaggctggctgaactcctgacctcgtgatctgcccacctccacctcccaaagtgctaggattacagatgtgagccaccatgcctgaccagaagtcatgattcttaagaataaaattcaaaataatctcttccgttgtcgattaggttctgttcataaataaatatttatgcagtcaaaaatgaataattgttttcaaacgaggagctcaaggaattctatgtaattttggtttacttactatttatatataattattttccaatctgtaagtctagtgattaattcttatattacctaaaatgttttatagacatgttagattattacataatgtaaatgtattgtaaatagtaatggtttcattaacttgagctcattttacttatttagtacctgtttggttttagtttatagttgttatttccctgtatagtgtagcttgtacttggaagtagtaaaaccagatttctttataagtatttatggtacagaccttttcctaaatcagactgcagacctttcctgagtatttctaataaagtctgcttacattttttttttggcctgcatagtagtttgtgctatatatactctctagaaaatgtaattctggatatttgtgccataactttcaattaatcaaaatcttgtcaactgccatataggccctcatgttacaaaatgtggaaagttcagttacttaaagagtttggctgggcattgtggctcacacctaatcccagcactttgggaggctgaggcagtcagatcacttgaggtcaggagttcaagacgagcctggccaacatggcaaaacctatctctactaaaaatacaaaaattagctgggcgtgatggcacatgactgtaatcccagctacttgggaggctgaggcaggagaattacttgaaccaggaggcggaggttgcagtgagctgagatcacgccactgcactccagcctgggcaatagaatgagactccgtctcaaagaaaaaaagtttaagccagatgcagtggctcatgcctgtaatcctagcactttgggagaccaaggcaggaggattgctcgagcacaggagtttgaaaccagcttgggcaacaaagtgagaccctgtctctacccacccgccccccaaaaaaaagcaaaaaattgaccagctgtggtgctgcgtgtctgtggtcccaactacacaggaggcagagagaatcccttgagcccaggaggtcaaggttggagtgtgttatgattatacaactgcactccagcctggatgacagagcaagacctaaaaaaaaaaaaaagattttaaaaaagattgactaagtgaatgagtcctcttcttgaatatcagtcattccaggagagtattttcattaacatatttatgtctcttgttgaaagtatccattaagagcaggtagcaaaagctagacagaatatgcttttgaagattctctatgctctttattaatacctttcttaagtttctcaagatctccttttgcctccctcttgatcttaaacgagactgaagtttaagagtctttagccactctgtccccatagggatgcaaatttatgatttcagaagttccagcccccaataagaagcactgtccaatcgtttgcagatgtatcttgtaagccagatttcatgacagataagtccattccactgtcatgtgccatgtttaaagtactaaattaggttactctgtagtcaaaacaagtaagccctggtccagactactctagggcaaaatcccgttgcactgtcccttttgttctgcccatgcattcagttgtagctttcccttttgccagttgacagatagtgacttctttgcaaaacataaccagattaggttatttttagtaaaccaactaaaataaaaaattcttgacattgggaagaagtattttaacagaataatagtaatgtttttattgtgccattgtgattttctataaagaaacacccaatattcattatttatatttttttaaatttacaactctttaactgtatccaacatttcactgccaggaatatagtcaggctcgaagcttttttagaaacccatgatccaatccataccaacacttcctttagtttatggcttctgttcatttgcactgtccagaaaggtactgctaccatttgtagtcactccaaaaaaaagtgtgaactacctaggtataactctcataagacgtatacagcagcatctgtatgctgaaagttaccaaaaaagtattacttgcagatgattttgcaccttagttcccaagtgcccctgtacagaatatggagcttatgtcctgtctctctttgaatgatgagtgatgaaggagcttcagatgttactgggtgagcttgtattgagtgttacaaagagaagtcattctgcctttctttggctctaattgcagaaagtgaagtcactgcttttgctgtcttggatcaagaccagaaagaaattattgataccaatggagctggagatgcatttgttggaggtacagactaatttatttcattcttacttacaagtaaaacattttaacccttgtttctaccatataaccaagatttattcatttagtaacttctaatttcttcttttaaataattaacttctgaagttctttccatatacttctatcattgtcagtattagagggttttaccagaggaaaaatatgtgtttggaaaagataatttgctactatgctgtaccccagtcattttcacaagattaattgtatctgtcagaaaattgcataaacaaactgcatcaagtacagtatatagtatattcatagcccttcaggcttaaatgttaacacatttttgttctttaaaacaagttgtgatgaatattaaacagtatgctaataactaaggatgatgtcttttgatgataatcctttggttaaaacatctgtttcaaacacaatagtggttgtttgttatactaaaaagggttaaatttttgcctatttttggctcaataagaactggcaaattttatgtgaactaatgattttggtaatgaatactcaaaaataaaatcaaaacaatagaagacttggcttgatgacttagattgatctaaaatctgattcaaaaattcttttgataagtctaaattccttctagttaagtgtagttaattaagctagtttatagtctctagaaagctttcgcttcctcacagataccccaaaggggtctttcctggtctctgtttctttctcttaacatcaagccagaccaggttaatttaaaaaaaaaaaaaaaaaagcaagcaagtggagctgatgattgtccctttttctctggaggataatttgaatcatgggaaacttatttaagtttgtgtgatggttttaacttaatattttattttaatagtcttttgccaacataaatttttatttttctttctctaaaactattcatgcccagtcttttttttttttctcccaggctggtgtgcagtggtgcaatctcagctcactgcaacctccacctcccgggttcaaatgattctcctgcctcagcctcccaagcagctgggaccacaggtgcatgcctccacacctggctgatttttgtacttttagtggcgacggggtttcgccatgttgggcaggctggtcatgcccagtcttaaatgaactattaaccattaggatgccccatgcccttgttctttggaaagagtctgtaccacagacaacattctacttcactgttatgattgtgttttttatttccttgctcggaaagtcttcattattgataatattagagtacttagcagccaattttcctattttttactttttagagctatagatgtatgtaggctaaaatattttattctgaatttaaccatattctgtaatacattaagaaaaccctagtgatttcttggttagaaattggtcaaaccaggaatcttagtctagaaacttttaaacttatacactgtatgtacattacttaagtactttaaaatctttaaaacatgaagtattctatttctttgacattcagtgggacacataatgaggccatcatagatttgatggtgacctaaatagccactacctctggccttgggttacttggcttcctggcccggcaacaacagattctgttacagacacctaactatctgtaatgctaccgatactaggtgagaacatgtagactttttgagggagggagaggccattcttaggatactgaggtaggaacagctagctaccatttgtattgtggttacaacgataaataaactacttcatcaaagcaattgggatttttttgttagaggatttttcagcctctttttatcctacttcattatatttattgttggggtatagttaggtaagcaaaaaagaaaaagagtatagaacagggatccacagtcgtcttttttaaaggccaaatagtgactattttaggctttgcaagtcatatacaggctgtattgcatatcttcttgttttgtttgcttccttgtgttttgtttttttacagcacttttaatacgtaaaaacctttcctagctctccagctgtacaaaaacataccataggccagagttggcctacagactatagtttgccaaaccctctttaaatcatgggcagcttcctcactttattcatttctagcatttcaaagctccagacactggatttcactatacattgttgaaatcagaatagagaaagtagaaagcaggtagaaactaggcaggactttactggtaatacaattagatagccatttttctcactttgaacctactcagttcccagggtaatcagatcccaaaacactgggtcatgcaatgagatgaacatcctaatgtcagtttattaatagaatacttatgttgccatctttagcacattctgtcaaatgtgaatcaagctacaaagtaatagcaatagataacttttatacagtacctactaaccaaccaatatcttaaacactttatatatatattaactaatttagtgttcacaaaaacttcttggggtagattatttttacccctattttactgatgaaaaaaacagagacaaagaaaggtgagataatgtgcccatagtctcatggctagagagtagcagagccaggattcaaacccagaaagtctggctccaaagtcagtgcttttactcaccacactaatactgcttctctaaacatttatgtaaatctcaccattagaactgagaaccacagaccagccttcctgacaaaagctggttttgccagagaatcttcctgttatctgagtagatgacttactttattgaaaaggatctgttgtaatctgacagggttctggggactctaaggtaagattgttgaggaaaagaaagaaaaactgaaagggaagagaatccaagaactgtagtccctggtgagtttcaaccaagagctttttgctaagcagtagaatcgattgcactacagagatacagaaagccagatgataaacttgcttggttagcatgggctccaaataagagagttatatgaatcagctgtttaatagtgaagcaggatatttccctaagcccttctcaggcagaaattgcagtgtgtgggcgcaggaactagccagccactttggtgccagcaggagcgaacttcactcactcgcttctccactgctcacaggagggtgagcacacgtgagcaggtgcaggagctgggctgagcgcttttgggcactggtaagagcgaactccataccagaccagtggcagcatctaagggaagctgcccgtgacccctggatccccagaggaagcgttacagtgcccttttagctttgctgtctgtagacagcttaagcattaacagctcagttgagtgaccctccattgtcaccaatgtgacagccctttgcacccacactcatggcacccgagttcttgtccggcatccaggataaatgaggtcacacaaacgagttggagatggtaaatgcaggggattttattgccgatgaaagtggctctcaacaggaaggggagctgaaagggggatgaagcaggaagataatcccctggagtccggtcatccccagccagactcctctccaaagctatgccatcaagctgtccctctgaagtcaagccgcttctctccgatgtccaaccgtggtctacaacatccagctgcttctcctcttctttctctgttggctgagcctggggtttttatgggcacaggattgtgggtggggtgggccatgggtgattttggaaaaggcaacatttgagcaggaaaacaaggatgtaagttctcactttgggccatggtattaggctttttggctttaggatggggcgctcaccagagacctaccctcttctgcccagaaatttgcctgcctcctgtccctatcaatagcacccatctaacaactgatgcatctatcttacaacagaaatggtcttgttagttggaaatactaaaagatccattggttaaaaccccctgctccctctccacaccagcaggagcctttctactgggattggaaataacagctgttggcttgacacagtggctcacacctgaaatcctagcactttgagaggccaaggcaggcggatcacttgaggccaggaatttgagaccagcctgaccaacatggcgaaactctgtctctactaaaaatacagaaaattagctggtcatggtaacatgcacttgtagtcccagctactcaggaggctgaggccctgcccgtatggaaaaattaacaaaatggatcaaagacttaaatgtaagtactaaatcagccaggtgtggtggctcatgcctgtaatcccagcactttgggaggccgaagcatgtggatcacttgaggccaggagtttgagaccagcctggccaacatggtgaaaccccatctctactaaaaatagaaaaattagccgggcatggcgttgcatgcctgaagtcccagcaacttgggtggctgaggcaggagattcacttgaacccaggaggcagaggttgcagtgagtcaagatcttgctactgcactccagcctgggtgacagagtgagaccctgtctcaaaaaaattaattaattaattaataaaataattgtcgttgactccttccaccttgggaatgaatctcaggcagtggcaacttttacatttactatgtagtttatttttcttcgcttcattgcccaattaacatatcttctttctgattgacacattctatatttggatggttaatatattcatcctgtaactttcaagttttgctggcctaagagtatttctgtcttttgtgactttgcatatctatattttagtccactttgtggtaatttaactctctgaaggacaataattttctttgcataaatttcaagttttggataaagtatcactccagctaccatgtgctaattatctatatcagtaccagagtgccatgtgttcctttagccagctaaaaagatatatgactacatcatggattttcatgtataatttaaaaatgagtaacccaaatgtacataaattaaattaaattaaattcgtagttccatctcacgggtttagtgacagtaacaaatccctccagcctctacaagcatcgctccttgttctatttggaggtcttaagcactttgtgatatttgttctttatttgtcactgcccagccctgatagaactaatcttttcacattcttcctcaaaagcccaagtgctaggattgtactcttggaaatggatacaattctataatctctaagtatgatttcctaatttcctaggtcaggaaaaaatttcttcctgttgtcctgctgtgctttgtcacagcaggtctaccttttcatttggaaccctctttgtcactgccatagtaacaaatggaaacattgagaacattttgtgacaggcactgtcattgttcccagtgaaatctcttcccctgtgtcttcccagtaaatgaaactgagaagaaaaatcataacaaataacatgaaagaggacctaatcaatatgttcccactgggctgtcaataccagcctgtgttaatctaatatgatttagtcatatgttttatggcagctgtgggaatatggacaggacctacaaatcatctttagactgaaagtgagtacacctttgacagattatgtgtaggcacttatatacaactctcagataaaagactagagacttcacccaagaaccaacattcttagaattaaaaaaaaaaaaaaacaccttcattaagtatggttaaaagccacgtatagattagaagattttactttgttggttttttttgttttgttttcgtttttgttttgagatggagtcttgctctgtcgcccaggctggagtgcagtgacagaatctcggctcactacaacctctgcctttcaggttcaagtgattctcctgcctcagcctcccaaatagctagaattacaggcatccgccatcacgcctggctaatttttgtatttttagtagagatggagttttgccatgttggccaggctggtctcgaactcctgacctcaggtgatccacctgcctcagcctcccaaagtgctggatttacaggtatgagccactgcacctggccagaatattttatttggaatgataataaagtaactgtgctgactcataatactttttttggagggggagatggggtctcactctgtcacctaggctggagtgcaacagcacaatcatagctcactgcagcctcaaactcctgggctcaagccatcctcccacctcagtctcccgagtagctgggactacagggtttttaaaaaatgtttttgtagagacagagtctcactctgttacccagtctggtcttaaactcttggcctcaagcagtcctcctgcctaggactcccaaagtgctggattacaattgattaaaatgacaattcatttgggattacagacatgagccaccacccccagccagaatactctttattttaaaaatcctcacaacagcttcagcagagaaaatgtattacccttaaaaatattacctataatatgcaaatgactctgaaaaccactcagcaatcacaatgcaaataattctcctatttcccatctaataaaaaggaacactaattacattctctaggctgggagcagtggctcacacctgtaatcccagcactttgggaggccaaggcaggtggacagcttgagctcggcagttcaagaccagcctggacaacgtggcaaaaccccatttctaccaaaaataaaaaaattagctgggcatggtggcataagcctgtggttccagctactccggaggctgaggtgggaggattgctggagcctgggaggtcgaagctgcagtgagctgtgattgcacccctgcactccaggctgggtgacagagcaagaccctgtctcaaaaacaaacaaaaaacaatttcattctctaattcatgtttagaaaagaacattggtttacaaaaaatttttaaagagttttttcagaacaaggatgccacttcctcttcatgtggcacctatctatacttctgagaaccatgaagactctctaattatcttcatattttctatcctcaccttgtttctttggtcccaaacatttatagcttccttccccattcttcttaattgctgcttcattgtgctatgcatagaagtggtgcagaattcttgggatttgttttttctacactacccccttcctttgctctccatctcagaagactagaagacaacttggtaagtgttgaatatattgtttctcagacttcttcactcaaaaaccaaaaccttcatatgacccacatctgctgaggatttacttgatggtgaccaagatgacagctgcccactgctaaacaacccaatgtcaacaactctttttcttgtctttctgctctaatgggacatcttctctgttttatttcttgaacagaaatttttcttaaaaccatcaaatgaacagtgaaattggcttggtcattaggaatatgaaacagaccaggcatggtggctcacacctgtaatcccaacactttgggaggcagaggcaggaggatcacatgaggccgggatttcaagaccagcctgcacagcacagtgagaccccagtctctacaaaaaaaaaaaaaaaaaaaaaaaaaaatagccaggcagggtggcatgtgcctgtagtcccaactactcaagaagctgaggtgggaggatagcttgagcccaaaaggttgaggctgcagtgagctgaggtcacgccactgcactacagtctgggcaacagggggagaccctgtctctacaaaaaaaaaaaaaaaaaggatatgaaacattcaccacagatagtagttcaggttcatgcaacagaaagcaagagagagctatacccttgcacagtgataggatgctttattacatgccacactagtgttatacatccagagtcttagtcaagctgaagctagaccagcaccaaatttcataaacactgtctatgattatttgagccttcgttagttaaaaaaatgtaaagattatcctctccagccatgatttaaaaaaagagagagagaaatcactttgttcatgtgaaatacaggatgattttagagtgaagcctgtaatttctcatcaacgcaaatgttccctcaaagacctaatatcctgaatggccttcatctagaagcaattgtaaatagataatggaattgaaaggagtttatcttctgggaatgtggataagacacagacagtctgaaccatgtaggctatcagactccaaagctcagatgtgaaacttaggtttcttatatttgatgattattgagaaatatttattctaagaaaatgatgttgatatggaaatttttatttagttgcagaggtccacaggaaatgtagtaagtaaaatttctgaagttcattttcttaaacagaattgtgacataacaaaatatatgtgtgttagttccctgacctagaatattggtgagccaattggaagtaatttgaatcctaaaattctctcagctgctattaaatgaatctggtcaattttacctgtctgatacatccaacatgtatcagttagcttttactgcataactaaccactttcaaaacctagttacctaaaataacaactcatttatttagctccacaaatctgtgggttgacagctgggcctgtgcttacctggacagttcctctggccttagagtgttgagagattaagtaatttgcccaaggtcatattgaaagctaagattcaaactcaaaatttggcctcaaagttcttagccctagccattttgctatactcccttttattactacaacatcttagcttcctctctaaaggaggagaaatagccaaagtggttttataaacactggtctgtcgactggtaccagtctatgacataagagttttcatcagtcagtatcaaaatgtaaaaaggcaggggcaagaaagtaaatttccataaaactaaatgtattcagttttaaatcttgcccttcctactttgagggagttcagttttctttctttatgaataatgttggtaatagtggattttttaaaaatgttcttatctagcagaattaaagtttgccagctctgtgtttatccctaaaatcttttgggcaagtttcaatgttctgtgaaatcccaaagtctgggattcactgatcaaccatattttttcataaattctacaaaattatttggccttttttttttaatgccagtaaaaaattactgatgacgtgaatgccattcatgttgggcttttctaatatctggcccacttcttcatataaagaagatgagtataggccaggcgcaggggctcacacctgtaatcccagcactttgggaggctgagacaggtggatcacttgaggtcaggagttcgagaccagcctgaccaacatgatgaaaccctatctctactaaaatacaaaaattagcaaggtgtggtggtgggtgcctataatcccagctactcaggctgaggctggagaatcgcttgaacccaggaggcggaggttgcagtgagctgggatggcaccaccacactctagcctgggcgacacagcaagactccatcccaaaaaacaaaataaaaagtaaagaagacaagtatagaactgtaagttctatacttactgtaaacagatgagtacaggccgggcacggtggctcacgcctgtaatcccagcactttgggaggccaagacgggcagatcacgaggtcaggagatcgagaccatcctggctaacaaggtgaaaccccgtctctactaaaaatacaaaaaaattagctgagtgtggtggcagacgcctgtagtcccagctactcgggaggctgaggcaggagaatggcgtgaacctgggaggcagagcttgcagtgagccgagatcgcaccactgcactccagcctgggcgacagagcaagactccatctcaagaaaaaaaaaaaaaaaatgatgagtacagagcaataagtataatatgatgtgatttgtattttgttaaaaatggtcttatgtgtgtatgttgtaggtatacttataaaagcatataaaagttccaggaagaaacactccaaacagctaacagtggatgtactgggaggtggctgaatgaaataatcactttctactctgtatgtctgaatttttttttttttacaatgtgcccttattggctttgtaattagtgtaatctttaaataaataaaatcacatgtgtgtagcactgatgcagagcctagccaaccttagtacctagcagaaatcttcactgtggtaaataagtcatcagacacagcatttcaaactatacgataatttacataaaacataacctctgatgttttaaggctacttatcagcaaaggtctgaataaaacaaaattagcagcatgattgtcaaattaacagctactctctcttcagatatataagttctgaaaccaggggtataaacacaggcttttaatttatttttcatttaattatccaattaacgttgacattttatagaatttagatatatttctagcccacaaagtaaatggcaaattaaaaactgatttctgtcatcaaatgctcttaaaattttagaaccatcatgctatgagaaattttcagttgatcaaatgtaggtttttgaattgagttaaataataacaaaatgatccttcttatgaattagggcataagcacagcttcacataaacaatgttaccatcatcttatcccagcagctattactttgccccattgaatcttttgtttttaactatatcatttagagtgtttgtgctgaaaggaaaattttaaaaaatcatattttctggttttcagtttccagtagtgaaactcttttcaaatgagatcttatctgaatcagaatgaaatgaacccacaaaaattaaaaattaaaaatgtttttaagaaagaatgaaatgagattaaacaaactcccatttgtccctatccacattttatttggtggctcatgatgtcacgtaggaaaaccatgacctattcaaaagcccctatttgatgaatgaagaaagtaaggcccaaagaaaggtaagatgagttgtccaagggagttaattgcaaatacgagacaagaagccagattactgaattcatgaagcagcagttacttgtgttcataatccaaatgaaagttgtcagttaaggctgagcgcagcagctcatgcctgtaatctcagcactttaagaggccgaggtggacaaatcacttgaggtcaggagttcgagaccaccggccaacacaacatggtgaaaccccgcctctactaaaaacacaaaaaattagccaagcctgatggcgggcacctgtaatcccagctacttgagaggctgaggcaggacaattgcttgaacctgggaggcagaggttgcagtaacccaagatcacgccactgcactccagcctgggcgacagagtgagactccatctcaaaaaaaaaaaaaaaaaaaagttgtcagttaagctgtctgttatttagtcctcttggaaacatataggtcaagagtcaatatcccaaatgcacagaaggaggggttttttgttttgttttgtttttgtcttgatgtttgactttaacaataaacagaagcatacgctaaacttttattttgggaaccacatcaaaagatcacacattagctttaaaatcaaatactgactcagtgttgtacatctatgctccatgaagaagaatgacttttaaagcagtgttttgaaagggattagggtgaaagggcatcttatctatatgagtgcaaaatactgcttagcagtactcttcaagagctttcttccgaaattaagatcatttttaaattgatgggcttttggttttgtttttaattcaaatacaatgtcccataccatgttaacagaacttagtaagcttccatttttagccaccacaaagaaggaataagaagttattctcaaagctgtagctataggacaataaagttattctttcttatagctacagtactgaccacttgcctgtatattacacattgcttctcagttgctcactttatgtgggagggtgtgttgtgctgaactatcttaaagcaacctttgctctaaattgacttcctgtacatgtcaacaattaacaccatctgacaccaattaagctttagttttcttttcttttcttttcttttttttttttttttgagacggagtctagctgtgtcgcccagaatggactgcagtggtgtgatctcagctcactgcaacctctgcctcccaggtttgagtgattctccagcctcagcctcccaagtagctgggactacaggtgtgcaccaccactcctggccaacttttgtatttttagtagagacagggtttcatcatattggccagaatggtctctaactcctgacctcagatgatccacccgccttggcctcccaaagtgctgggattacaggcatgagccactgctcccagcctggttttcattatgcaaatacctgctaggtcagaccttaccctggcaggcacagtagctttttcagttatttcaaaatttaatatttattattttccctgaaaaatcagttttctaaaatttgggtcacaagttgttatttgagttcatgactaattggtagtcaatatgaagtcaaaacaaaattttactaactagactacatagaaaatacaaaaagtttacatctgagcacttttcagcagggggaaaccattactttgtcacatctggatattctaagctagccaaattgaagtgggaatttcctgccagatgttagttctttgagcaacctgtgaacatctaagtaagtgaggggttatgagtccttgtttggtagagctatacccactctggaggcttgctcctaacaggcagcagacattttatatgtactaccaccagtcaggaggttgtgcaacctatttgaagtcaatatgatgtgctcttgttaaatgtcaaaacatccaaggcctcattttgaatgtacaacatcagtcttacagatattatatccagggtgaacattgcattgaaatgtcctcccaaatgtagatgacaaaaattttgtttcattaatagaaagaaggtaagactgaaacaccacaggtattccagataacttggatagggccattttgtaaagtcagtgtagaccaaaatatgtctctaaatatgagggaaataaagaatctgaaatgacatgaaaaataccaagtatttatatcaacctcctgttctagacgcacatgggaattaggaagtgaaaatttcattcagaagagctgtgcacaaaaagtggaaatgcattattcaattgaaacaagtaacatttttaagggggataaaatactttctacatgatctcactggttttgtcgtcctccgtaagggaaaatattgacatttaccagactgtttgctccagctttctgatctcctgcagtttatttttataacaaccttatcgatgggcctcttacccagctctctaggtttaactgagttgagtcgatttgttaccacagcttcaagtagctgttacagaacaagcaagacatcctaataaagctgtaaacgtgtttactcaaacagagtattgattttacttggaggggaagaagccggttcttagcacagtgtcagggtggatgaatttcactgcagtttttcattgtcatctgtcagggttgtgaaacactaagtaaagccatcagaggataattagaagtaccagaagtttagcccctaaaatcagttaaccacttgggagttttgtagcttaattagcttttattaaaactttccctagtattaatagccaagcacttttaatggtatttccaagtagatcaagatatcaagattgtgacttgttaaatatatgaatttaatggctaagggtttttcagaccttttctcactctaaattaggctaccactagaacataattagaaccaaaaccaatgtaaagatacagtgatctgtacttatactagcagaataaatgcatgatttttttttctgaaaaatcaacttaaaagaagtagtaaaacaattataaaataatttaagccaggcgcagtggctcatacctgtaatctcagcactttgggaggccaaggcaggaagattacttgagcctaggagttcaaaatgagcctgggcaacatagtgagactcccatgtctacaaaaaattaataaattagccgggcatggtggtgcacacctatagttccagctactcaggaggccaaagtgggaggatcgcttgagctcaggaggtcaaggctgcagtgagccgtgatcacaccactgcattccagtctgtgtgacaaaacaaagccctgtttcaaaaaacaaaaataaaacatgtctttgtagaaaaatccagtttgcgtctttattacacttaaatgtttttgtaacacaatgtgatctaaacacataaaactgtcaatgccacccttatttttaaataccttgattaaagcagattctaaaatattctagcttactttaagttagtcattgtcttaacaataaaagctgatgcacgttgtgcaaaaggtaagcatcagagtaaggagttgcttaccttctgtagaaactgcattagctactgagcttcatgaaaagcattcatgtgaacactacctgacctcttccaaatgtctagaaaaacaaatcacagttgaaaaaaatcacccacctagaaaatgaacaaaaaaactggaaatttattaaaaataagtttgaccttctctcatgatgctgcagtcaagcaaaaatgaaaaataagtttgaccattatatttaaagtacatcttcccatatctaaataattcatttagtgctttatggtaaactttttatgtcttcttgcactactgcctcggcctgtctaaatgactaataaaaattatgatatctctgggatgaccagttctaaagcctaagggtaacagactctgtcagaaagaacagcaaaagatgttgggttttctttgtctttgaaatgctttgtcacgtgtttatctgtgcatatagttctaagccaaattctaccctgaattgctttaagccacaaagtagcaggttgtaaaatattgttgcataagagggcacctctagagcttgctcttctaatttttctaaaggtagaagaaattgacttttcacaattgtatttagatcattcttccatattaaggtattcaaaaacagaaaacataaaggatatggatttatgattatatcatttttatgtgcatttcaaaaggcccacaatacagtaatttattttattctatgcaattttcttgagaatgacagcatgtgagagagctcgttggatggggaggggcagtatatagtagggtagccatatttgagcttcaaggcactgtttactctgactccttcagtcaaaaggagcataaacccatttcacctagttcaggttaaggaattttttttttgtaaggaagatattataacagtggttaagacactgggtcaaaatatgtggggttttttgtttgtttgttttggttttttttgaggtggtgtctcgctctgttgcttaggctggagtgcagtggcgcaatcccgactcgctgcaagctccgcctcccgggttcacgctattctccttcctcagcctcccgagtagctgggactgcaggtgcccaccaccacgcctggctaattttttgtattttttagtagagacgaggtttcaccatgttagccaggatggtctcaatctcctgcctcctgatctgcccgcctaggcctcccaaagtgctgggattacaggtgtgaaccactgcacctggccccaaaagatgtggttttaagtcctggtaccacattaactagttgtgggactgctgtggtttgaatgtgtcccctctaaaattctagcattgtcaatgtgatagtattaagaggtggggactttaagaggtgattaggccttgatggctcctctctcattaatgggattaaggcccttataaaagaggcttcatgcagcatttggctagcttgctcttccactctggcttacccttccaccctcacaagacaccaaatgccaacagcttgatcttgaacttcaaagctgccataattgtgagacaataaatttctgttctttatgtattacccagtctcaagtattctgttgtagcagcacagactatgagagagactatggaaaagttaattctcttttttgtttgtttgttttttgttttttgtgtttcttttttagatggagtcttgctctgtcaccaggctggagtgcagtggcatgatctcggctcactgcaacctctgcctctcgggttcaagcgattaccctgcctcagcctcccaagtagctggcgactacaggtgtgcgccaccacgcccggctaattttttgtattttagtagagacagggtttcaccatgttggccaggatggtctctatatcctcacctcgtgatccacccgcctcaacctcccaaagtgctgggattacaggagtcagccacagtgcctggccgttacttaacatctctaagcctccgtttcctcatttataaaaatgaagataatgagtacctatctcatttgggttattatgaaagttaaatgaagtaatgtttataaagcacaacacctgatacatagtaaggattcattaagtgttacatattataagaggggtctcaaagaagtctcagacaagagccagaatgacaagttttcactgaaagtatagccagatggtgattgtaggttcaagtcagttctggagacctcagcagcagatactggatcttcactccagttcttcactaattaatcctactcagctgcattacgtgtctgcgtcttactgtctcacagtcagcttcccagcctgtctttgttttccattctggctcctaaaagagaacactgggttattagctcaattcactttttatacaatgtcatcagtaggacactaggagaaccataagttgtttgcccttgaacgagatgcctaccctttgttccatttaatagtaaaggttgaatttacgtgcacaaaacattctgcagtgctggaagtgatttttcttaaaagggtaatacgtggatgggctctataaacattgtgtttgcatgccttgtccactaccttcttcccatatttatagttctgaaaatgttccctacaacgtgatccatctatcatacaatacatggaacatcaaacagcttgtatctcaagctagaaacctagacgcccttcctgagtccttccattccctctctccaaaccgtcagtgagttcttttgattccgctttaaggatgtatctcaaatttgtccacttctatttctctgtcatgactttagcttaggcctgttttccacttactgtagtagtttcctaactgatgtctatgccttcactctttctggaactttattccattttctgtataatagccaaaataatcactttaggaagaagttgaattatttcattcccctgcttacaacctttccgttgcttctcactgcacttagcctaaaaatccaagctcctgtggtgatttaaaaaaatctatatgatctgctatgtttgtatctttatttcattccattttcacctttgcctgcatgatgtagctatactgtcagtcttctttcaggccttagacactttgtacagtggagtttactttgcctagaatgttcctcccctactctttaaaagtcaactcttctgtaatcatcctatctaaaatgggtcccttgactaatattctctcctgttactcagttctttttcatagtagcacttaacactctggaattgtcttatttacttatttgtttacttgtttttgtctatttcccccattacaatgtaagtttcagaagaacaggaactgtaagtgtcttatttaccagcgtatccccgggacccagcacagtgcctagcatagaagactcagtaaatattagttaaataaatgaatatatcaatcatatgcacagctgcaaaccgatttgcccctaccatcaagtaaagaccatttagtcggtatttctaggaatttggttattgaggtatatcataagaaggggttagaataagtcaggaaacagagtaggccatactttaggatcaggtcaacttggtttaagagtaacccacgctaggccaggtgcagtggcttacgcgtgtaatcccagcactttaagaggctgaggtgagacaataaactgagcccaggagttcaagaccaaccagagcaatatcgtgagacccccattggtatcaaaaattaaaaaattagccagacctggtggcaaacacctgtagtcccagttactcaggatggtgagataggaggatctgttgagcccaggaggtcaaggaaacaatgagccataatcatgccactgcactccagcctgagtgtgtatgtgactaatccagaaacagagagactgatcatactacctttagtatcacttaaaataaaggatgctgggctggggggcatggtggctcacgcctgtaatcccagcactttgggaggccgagaccggatcatgaggtcaggagatcgagaccatcctggctaacatggtgaaaccccatctctactaaaaatacaaaaaattagctgggcgtggtggcgggcgcctgtagtcccagctactcgggaggctgaggcaggagaatggcatgaacctgggaggtggagcttgcagtgagccaagatcatgccactgcactccagcctgggtggcagagcaagactctatctcaaaataaataaataaataaataaataataaaataaataataaaggatgctatggagagaatacatgtgttaggaaagaaggtagtatttaataataattgtactaagtagttatagtacagatacaaaaaatttattctcaagatcataatcctgaacatcagttcctgctgtaataggcagtaacatacaggtcagagactccagtcaagatttcataaaatatattaaagttatccagtagatctccaagttgattcctgacatcactctcaagtcccctaatacacacatcacactctcaaacttacaaatttggtttgccaaaatgtccagtgggaagggtttaattcagcagataatagaaccttgccctgtcctacctaggatctttgctgccattccttcgtttataggtgtgagtggggtaaaaagtagctcatccataaaggaggcagtgaaaatctctagtgaagagcactgagcctgggacataacctgtttcattttccacagcttctttacctcaagccacagaattgttcttagctctttaacttttgtcagcacccacatcaaatcaacaaacttgtttatttttcttctttccttactatctatcacccagaatagtggttctcaaacttgagcgtgcatcagaatcatctgaacacttgttaaaagatctgttgctggaccctctcccagggcttctgatttagtaggtccgtgatggggcttaagtgatactgaagcagctggttcagggaacacgctttgtgaaccatttctggaaagaattttacagtagattcccatttgatctctctgcaagcagtctctttcctagtaagttcatattccacacttctgccagagttagctgcccaaaagcaatgtaatatgcctcccctgtatcagagtttggttggctctctatttattatagtataaaatccaaatcaggctgggtgtggtggctcacacctgtaatcccagcaatttgggaagctgagatgggtggatcgcttgaactcaggagtttgttaccagcctgggaaacatggggaaaccccatctctaccaagaatacaaaaaattagtcaggcatggtggcacacacctgtggtccgagctactcaggaggctgaggtgggaggattgcttgagcctggaaggcagaggttgcagtgagctgagatcacaccactgttctccaacctgggtgatagaatgagaccccgtctcaaaaaaagtccatatcacatcatacaagatccttgacgatatgtccccattttgtctttcccgctgtgtccccaactcagctgacctttgactatattgcaaaataagctttgtcctgtcaacagcatggctttttttcctgcttataatgtctatctctgcaaaatgttattcattcaacacccagctcatgtcaccttctccaagatgcatttctaaatgtcccccaattgaggtgttatgttatttttaaagtgcatacgtggctttctctcctaaagctataaaaccctcaaggacaaacactgtgttttatccatctttgactcctttggtgcacccaaagcccagtacctagacattcaatagctgttggttgatggaatgaatccaggtacttctgacagattccagattttcactttcttttgtttcttataataaaaatgtagtatagaagcagtcatggcatgagtctagtaaactgaggattcagatcagtcaaagttataatttatcttattccctttcctaaagcagctagagataatgaaaataaaacctttaaaaagaatgtaacacctttaagttgactgcctcgtgtacactgtggcagcatatatctggtaatcattggtataggaggtaagtttaacaggccagtttaagacagcatataaatcatcactaaaggacagatagctaagaaagatggaaaataaacaaataattgaaaaaccagattgacccagaaatgactaagaacaaagtttgtgcagggagacagggagaattgagtttagtactgttagttgctgtaaaatatatcaggtttgctttaattacatggtaatgcttctaagaacaaaggtaattacatgataacttatgttactactcccatattatctctaaataactatgtaattagcttgtcactactatacagtgtgaagtttgatattactcatggataaagaacattggtaacttaagtgagtgagcaagggtggggtgagggatggaggcagcagggaaatcatagaattattacaatcaggaatgcaaatggttaattagatcattgcacccagtccttaaggatctgagccagagccatggagaataccaaacgagtctgaggtaaattctccatggcttgtcacagtgtcttctgaagaccataaacatacaacaaagtaagttgacaaagcacgcaacagatcaatgagtttgggatataatgcatgtaattttaaacagttccttttatttggggaggtttttcttttaagtaaatactaagaattttttttaattgaaaaatatttcactcatctcattttccaacatcctgaggttatatgtgtggcctatggggtgaggatgtgtagcactgggaactctcatttattgctggtaaaaaatgcaaaatggtaaacaaccactttggaagacaatttggcaatctcttacaaaactaaacatacttttaccatatgatctagcgatcaggctccttcgttgcccaaatgatttaaaaacttacgtcttcacaaaaacctgcatgcatatgtttatagcagttttattcataattgacaaaacttggaagtagctacatatctttcactaggtgaatggataaacattatcgatacaataaaatatgattcagccaacaaaaagtaatgagctatcagctgggcatggtggctcacacccgtaatcccagcattttgagaggcaaaggcgggcagatcacttgaggccaggagttcaagaccagcctggccaacatggtgaaaccctgtctctactaaaaatacaaaaattagctgggcatggtggcaggcgcctataatcccagctacttgggagactgaggcaggagaattgcttaaacccaggaggcgaaggttgcagtgagctgagatcgtgccattgctctccagcctgggcaacaagagcaaaactctgtctcaaaaataaaaaaaagaaagaaggaaagaaatgagctattaagccaagaaaagacatgagggaaccttaaatgcatgttgctaaatgaaagaaggcagtcttaaaggctacatactgtgtgattctaactacagtcatgcaccacataacattttggtcattgacagaccacatatatggcagtggtctcataagattataaaaccttatttttactgtaccttttctatgtttagatatgtatagatacataggtacttaacattttgttacaattacctaaaattcaatagaataacaggctatacaggattgtagcctgggaacaataggctataccatctaggtttctgtaagtacactctgatgttttcacaatgacacaatcacctagtgatccatttctcagaatatatccccgttgttaagcaactcaagactgtatatcacattctagaaaaggcaaaactatggagactgtaaaaaagtcagtagctaccatgggctggagctgtggcgcaaggagagagggatgaataggtagagagcactgaggatttttagagcagcaaaactgttttgtgtgatactttaatggtgtatattattatatttgtcaaatcccacagaatatacaacacaaagtgtaagccctaatgtaaactatagatattatttaatgataatatgtcaataatggctcatcgattgtaacaaatacacccactaactaatgtaacaggttaatcataggtggaactggggagtaaggggatgagggaagatttgggaactctctgtattttctgcttcattgttttgtaaacctaaaactgcccaaaaatataaagtctaatttttttaaacccaagtgggaaaacctttcttcgatccatcttattctactgacatcttgggtgtgtatgatggtctgtgtttcccagtgtcatcaatttcactgccttaaggtgctatggcttagacttgtgtcctgtggccagtgacctcacagtttttaccaaaatacttgttttcattgctatcacgtgatagctactctaagtatgattatccttcttaattctgttaggaatccccccggcattccctgtgagggaagtattagtccttgaatttccgtttcaaaagatgcgtactgatttacttggtatatagcttctgtaagaggaagtttcatttgggaaagaaaggttgtgctaaggttccctcagaaactttctaaattgccttctctaaaattgcctgtgtttccctaagcctaagagtaaaatacaggaaatagtgatgatttttatgtgcttgaggaatcttctaagaagagtgaccaattttattctacttatactgatacttgtactgatttaccttgtggaaaattcatccagtggctacaattactaactcactccaaaggcatgagtgggaaactattaaaataacacatcacttagctgaaactcttgaatggttgctcttaataaccatttttctgaataatttaaagttcccatgttttttaaaaaggtttattgacttagatctgatttgaaaagtgtaatgtagcttattatagaatatttaaaacataagaaaaacaaacaggaaaaaagtcatcccaactctagaaacttaacttttttcaaacacattttttttttttttttttttttttactattttgactaaacatgtttctaaatgtacttcttggatctgactaaagactaaaaatggaaggaaacacaagtagaaattataaagtcaggatcaggccagtgtggtagctcatgcctgtaatctgaaaaccttgggaggctgaggtgggaggatcacttgaggccagaagttggagaccagcctgggcaacctagtgaggccccatctctaccccaaaaaaaaaagaaaaagaaacttatttatttaatttcctctctttaaaggtatcatatgcaaaacagaaggtttgggggttttggggttttttgtttgtttgttttttgagacagggtctccctctgtagtccaggctagagtacagtggcacaatcatagctcactgcagcctcaaactcctgggctcaagcagtccccactaccttagcctcccgagtagctaggactaaaggtttacaccaccatgcccagctaatttttctattttttgtagatacagggtcttgctgtgttgccagggttggtctcaaactcctgggctcaagcaattctcctgcctcaacctcacaaagtgctgggattacaggcatgagctgctgtgcccagccagaagttttcattttagcacagtttaatctttcactttctggtttctgctttttgtgtgtcttatttaagaaatattttctacctctaggacataaagatattttttattttcttctaaaagtcttactatttttccatttacatttaactcattgatagacctggaattctttttttttttaatatagagtgaggtaatgttatttttccaaattgaaaactagttgcctaaacactacttttctaagaagccatcttttccccatgaatttgcaatggcaactctgttgtagctcaagtttccaccttttctctatttatttatagctatgccaacaaacactgcatttattattatagatttttagaagtatttaatctggtaagactagtctctcctatcatttttacttcagtaagtgtatatgcctgttcttgatcctttgctttttcatataaattttagaatcaacttatcaggttcccaaaaacattgttgagactgtgattgaatttgtattgaatgttatcttcttctccaataacccagcatatctctccatttaggtcctttgtaatatctttccataaagttctatagttttctttattagaggctggcataacttgcatcgcttttgtatttttaccaaattacatttttaaaactgttgctcttgtatatatatatgtgtgtgtgtgtgtgtgtgtgtgtatgtgtgtatgtgtgtatatatgtatatgtatatatgtatgtatattctatatacaaagctgctctcaatgaaaatattgacaaatttatttcttcttttacaattcctgtgtatgtgtggggtgtgtgtgtgtgtgtgtgtgtgtgtgtgtgtgtgtgtgaagatctcgcactgttgcccaggatagaatgagtacagtggcatgttcacagctcactacagcctcatccttctgggctcaagcaatcctcccacctcagcctcccaagtagctgggactacagtcatgtgccaccatgcccagataatttctgtattttttgtagagccgaggtttcaatttcttacccaggctggtcttgaactcttgggcttaagcgacctgcccaccttagcctcccaaagtgctggaattacaggcacaaactactgcacccagcctccctttacaattcttaaattttttttagtcttgttactcttgttagggcttccccactatgttaaatagtattgattttttattttattttattttttgatacagagtcttactctgttacccaggctggaatacagtggcacaatctcagctcaacacaacctccacctcccggattcaagcaattctcatcccttagccaaccgaatagctaggattgcaggcacacaccaccacacctggctaatttttgtatttttagtagagatggggtttcaccatgttggccaggctggtctcgaactcctgacctcaagtgatccaccagcctcggcctcccaaagtgctgggattacaggtgcaagccattacgcctggcctgattattattattttatttttattttttatttatttatttttgtttttgtttttgtttttttttgaaacgaactcgttctgtcacccaggctggagttcagtggcccgatctcggctcactgcaagctccacctcccgagttcatgccattctcctgcctcagcctcccgagtagctgggactacaggcacccgccaccacccccagctaatttttttttttgtatttttagtagagacaggttttcaccatgttagccaggatggtctcgatctcctgaccttgtgatctgcccgcctcggcctcccaaagcactgggattacaggcatgagtcaccatgcccagccctcattattatttttaatgggactgtgtatgttttctatttatttgtaattttactgtttccctttttccacattttctgcagttattgggtatgacttttataatcagaaaaacaatattttcacttgctttcttaaaaataaataatctcttagtgaaggcctgaggggtccttataggtgtaatatggatggccatggagctgctatggcttcaggctttatatatatgaggtattgctgtctattcacagtattctctgacctttaaatttatgtggcttaaaatctattttcaatgcataaacatttgtatatttttccaggtgaacaatgtactacctagatgtataataatttaaatttagtgtaaaatgagattttttacaacaaattatatatttccaaaaactttaaaatgtttaaactctacataggcatatggtggtctactatatataaaaggtttctgggaactatttaagaagataaaaatagagccactgacatgtatttgtactgtatctttgggaaaacaatttcagcgtaatatatacttgtaaaaagtgaattagtaaaactattctggccgggcacagtggctcacacctgtaatcccagcactttgggaggctgaagtagaaggattgcttgagcccaggggttcagaccagctgggccacatggtgagactccatttctacaaaaaatagaaaagttagtcaggcatagtggcacacacctgtagttctagctactcaggaggctgaagtgggaggattgcttgagcccaggagtacaaacaaaaacaaaaaaaactttattcctccaagtttaaaaagtgcagcttgcttacttgttgacaagctgctgaatatagaatgaacagtaatagagtctactgggttttaggttccagctaccatgaaaaactattaaggaactataaatagaaaagaaaaaatggactcataaagactttgttcatttccttctaaaatatccctagcttattaagtgtctccattaaggcttccgtacccactgacaatatttcttgattctctgtaaatgacactaagaaaattctagatgctatagctcttctatagtaactacatggaatagacagcttaagttaggaaattacattgccttttgagcacaccagcaatcctacctctgtgtgctttgaggaaactagtgtagcacctcctctttttgtacaactttaacatatgtttcaggtctcatgtcaaataccagatacaatttgtcaatttattgatcacattttgtaacatcagtaaaagtctaaataaaatcaaccagaagataataggctacaccaattgttaatgaacagaggtttatttggaaagattgttccaggattcagagccagctaacaatagctctaggaacccaatttattgtcgatgagagattctcaccttatgcctcgtcagctagaggacctaaagtctataacgtctcctaaagctgggaaaagcctgagaggcccaggttgatacgcctatgtgtaacaggatagagagaaggaaccaaagtaaaaaggcaacaacaactgcctcagcatatgagttcttgatttggaaaaacctgcactgatggttcttgttctctggtgtaatgcctcctatgcctgctctcttggctgtgttgaaaagcatacatacagagctgtgctcttcattttcaagatgatgtactgataaggaccacaagccagtggcactgggaaaaagggatcctaagagactttttcttattaaacatacattcaaagtcagttatttaatattttgctttttggactcttggtaagcccaaatcttgttctaaaaagagcagacttttttgttttgttttgttttgtttgagatagtgtctcactctctctcccattctggagtgcagtggagcgatatggctcactgcagccacaacctcccaggcttgggtgatcctcccacctcagcctcctgagtaagtagctgagactacatgtatgtaccaccacgcctggctaaatttttgaatttttttgtagggacggaattttgccatgttgcccaggctggtctcaaacttctgggctcaaatgatctgggtgcctcagcctccctaagtactgggattacaggcatgagccaccaggcctgacttgtttttgtttttttgttgttgttgttgcccaaactagagtacagtaggctcaatcacagctcactgcagcctcaacctcccacctcaagcagtccttccacctcagcctcccaagtagctgggattgcaggtgcatgccaccacgcccagctaattttttttttttttttatgtagagacgagtctccctgtgttgcccaggctggtttcctgggctcaaatgattctcccatctcagcctcccaaagtgctcagattagaggtgaggcatgagccacccaacctagccttttttttttttttttttttaatacctgcaagccacatttatctgctatagtgtttaccaaccacactctggggcctgaggctgtgtttcagtgaatgaaatattaaaaagtactttgtttacttgctgacacagtacagtatttgtatctattaatagcatattgttattgttggttttttttttcgaaaaacactttattggaataatatacttaaaatgcagggaacttttaaaaatagagtgaggccaggcatggtggctcacacctataatcccagcactttgggaggccgaggcaggcggatcacctgcagtcaggagttcaagaccagcctggccaacatggtgaaacccgtctctactgaaaatacaaaaactagctgggtatagtggtgcatacctgtaatctcagctactcaggaggctgaagcaggagaatcacttgaacgctggaggcggaggttgcagtgagccaagatcacaccagtactccagcctggatgacagaggagactctcaaaaacgataataataattataaaatagagggtgaaagaccaaacatcctatagaaaaataagcaaaagataaaaattaattcacagagagatttgttctttaaagatatataaaaagatgttcagcttcacttaataagagaaatccagattaaaattatactgaaatatttctaacccatcggactggcaaaaattcaaaagctggacagtgtactatattggtgaagttgtggggaaatgggcactcttacattactagtagaaatagaaaatccttaaacctctatgaaggagaatcactaataaaactatgtatgcatatagttactcattaacctagcagttctacttctagaatttatcctgaagatacgcccctaataacacaaaaatacatatgtaaaattttattcattgtagcattgtttatatttccaaaacattggaaactatgtaaatgcccacacataggagatagattaaactacagtgtatttatacatggagatactatgtagctgtaaaaaagaatgaagaaaatctctaccaattgatgtataatgattaccaggagattttggtctctgactacaggagtctcgctctgtcacccaggttggagtgcagtggcgtgatctcggctcactgcaacctctgcctcctgggttcaagcgattcttctgcctcagcctcccaagtggctgggattacaggcacccgccaccacacccggctaatttttgtatttttagtagagacaggatttcaccacgttggccaggcaggtctcaaactcccgacctcaggtgatccacccgcctcagcctcccaaagtgctgggattacaggcgtgagccatggcacccagcctccaagagatacttttaagtggaaaaaaagcaaagtgtaagagagcatatatagtgtattacctccttttgtgttaaaacaaaaaaaaaaagaaaagaaaaagaaagaaaaggaagaaaatgtacatacatctgcttacctttactaaaagaatacaggaagataaaccagaaaacagtgaaagtggttgcttaaagggatggtgaggaggacatggtaaagagagtcactcttctttgagcatatcttttatagaatttttacttttagaaacatgttaatgttctacatattttttaaatattaaatcaataaggatagaatgtaagaaatgggactaaaactgaaagcaaactgaaaaacatgaacccaactatttccaatcttttcttaagtaaaatgagctccccaaagggggtaaaaaagagaaccaatctaagttacatgctgaacacagtatttgactacaccagagaacagaaaattaaccctaaactctttttagtagatttggatttttttcttttaaagttagggatgaagtgacttggaaactattttagatgtattacaaaagtgagtaaacaaataaatttgttgatatttttgggagctaggttctcactataaaagaaggaacatacaaataatgggatgaggaaaggcaagaaagaaccctgtggagatggactagaattggaagtactggtgtcagctcaatttctaaaataggtctctgtacacatgtatacgtatacagttatggatgtaagtgtgtgtgtgtgcatgactatgtatacatgcatacttcccagctctgttcattaacatggtctagaagcaaagagcacagctgccacccagatcttggtctctaataccattctgtgctaaaaagaaccagttatcctcagataaatggctgattccagggcatagtagagcccagaacattatgccagaacataaagaagggatcaaaaataatgtgatggcatatccaatgacacgggagccaccagcctgaacggctcccactggcaaaaactggaatattttaaggaccaaattaattaagggctgtaagggattataaaccattgatttaaaaagaattgtgggccaagcatggtgtctcacacctgtaatcccagcactttgggaggctgaggtgggcggatcaccttaggttgggagtctgagaccagcccgtccaacatggtgaaaccctatctctactcaaaatacaaaaattagccaggcatggtggctcatgtagtcccagctgctacttgggagactgaggcaggagagtcacttgaactggggaggtggaggttgcagtgagctgagatcgtaccactgcactccagcctcggtgacagagcaagactccaccacacaaataaaataaaaataattgtgcattcttattgataataaatagattttaaaataataaatgggagaagaggtaggctcttgtttatggtagaatggtgagggctgactggtaaatgtgaaaatcatttcacagctgcagttggaaaatcatcacagtatgagttgcttcagttaaaaattatgagtggatactcaatctgggagggggttgggacttttgataaagaacagaatatttatgtgatttttttttttttttgagatggagtctctgtcgcctcggctggagtgcagtggcgtgatctcagctcactgcaacctctgcatcccggattcaagcgattctcctgcctcagtttcccaagtagctgggactacaggcacccgccaccatgcccagctaatttttgtatttttagtagagacagggtttcatcatattgaccaggctggtcttgaactcctgaccttgtgatccgcccccctcggcctcccaaagtgctgagattacaggcaggagccaccatggccagcctaatttgatttgaggatttgctcagtctgtcttccttccttctttccttccttccttccttccttccttccttccttccttccttccttcctctctctctctctggtctctttctttcttttttctttttttttgagatggagttttactcttgttgcccaggctggagtgcagtgacatgatctcggctcactgtgacctctgcctcctgagttcaagcagttctcctgcctcagcctcccaagtagctgggattacaagcaagtgccataacacctggcaaatttttgtatttttagtagagacgaggtttcaccatgttggccaggctggtctcaaactcctgacctcatgatctgcctgcctcggactcccaaagtgttgggattacacgtgtgagccaccgtgcctggcctatgtgatcttaaattgtctattcacaaactgcttgttagatgcaagggaaaaaataggtactatacaatggagaagtaggacaacaccttgatcaggtggtcagaattcctatcaccagtgcacagcagatggacatgatgtgcctctaaatgtgacactttgagaaggatccatcataatgtgtgtagtagtctgcctgggtgtgcatagtctgaacttaatcatgagaaaatattagacaaatccaaaattagaatcagtctattaaaaatgggaaaataaataagtaatgggataagcgcgtcagacacagtggctcacacctgtaatcccagcactttaggaggctgaggcgggtggattgcttgagtccaggagttcgagaccagcctgggcaacatgacaaaaccccatctactaaaagtacaaaaaaattagccaggcgttgtggtgtgcacctgtggtcccagctacccgggaggcagaggtaggagaatcacctgagcctagggagttgaggctgcagtgagccaaaaaaaattatgccactgcactccagcctgggcaatcagagtaagaccctgtctcaaataaataacaaataaattaaaaatgaggtgaggtaagttatgactatattcttcaaaaatgtccgtatctcaaaagtcaaaatctgaggaaatgttccagatttttaaaaactataaagataccacagttaaatcctgaactagactctgttccagaggagaaaatttccataaaggatattattgggtaattgactaaattgaaatatggacagtagattagataacagtgttactgaagttgatgttgatgtccacactgtagctatgtaagagaatatccttattctcagaaaagatacactgaagttttcagaagtaaaaagacattgtaaatgtaacttcctctcaaatagttcagggaaataaaattgtatgcagagaaagagtacatgcaaatggtgcaaaatgttaacaatattgtgcacctgggtagatgatatgcagatgctttttgtactatttttattcctgcaacttttttctgaatttggaatccttttcaaataaaatacattttaagcaggctaataattaaaaatctaaactaagattatattgggaaacattatgctaagtgaaataagctagacacaaaaagacaaatattgtatgatctcacttatatgaggtacctagaataggcaaatttatagagacaaaagtagagtagcagttaccaggggctagaagtaaagaggagtggggagttattgtttaatgggtacagagtttcttttggggtgatgaaaaacttctaaaaatgcatagaggtagtagttgcacattgtgaatgtacttaatgtcactgaattgtgcatttaaaatttgttaaaatagtaaattttatgttacgtatatttttcaaaataaaaaagtatcttggggatgtttacttccattataaaaggattccctacaattatttaaatataagctccctttgtttatttaaacaattttatacagctttcaagattcacatcagatactttttgaagattccacttataactgattatgtagtatctgtatttcattttagttggtttttaaaaatagattattgaaaaactgacattcaccttgggcaaaggtcttagcttttttcagcatccaggttctccacttgtcaaagcaaaagattcttcagaatacttcattcatcatctagttctcttagaaaaaggatgctggtggttttgcttcacaaaaatatttcataaacatgagctttttctttttctcacaatgatcataccaggcggaatgaagaaaacagatgttgcttataaggcgtctaatagacatgtttgcattgtaagctgatctgactctgaatttggcatctgctccattcactgtgtggactgagcattttcgcctcacagtttggcagaaaagttaatattgacttttgactgttacctgaaaacttggtgataaaatactcttactaaacctcttgagagagtgattttacagtctcagcaaatgtctttaaaatacatcattctattaaccattttaattttattctttggttgggaatacttatttgtttcatctaatacagagcattccccaaatctgactgggaaaagtctgtgtggtcagaatggtagaagaaggaggacataaatcacttataatgttctctacaggtcattataccacagcttctcaattaaccttcatccccctcaggctgcccagggcctcagggaaggcccagaagcctagctgcagcacagtttctcattattatctgctcttctgagtatttgagtgttaactgcagcagctcagcagctcaggtttcccctaaggggaaggtagcccagattcttctgctcttgacctgtcttatttgcaattatcctttttttcttttttcacagttttattgtggcataatagacatacaataaacggtatgaatctaaagtttacaattgtataactttggacatatgtgtacacccatgaaaccatcactatggacatatccactgctcccatggccttttctaatcatgccttcctgctccttctcatccccttttggattgtttccagtttggggctattacaaataaagctgctgtgaacattcatttacaagtctttgtgtggatatgtgctttcacctaccttgggtaaatacctagaaatagaacggatcatatgatatgcacatgtttagctttttaagactgacagatggtttgggaaagtggtcttagcattttacattcccacaattagtgtgtgagagttccagttgatcacacccttgccaacacttgttatagtcagtcttttcagttttagccattctgcgagtgtgcagtggtatctaattgtgattttaatttgcatttctttaatgaataatgatattgaacattttttcatttgcttatttggcatctatcttctttgctaaaatgttaaatacttttgcctactttgtgttgagttgtttcttgttattgaggtaccaagtatttaattgtgacaaagttcagattattttttcttctataaaagttgcattcttagccaagtgtggtaacttatacatgtaatcccagtgctttgggaggccaaggcgggcagattacttgagcccaagagttcaagaccaacctgagcatctctacaaaaaaatgcaagaattagaggaaagctgaggtgggagaagagcttcagcccagaaggtcgaggctgcagtgagccatgagtgtgccactgcactccagcctgggtgatagtgagacactgtctcaaaaataaataaatttttaaaaaagaaaagttcatactttttacctcttactaagtgatctttagcaaacccaagatcactaagattttcttctatgttttctcctcaagagttttaggattttattccttacatttatgtctgtgattcatttcaagtgaatttttgtagatagtgtaaggtaaaggttgaaatgcttttttttcacacaatttgttaaagtgtcctttcttgatgggattgtttgggcacctgtgtcaaaaatcagttggctatacagaagtaggtttatttctggactctgttcagttccattgatctatttgtctatatgctaataccatagtgtcttggttattatcattctataataaattttgaaatcaggtagtataaatcctctggctttgttcttctttttcaaagttgagtttttgctaacctaggtcctttgaatttccatataaattttagaagcagcttgtcagtttctataagaaaaatctgctagaatttttattagtattccaatgaattaatagaaaaattcctgcagaactgataatattgaatcttctgacctttgaacactttatgtctatttatttaggcttcttttatatttctcagcattgttttgtcattttcaatgtgcaggccctacacaacttctgtcagatttattctaaggtacttcaaatatttgaagtatgtgaagtaccttagaataaatatggataaatattcttaactttttaatcaatttttgtttttgagacagggtcctactctgttacccaggttggggtgcagtgatatgatcatagctaaccacagccgcaaccttccaggcttaagcaatcctctcacctcagcctcctgagtagctaggtctacaggcatgcaccaacatgcatggctaatttttgtattttttgtagagacaggatttcgccatgttgctcatgctggtctcaaactcctgagctcaagcaattcacccatcttggcctctcagagtgctgggattataggcatgagccacgatgcctggcttattcttagtaacttctaattgttcattgctcgtatgtataattatatatacacattaccagtatagataatttacttttgtatttttagtagagacggtgtttcaccatgttgattttgagaccctatcaacatatgcttccctggctgggtgtggtggctcacgcctgtaatcccagcactttgggaggccaaggcaggcggatcacctgaggtcaggagtttgagaacagcctggccaacatggtgaaaccccatctctactaaaaatacaaaaattagctgggcgtgatggaaggcacctgtaatcccagctactcgggagcctgaggcagaagaatggcttgaacctgggaggcagagattgcagtgggccaggatcatgccattgcactccagcctgggcaacaagagtggaactccacctcaaaaaaaaaaaaaaaaaggaagaccagattgacttgatggcaagttgttgtgtctcaacttgagctctttagaataaatattaggggaagctcatgatgtttgggaaaagatctcccgaccgggcacagtggctcaacacctgtaatcccaggccaaggcaggcagatcacgaggtcaggagtttaagaccagcctggccagcatggtgaaaccccatctctactgaaactacaagaattagctaggcatggtggtgcatgcctgtagtcccagctattcaggaggctgaggcaggagaattgcttgaacctgggaggcggaggttgcagtggccaagatgatgccactgtactccagcctgcgtgacagggcaagactccatctcggggaaaaaaaaaaaaaaaaagacctccctaacggtaacgcacaagactttctcttactgtcaaggctgaagaatgagacaggtgcttagatcatatattggtctgacccaatatgacatttctgctgctgttatacaatactcatgtgtttttttttgcctgtgttctaggttttctgtctcaactggtctctgacaagcctctgactgaatgtatccgtgctggccactatgcagcaagcatcataattagacggactggctgcacctttcctgagaagccagacttccactgatggaagagctgaaaacacaagcccaggagtgcagacactgccctaattgcttcctgagaattcccatattaataaagaagaaaattatctgccattttttcctactataataatgctgaatcttaatttagagggtacaagggtatggtaatgcttgtagaatctttattatctcaacaatctaaaaaatgatgtttatttccatagtttgatagtgccacttaaatgccaattaaacaagaatataacatttcaatagaaatttttatttcattttcaattactttgtaaattcgtgtgtatttagtacactgatttgtttttttacatttctgctttgaatgcagatgcaatttaatataatagattttttaatgaattaatcttaacatagtaatctttagctttttatacaaatatatttaatttaggagtatatgtgtgtctatacacacacatacataaatataccacatatacacctgatagtcaaataaggtacagaaattttatcttgtcaattatgccaaataatctctttaatgtgcactcaaacatgtaataaactttggataattaaataatgtgccaaatttaagttgtaccacaatattcaaatcatagtcttatggaactctgtaattggacacaaacaaaaacttgtcatataggaatttttttctgtcttttccctgtgtacagcaaactgaggaagaaagatcattatttaatactgggccctgaaatgacacccaatttgttaatggaattatgaagaacagcaatataatacactgaagaataacttagtatcagagaccaataaatcacttttttaaggatgacaaaatggtataat

SEQ ID NO: 693 - DNA, 532817 bp, Homo sapiens; identical to SEQ ID NO: 692

SEQ ID NO: 694 - DNA, 558121 bp, Homo sapiens; identical to SEQ ID NO: 691
